United States Patent 11,401,555 (GENETIC POLYMORPHISMS ASSOCIATED WITH STROKE, METHODS OF DETECTION AND USES THEREOF) - sequence listing, part 5

SEQ ID NO: 368 - DNA, 1480670 bp, Homo sapiens
atatttcttaatttattaagaccttctttgatttttaataaacattccatagttttcagcatacaaattctgtttatatttttatatctaagtgctttaagtttttgagcaatcataagtagtatttttaattttggtggctacttgtccattgttcatatagaggaatacaacagacttttgtacgtttatcttgtgtcctgtgaccttgctgaactcacatattggttctatgtgtgtgtgtgtatgtgtagattacttgggattttctacatagaaattatgttatctgcaaataatgacagttatatttgtttcttccagagccgtatgtatttttttaaatttccttattttactggctagaacttccagcactgtgttgaataaaaacagtgtgagcagacattcttactttgtttatgatcttaagggcaaagcattcagtcaagcaccatggttagctattggttttctgtagctgctctttattaagatgaagaagttcatctctatttttattcttctgagagtgggtgttaaattttgtcagatgctatttatgtgtcaattgatataaccatgtgtttttttcttctttagctgaagaatgtgctagattacattgataggtttttgaatattgaaacaacttgcatccttggagtataccccagttggtcatggtatataattctttgtatatattgttaaattctgtttgccaatattttgttaaggttttttgtgtctatatttataaaggatattgatgtgtagttttcttttttgtaccgtttttgtctcattttggtatcacgataataacttcataaaatgaattgcagtatctcccttttctctattttctggaagttattttatagaattagttaattaatttaaatgtttggtagaatattccagggtaaccatctggacctagagattttattttgggaagtattttaattatagatttaatttccttaatagttatgtagctattcaaatgatctcttccatattcaatgatttggggtagacagtgtttttttgaggaattggtccatttcacttaaattatcaaatttatgtaagtattatcaaatttatgtatgtattcctttattatccttttgatatgttcgggggctgtagtgatatcccttcttttatttctgatattgacaatttgtgtcttctgtctaactttgtcagtcttgcaagatgcttgttgattttgagcttttcaaggaatcatctctttgttttattaattttctatacttatttcatttttactttcattagttgttgcttttgtctttatcttccatttactttggatttattatttttttttaggttttcgagatgtggccttagattataaatttgacttcccccccttttctaatatatgcagttagtgctataaattttcctctcagcactgctttagttatgtcctataaattttgatatgttttatttttcctttagcttaaagcactatttggttttcttgagacttcctttttgacttatatattatttagaaatgtcttatttaatttacaactgtttacttgtttttgttgttgttgttgtttcatttggtctaatgttggttggcacatgcactgcatatgatttcaattattttgattttgttgaggtttgttttgtggtccaggatgtggactatcttggaaaaaaatgtgtattcttttactgttgggtggagtgtttgataaatgccaattattaatagatactgttagttgatggtgttactgggttctatctctttgtgattttctatctagttgtcctatcgattattgagagaagggtgtgaagtctaaaactctaattggatttatctcatttttccgttttcagtttttgcttcacatactttgcagatttgttgtttggtacagttacatttaggtggattgactcttttatcattatatgttaatcctccctgtttttgtgattttttttgtcctgaagtctaatgtatttgatattaatagagccattcctgatttcttttgattatctttgtgtgatttatctttttctatcatcttattttcatcctgtctgtatcactctattagaattgaattctttgtagatagcatatagttgggtcatgtttttaatctattttgctattttctgtcttttacatatttagactctttatatttaatatcatcatttatatgtaagggtgtaagtctactatttcattgttttctatttgttctctgtgtttctcttttctttttctgccttcctgtttgttacttgaattttttttaatttagtattttgatttatctatggtattttgaatgtatttctttgtatagctttttaagtgattgctctaggtattacacacacatgccacacacactcacacaatcatagtctactagtctcattttaactgtccatgtgaagtgtggaaacctttatgtaatcctccctttatgactctttaccctcccctatttataattttaaatattttgcctacatgtagttagaaccatgtcacacagtgttataatttttatttcaatcatcagacagaatttagaaggctcaaaggagaagaaaagtctatttgtccacatttttgcttactgtgttgttcttcctgatgttttgatttctcttttaaaaagtcattttctttgtttagggaaattttgttagccattatttgaaggtaggtggtctggcaataacttctttcagttttctttcatctgaaaatatgttgagttttcctaattcctgaaggacattttcacagataagaattctagattgacagtcattttctttctgcatttaaaacatgttgtgccacttcctctggcctctatggcttttgatgagaaatatgctatcattcaaattatttttccattataggcaagatgtcatttttctctgactgttttcaagatttttttttggtcttcagttttggaagttctgatatgttattgtagtcagctcagattgccatcacacaatatcatagactgaggtggcttgaacaatagaaatttattttctcactgtctgtaggctacaagtctgagatcagggtgccgggtggtcaaattctggttggggctctctttctggcttacagatgagagagttctctctcttcctcttcctataaggctactaatcctatcaaattaagaccctacccttatgacctcatttaatcctaattgcctcctaaaagccctatctccaagtacagttacgttgggagttagggcttcaacatatgaattttaggggtgcacaattcagtccatagcatgtgccatcatgtggatttaaacattttatttaacctgcttgcactttactaatcttcttgagtcatttagtttgatgtctcttaccacagttggggagttttaagttattacttctttaagtacttttcagccatgcctcctttgtcctcttcctcttggacttcattacagaaatgttacaccttttgctatagtccacagaccctgtggctccattcaccttcttctcttttcttgctgctgtttagattgggtaatgtctatcttccaattaattgatttttctccccctctgtgtcctccattctgctgttgtgcccattcactgcgatttttattttggttattgtagtttatcagttattctgtttttttttcccattcttaaaatgtcatttttgttcttatttatattttctttttagttgcagagacttttatttcattgctgagactatactccttgaagcactttttttgtttgtttgtttgtttgtgacagagtctagctctgtcacccaggctggagtgcagtggtgcgattttggctcactgcaacctctacctcccgggttcaagtgattctcctgcctcagcctcccaagtagctggaattacaggcacatgccaccatgccaggctaatttttgtatttttagtagagacagggtttcaccaggttgcccaggctggtcttgaactcctgacctcaagtgatctgcctgccttggcccccgcaaagtgctgggattacaggcatgagccactgcccctggcctgaagtgcttttaaaatgactgttttagggccaggggcagtggcttatgcctgtaatcgcagcactttgggaggctgaggtgggcagatcacctgaggtcaggagttcgagacaagcctggctaacctggtgaaaccctgtctctactaaaaatacaaaattagctgggcatggtggtgcgtccctgtaatcctagctactcgggaggctgaggcaggagaattgcttgaatccgggaggcagaggttgcagtgagccgagattgcaccattgcactccagcctgggtgacaagagcaaaactctgtttcaaaaaaaaaaaaaaaaaaaaaagtatgtaattctaacatttccatcattttactattggcatctattgattgtctctttttattcattttgagatcatctcagttcttgctatgatgtgtttccattgaaacctggacactttggttattattttgagactctgggtcttatttaaactttctgttttacttggctttgtctgacacttctctgtcggggaaaggtggttgggggaaccacctccttactatttcattcaggtaaaagtctaggttctctacttggccaatattgacacatgagggtggggcttgttactgttgggcagagtttggaggtctggcttcctatgaggcctccattgatacctccctatctaagagtgaaagaaatgccttgttactattccccatgtggcctccattgatactgtgatgataatggtggaattgcctcattatgttgggtgctggcaaaagtcctggctctctactaggacttcattgacataaccccgaggggatggggagtggtgatttgtttctgctgaatagaaataaaaatccaggctccccatgtggtctcaattgacaccatggaggtggagggttttgttgttacatggcagagatgaaagtcctggctcctggcttggccttatctgataccactcaggctggcaagttgagaccccattatagcctaacaagtgtgagggtctatgttcctcagttgttcttcactggactgggtagatatgggaccacactctttctgtgatgtttggctggagtatggaaattgctttgtgaaagttttttgtcttcctggttctttgactagagatagcaggccttctatggggctttttgtcacattaccaatttattcaatacttagtctgagatatgcgatacaaaacaaaaacacagaaaacttattgctgtgtcattctttagatctcaaggtcctgaattagtatacattctcctatcatttcttatggttgttttatatatagtataaaaacaaccatatacataataaaaatacacataataaaatatttaaaaaatcttatgtttgttttatatatagtatctagagtttttagttgtacttaatagaaggaatagaaacaagcatgtatactctattctccctgaaacagaagtctgtgcacttgtttcaaaaacaccaaagcatttgataagtgtatgagaaatgatggtcaattacagtataggctcattttggaaatacgaaggttcccagggagctgtccagggtgctggactctccttaaagctctcagactcagtgcatgagaattttccatttctctgtcttctaatttcttcttctgtttaacctttttaaataccagcctctaactactctgctctacccttccatactcaatgtctaactgctgcctggtgaatttgtggttagttggcccttaataactagtgatgcattggctatttttgacagtaatttttatttgctatccattctagctattcgctagtctggctgaatccttgggaaattcacaacactgtcatagtcttcaattgcttgtgtcactgccacctctagccattaagttgctctgttttgtagaatggtagaaaaagtcctccggaaaaatgcaaggcagcagagaggcccctccctcaagatcctaatagtgtcagagggaaactagaattagctatgtaactaggggaaattttctcacatcatttatctatactacatttactattctttgtttttacaatatctattgtaacagaaaataaataattgaccagtctgtgttttgttttctttttctttcagtatttgcagagaaataactgtaaaacattttacttcattctattagaaatattgaaaggggatgatgcagccatggcagaaaaaggcattattcccctttaagagaaatttctctcagacatagaaaaaatacagcagtctcctattatgagttgaccttggagccaagaagtagtagttattccctccatccattccattactaatacagcaggcaaaagtcagaaagattagtttcaaaatttctataaactcgaagtaaagtttcagctgtcttcctttatctgacagtgtttttactggtggtacttttaagacttaaaccaaccataggcaactattttctcttcttgagctttatgggcatcttttatagaaactttacctagctgtcagtctattaactcccaagtatttagtttgattcatcggattgcggatatttctaaaaggtaccgcaaaaatacatgggcctgagaatcctcaagggggttggattccagtgagctagtgaaggatcttcaaggtgtttattgagcacttattccctggactgtgcatgatgctgtataggcattattaagttaaacctgacaattctctaagttatggacttagtatgtaattgatggtctctgtcttcaaagtggaaatacactctccactgtgtttatgaaaatcactaaatgactgcctggctgggtgtatgcagtcggtttctctctgattaccagtgatagattatcatgattaatcctcaccatttcccattctcctctgcaccctcccccaatttttatgatgaaaaccatcttcatctgtttgtgctgctataataacatacctgagactggggaatttataaacaagggaaatttatttctcacagttctggaggctgagaagtccaatatcaaagtgctggcaggttcagcatctggtgaggaccctgttccctgcttccaagatggtgccttcttgctaatcctctggaggtgacaaatgctctgtcctcacacggtaaaaggtggaaaagcaaaaaggtctaagttagttccctccagtcattttataaagcactagtggggtcccaaaatgccactttttattttttttgggatggcgtctttctctgttgcccaggctggagtgcaatagcgtgatcttggctcactgcagccaccgcctcctgggttcaagtgattctcctgcctcagcctcctgagtagctggaattacaggcacccgccaccatgcctgactaatttttgtatttttagtagagacatggttttgccatattggccaggctgatcttgaactcctgacctcaggtgatctgccctcctgagcctcccaaagtgctgggattacaggcgtgagccaccacgtctggcccaaaggccactttttaataccatcacaatgaggattagatttcaacagtggaaggtggaaaagcaaaaaggcctaagttagttctctccagaccttttataaggcactagttgggtcccaaaaggccactttttaataccaccacaatgagtattaaattttaacataaattttggaagggacataaacattcaattcataaatcaaaggcagatattatgctcctttgcttgaacaaatagccagtctctggcaatggaccattttctaacttgtataaagctggctggcccacataaggattcaatctataactcatacttaacttcttgatctaaccagctaaactattcattatagttaaaaaggcaatacacaatagaggaacatactcactagtttctaagttttaataatttttaatgccttgactagatcaaactagtaagatacagagcctgcattcgattccaggtttgctgaattccaatgttgtacagctttaaaaagggaattattgcatgctttaaaatggtgtttctgtctcactgcatgtggtgagtgatgaatcactgaatggatgattaactgttctgaatggtgcggtttattacacattgtacattgtgtgctatgcaccactaacctgcataggatctatgtgtgttcttctgaatattgaaaaaatgaggaaaatggtactttctatctgcccttgaggatgttatgtgtgttaataaactagcatctttgaagaaaagatccacatgcaacgaccttttcacttgatagcaagaagtctgaattagtgaaaagtcagaataagtgattacttggaattttaaaaaatcaccttcaagaacattcagtagtgaaaacaaagatttactaagtggattgatgggtcttttattgaatatataataattcttaggaaattcctatttatatgaattataagtgagtaggtgctgcccaagtgcttaaaagccgtttgttcttttaagaatctttaccattccttctaagactttggagcgtttggtgatgtccttaacaagccattgtatatagcagaggagtaaagtggaatcacacataaatggtcacatatttcaaatatgaagatgtaaacagtttagggtctactctgagcacctacttagtgtagtagagctgagcagttgaagtcatttgttctgaaatcacataggtctaatcctgaaatcccctcttaaccatgtgactttggacaggttacctagtatctctaacatcacctgtgctcatttctaaaatggagagaatactgattagacatatcttatacgatttgggggctactaaataagataatgcatgaaaagtactatgaatcatatttacaacataataaagatcagctgcttctattattaatattaacactattaaggagtaattttacaaatgatgctctctccctgtgagaggttatgggtaacaactgagtctatatttgttggcatcataagaagacaactccatatatagtattctgcccccggatttctgcttcttgtttgaggtgggagcaaagaaatgacaggttcaatccaaaatatctttgagttgttcagctaaccgtgggattgggtgaaggatttaggaaggctatgttttggatctgaaataaggggatttcaagactcctgtatttactacagaatattccaaacttttgcagctaccttgaaactatgaatcagccaataggaagaaggggccccaggtaactgctgtagaaacactgccggctttcgccctgacttcttttctgctcactgcagtagcaacttagcttcaaaatgtcctctttagtcatgcattctgatcaaagtagttatttaaagattgtggctaatagtagagtagatacccctggtatttcccagagcagagctcgcattctgggaatcttaggtccatgtgacttcctgagtcagtgattcacactgagaaaagagataggtttggcatgacacaatctgcagattcaaataaatcccctgggagaggatgaggctgctgagagtcctctttgctggctgaagctcccagtgtatgcacaaaacaccctgtcccgggccccagatgtgtgcaggtttctaattgccggtgctgcactaagatttgaagggtgagagagttgcaaaatcacgaacaccgagggcggtgttaggaaggcagcttcctgcacactgttgtaggtgttagtgagattatcaattgctccgggagagacacaggactggagggcttgaggaatgtggtggtccctctcttcgttgtttctgccccctgaggttgtgctttctcagggatatgcactctgcacttccattcctgcagtgaaattaactcgagcttggcaggtaagtctttcggctcacctttaaaaagaaaagatatgtgagctgcggtgggggtgggctgttccccatttgccttacattggatgtattttattggtgcaaagtggtatttggaagcttaaatgtggggcagaggtttgaagtagccaaatgaactctgtggccctgagagaagagaaaggataaccaaaagaaagggaaggggactcaggcatttttctcctaataaatctctaatttttcttggaaattttgcctccaggccgatgcctggccccagaacagggtctttggcatgagttatagctgtgatgttccctattttcctttttttttttttttttaagttgtcgctgcatgggagcaggcagacagaaacagggttgcatgttgtcaatacaggctgcagaagtcaataagcagccagacagggaatgaaattggaggaggcagctatagatttcttaggttatttcttgtgagtttttcagaacttgtgtgattcaggcttgtcagatactattttgagctgggctgagacaaacacattcccctagtgcaccagatattgcctgcagcctcccaatttctggaggcacctgggtcggctttcttgggggcaagggaatgtccaaggaaaggtcaggaatgagggaattggaaactatgatgggaaaaacaactgttttactgctctagaatctaacagaaatcataatgtcaccctggagataattattatgctgttagtgatcggcttgagaccagggactgtgcctcattcaattcactgcttggatcagagtgaatactcaataaatgtacaatgattaaatgttagtatcaaaatacatacttttgggataagctcggattgatattctgggttctgcttagaatgataagatggagtaataagggagagtaatgttgattggtagataattatgaagaaatgagttctgttaaatagtagattaatatctgcaagtggaattattagacaaggacacacaaacacagggtctctctgcctgcctatcgtctgtctactttcatctctgtcttgtgtttcacttgattccagaagaatttcaggcagcttatgggacaagtttaatgaaaattaacatcattagggataaaaatgacaaaatatataggcttcatccagcaattgatcttctgtggttctacagtgacatggactacagataactgaaatgtaagggttactgtaacttcatttaagcatttattttaacctcttcttccactaatctcatgcttgatgctacaaacctagagtaaagtagatgaatgttctggccctgctgtgggtcccagtgaggtaaaactagcaaagggcagataacagtcatgcaggggattgagtcatacatggagggttgaatgttttgccctttggaggtgataaagcagataattgggtggctcttctccattccataggctgggctgctctgtcatagcttcacagtgctttgcttactttttctttcccctatttgaaactgaatcaggaagatcatatttcccttccgatcctgcttaataaaatattctattattttctcagctgcaaaagtacactattatcactgatcattccctcctcatctcagagtgtttgtcactggccacagtttatatacaagctatacaggctgcctggaacttgaattggctttagagtggatgctggggaaggggcgggggggttccgggtatctgatgaattcctgcaactgcagggctgggagcctggcggggagccaaggggattgtggacagatgctatgcttgctgggtcgacctggctcagctaatattcccagacttggagctgggggacacattcatttcattcaacccatacaaaaatatggacttaatatcaactatgtgtacggcatggaattcttggcatactcagggtgtcaaacccaggagtccctgttccccaagtagctgactctgctacccacatagcaggtgctgttacattgtctagtttatttctcttggatgggaaaataattttatcctattcacaaatgaggaaaccgagactcacatattatgcaccatgcctaacattgcaggtagtgaatggatgaatcatgagggaaactgtttacttcaactgtactgcacatctgtaagaaaagacattcaggaaagacttttacaagacagtgcatgctaagggctaggaagtttggtgagagatggctcccatggagaagtagaaattaagatgggctttgaagcatgagcagatgacaaaaaagcccaatccaaactggcttaaacagcaagggggtggttattggctcatgtgattgagaagatcaatgtgaccaaggtctggatatttctgtcttgtgtctcctaccgagttggctttatcctcaattcagctacctaaagtcctctggaccctacccccccggaagctgaaggatgactgcgggagtttcagtcccctacatagttcctggggccactttctctcattagccacaactgtggctgggggtagacaggagacagtttattctgtaccctctactaaacagcataggtaagactaatagagaataaattttgcaaaaggaaaatctgggtagaagaaggggaacgaatggttggtagcccactaatgtcccatagcagaggatttagagaggcaaggggagcagaaatcctcacagcacaagcactggtagcagtggagggtgggtaggcctgagttagaagttaagatgccagtcttctgatgttcctgggaatagatgttttggccagctatgtcttattaccagtgcccactgatcccaaaactaccttgctgcatgctgatagcgtcctcctagacctcagaggttggaggtgggggtgagagggtcttagtttactaaggtagaaatcagtgaactggtagggtcagatcatgtcagtggaaatgatcccaagattccctgactggtctgaggctgcatataccctgcactctaatagcccattgatgtcagctcttggctacctgctccagtgaaactcgggtcctaaaagtcaacaggtgctcagtgataaagcagggtacaaggagacaaagagagggtcttagggactgggatccttttgaatggtcctaagaagatatgacatttgttgtttcactaactcctaccaactcatgcctaggtttgctcaaagggcttttgtttctggaggcatatcctgaggtcctgagtgggaagcttagagcttggcccattaaaacagagagctcatttttctttcttttccagaaaagcaaagaagcatcatgggtaatgaaaaaaaaatactgcactaggaggaaccaggagacatgagtttggcctgggatctacatgtactgattcctgtttgactttgtataagcttctttaatttctgctactaagccccctatcaaggtgtttttgttgttgttgttttttctcttatttcctcagatagaattattttatagtcaagctttgttattctagcaaagaaacctggggttatgctttggaaggccatttttttcctgtgtttgaaccaaattgaatttagcaggtgcaaagggctgcagaagagacttggcaattgatagaattatagccaggattcagagggccctcaggagtcctaggcattgactctttgagccctgtgctgaaatcacctctcaagctttcctctatccaggctcttctcttgtgtgtgtaacaccatgccatgcccagccacacttgggaataatctcagattccgtatctttacctctctttttaattttgctgctcagcctctctgtgctgccttcacacatcccattagtcaacgaagtcgtattgattttatatccaaattcctcttaaacccacaccatcttgttcatccccatgttccagtgctgctcctccctcactggactcttataattgctgctttactgtgcatgggatatgagaggtcctccataaatagcatttgaacaaatgcagaatgagataataacacaagtgaaatgacgtgaaacaggcctgagttctcaatcttctacttatatgggatagacatgggttggtatttctagaaataattataggaaagaactaggttcttttgtagtcaactcaccacgtgtctgaagttaccttatttccatctcatgaagatgtttaacaagttcatgtgaaacaaactgtttctactgggaagaccatgtccaagtcttcccacattctgatggaggtgccacaccctcccctgcttctctagggtctcattttaccatcctcattttgccagcctctgggaaacctgatctaagcctatgcaatgctaaaagtgcctgcttaacagcttggaagggaggagaggcaatttatttgctcaactgaattacctgtttacacttctgatctccaaagcatatgtcagaacaagaagagaatagaagaaattgttaacattgcatggaactagggagtccacatataagagaaatttatcacatgaaaatgcttgctttctttggtggtgaatctctttcaccatcagaattgcctccctcctgtcatttaccttgcaacaaattttcctttacaatatctttactcagggtgcctttcctctgaaaacagaaacacctagttgacatctcaccactttgctgctttggttgcagcctagtgatggaatgacaagcccactccataggtgcctctgaatagcttatttcagggagctgcaagacaactatttgctcagaaaattctcacgagggtgatggttttcaaagcaggaaggagagggaattcctggtacacttcccctctgcattgctggagaaatgaagaaacacttgaaggcaaagtcataagtcaggttgaagatggtttctggtggagtggtttggagatttcatctcaagttgagagctgtcctggaatagcttctacctgacttgtttatttctcagctattaatagaaactaacagagtgaggatggtccaggaatctctcccataatgtcctacttcaggacttgaaattctgttagaaattcaattttaatatcatgggataaaacataaatgcatgaatctctttgcagaacccctgccaagggacagccttcaataaatacttacgaagctggacactaggctggttgctacaaatacaaagaaaagcaagtcatatcatttcctaccaaggagctcacaacctggatgatgatgccaattctaagactaacaagaacaggtactagcgtagatggtggtttctatatgctaggtaccattctatgtgctttatgtgctgaagtcattgcattatcacaacaagcctataagactcttaaccctgttttacaggtgaggaaactgggacactgtcttgttaagtgtcttgcctgaagtcacaggattaacatgtacaaggcactatgagagcagagagaaaagaggcgtggtcagggagtaagggagatacatgtacagaccactgatgtggactcatcatctccataactgcccctttgcccttcctttgcattcaaaattattatctctctctcgttcaatttagctatttctatgaaggggtgaaaatccctaacctcttgatatgaatttagcattcaaaggcacctgagatgaggaaggcagaaagtgttcagtataatttgggtctgcttcctgatttttctcaggtttggtcaagaggctgaaaagcaaatagaatgcaatggcaggcacacacacataaggagcttattgaaaagatagatctcaatttctagtatttccaccaggcattatgaccctgacacctttttcagttatggtactctatcagggttactttgattataagtgacaggaaaacccaacccaaactgccttaagccaaaggaaattttagagggtcccataaggagaaagtctaggggttgctctgggtctaggaataccttgatacaagatctcatgtaatattgccgggttttctgttctcttctttgaacttagttctcctcctcttgcctcatgatcacaaaattgatgcagcagctccaacccttactttacttagcttctgtctagggggagatataacagttacttttctgaattatcagaaagagtcctgggcttttctatcgttggccctattaagttacctgcctgtttctagatcagtaactgtgcccatggaaataaactacactgattagcttaggccaatgggtataagaataaatgaaagtggagaaccagtaagtctctgaggaaattcagtttacgctggagaatggtagtgacatcttcaatggaagcttcttgagtgacctatgttatagctctgttagatggcgtggtccctccagggctaacagcatctataatacctatgtttccttattctcctccttacctatcagtatgtctgctctatgctcaggagtattccacagtggctcagtggcatgaataataggaaataatgtctaaatggactataagacataagctggctttttcaatggcccttaagtttcttaactcctgagccagggttcttcttcagaccagagggacctggaacatctttggtcctacagatggtgttggttgggtatcagcatatggggagatacgtgggtgggaggagctgatgtcagaaggcctgagttggaacattggattacaatcaaaggaaaaatcttgagccttcaattgatgaaaaaacctccttagttgaaaaatgcaaaactctggcagactccttctgaggatgatgaagaaaagacaaaactctctgaaataattaaaactccgcaggagggatattattatatatggggttactagaaggggagtcaggattagggttgggattaggggagttattagacagggagtcagggcctcctgccatgggaacttcttgtcagtgatttcttcccttggccctgagataggcagcttggtggagaaggcttatacttcttagctgggtgaccttggataattcacttaatctcgctgggtctagatttcataatctgtaaatgaggataataggaagaccaagttcatgaagaaattatgaaaattaaatgaaaatgttaggtagttatgttcaaactcatgcaagcttggccaatagccaaccatttggtcaacattagtttcagttattttctccctgtctgtaaactctagagtttacaaactcaacaatttggaggtttttcttcccacgcagcacatgacttcacaacactaagcatgtcgatagtgaattaacttgtcattattgtatgggttttattattatgtttgcttttgaattagtattttgagcagttgcatcaaatcacagaacagtggaggggttctgattaagctgagcctttccctgctgcagcacaggccctgggtgagggccatttgtattaggatccctgccttgcccctgactagccagatcactttggtctctgacctcagtgtcctgattagtccacatggggataataataccttcccacaaggttattgtgagaatttgagacaattcctagaaagcctggttcttttatgagctgtgtattcattcattgtcagtgcccactctgtgggattttgcaatttaaaacatcacttccatgcatggctgtctctggaagggtataggcccagaggacctcatctggtgatggggaagccccctaaattgctcatacgtatacatgtaaaatcaaaatccaccagtgcagttctccctgcacctccccctatccaagcatggggccagggtggctgccagattgttttttccaagggttgaccctgttttcatgctcctgtgatttacttacagaagggattatcacattggatgagaggctgaatttcatagacctcaaatgtccttttccaactctgagattttatgtgtctatgttttcatttccaaatagaaaataacccttatcattgctaatggtattcccttaaggaagttacttaatctttctatttctcaatttcttatttgtagaatagaatggattatattccctacatcctaggatgggtgtgagatttaaacaaagaatgcatgtaagatgttcagcacagtgtagtaagacgttaatggtgctcactgatagacatttcttatttgggacataatagagtgacatttcctgactcacttgccattggaaggggctatgtgactaagtctggccagtgagctgtgagcccaataaggtctgtgacttctggatcagggcactgaagtgtgcatgtgtgacttctggcacagcaaccataacattcaacatggtggctgctcagtcagcctgggtcccgagcatcccagccaacataatggcaggtactgtgagagggaaataacttgtggtgtactaaggcacttgaaatttggaggtgtttttttactgttctgtaacttcatctacattgattgatacgcacattgttttatccaagataataataactaatagtacttgggcatttgctatgtgccaggtgagtattggttcacattttgcaataccctagaacatacatattattattaatctcatatttagatggggaaactaaggttagaaatgttaagtaacttacccaaggtcacccagccagtaaggggaagggtggggatttaaacccaggtcacgtgacttcagagcttgagctcttaaccgctgctcacccgactccatagaccaaacctgtggtttcatggtatgatcaactaacattaattctgctttccctttctcttgaactgcatcccctgtagtttcatttggaagtgatttcctttgttggccattactcttcagagtggtggtgaggttgggaagccagcagagtggcctgctgtgggtattgaatgctgatgttgtcataggaagtctctcatttgctttgctttgcttgactactttttggtttttaacctgttatttaagccaaagtatttgatatgggaacaggaagcctcttaagggtaaggaaggcattttgtcttcttacctttgcttgaaggcatcaagatgattgtcttgggtcagagtcagagcctgagatggggattcttctttaagtgatttgttgagggagttcttttggggaaaagctacaaggaagtgagggaggaagagcagggccagggaagctaagcaaagatgtggtatagctgaggtctagctcagcctgatccacagaggagctgagcatgacttgtgacacagagtttgctctgcattgaggcaacagggctaagtttgtttgtttgtttttttggacagagttttactcttgttgcccaggctggagtgcaatggcataatcttggctcaccacaacctccacctactgggttcaagcgattctcctgcctcagctgctggagtagctgggattacaggcatgtgccaccacgcccggctaattttctattttcagtagagacgaggtttctccatgttggtcaggctggtcttgaactcccgacctcaggtggtccggccgaggcctcccaaattgctgggattacaggcatgagccaccgcacctggcctgggctaagcttttatactcctgcatcaggtggttattggccttgggtgtaacctcccagatgtctccaggtgaagtggctcccattagctaaagacaattctgcagagaaggatgaggtgcagcgtaattagcagccaacacctgcagcagttgggggatgagtgcacttgccaggtaaaggagacctggaaggggcaccaaaaacatccactatagtgtttgaggtcagtggcccatctgatacggcttagctctgtgtccccacccaaatttcaccttgaattgtaataatccccatgtgtccatgagagggaccctgtgggaggtaactgaatcatgggggcaggtttttgccatgctgtttttgtgacagtgagtaagtcttatgagatctagtcgttttataaaagagagttcccctgcacatgccctcttgcctgtcagcatgtaagacatgcctttgctcttcctttgccttctgccatgatagtgaggcctccccagccatgtggaactgtgaatccattaaacctttttcctttataaattacccagtcttgggtacgtctttattagcagcatgagaacaggctaatacaccatcctttttggatttgtgatttttttttttctgggggtgatattgtcaagttgagaggaggtagcgaagtgtgtaaggtgtaagtgtagtggtggcatgtggccttgtcagggcctcagcacatgccttttattgacactgaagtgttgtgtgtaggactgtgtaagggcagggtggttgttgtgcacactgtcctgatctttggacctagaactgatacattgtgtctagtcaccaggggagttgtccctttctatctttttagacgggcaagttggctgccaaaaatgtttaggcaattctggtggtgttttcctttctcatgaaataggcggcttcaacctcatagaataagaatcagccactctgcctaacaatattaatactaacaccaatgccctttattaagtgccaggggatttacttgtattaccagatctattcctctccatgaccctgcaagatgggaatcataggatccatttgatggtccagaataataaatattaggaagagtcagcattttgtccaagggcacaccattaaaacagtttgcgtcaaagtagcaaagaaaataaatcacagcatcaaagaacaggagattaagagaaactgaggaaaaaccacacgatctcggaggggtagagaatactatatttataatgaagaagtctgactctttggattaatataaaaatcttgccatgtagcatgtgggagaggagagcaagggaggctcacatgctggagacaggatttggttccaatgctatctgactctaaggctgatacatctttctgtgccatggtgttttaataagcatgtaatttagaaatgtccacccacttacttcggaaccatagatttcattaaaggagagtaaaaacccaggctttggatacagacagacttgagaaacagctctaagatttgggcaaggctggtcttgaactcctgacctctctattcatcctctctatgcctcagtttcctatttgttaaatggggatgatatttagcttgcatgactgtcatatggatgagatgacagcatgtatacaaaatgcctatcatgtaaaaagcacttagtctttaccagttattttaatatattcatgaagaagtttcagttttgtcgaggagaaaagaggctgtgtcagttctttattctctcataacaaactgtcacaacatttggcagcttaaacaataacaatttgttatttcccatgagttgaggggttgactgggtaagccgtccagttagttatatttcatgtaatgttagcttagtcatttatgtggttgcattcagctgtgaacttagctgggcctgggatgtacaggaaggctccttcacaagaccttcacaactcctctccttgctcaattgtctaacccagattcttacatggtgactagatttcaagttctccaaagtggaagcatccctgctgctatggactgaatgtttgtgtccccttgaaattgctatgtcgaagcccttatccccagggtgatggtgtttggaggtaggacatctgggggtcattagagtttgatgaagtcatgacattggagcacttatgatgaaattaatgcttatgaaacgaggaagagatgagatctctgcatgcatgcaccaaggaaggccatgggaggacaaatccagaaacacagctctcaccaagaacccaactatgccggcacactgatctcagacttccaacctgtagaaacatgagatataaatgttcatggtctaatctccatctgctgtactctgttatagcagcctgaactaagacacttgtcttcttaaggtttagcctggaattggtgcaccgtcaattctataagtaaagcaagtcacatggacaatgcggattcaaggggagggaaattaaactcagagtattgttggcagaatggcatgcatgtacttgaaggggaggagtgattggcagccatatttgaagactatctctcttggatacattcatcctagatcattcataaacaaggtgattttatgagaagtttaattcttactgttctgcatttgcagtgcagacatttaccatgatgacttattccctgtagagtgggttaatgttttcagacatggcttcagaggacctggggcttcagttgagccctgaataaaggataggaaattgctatggaaggaaaagaaaagggtctgttgtatgctttgtttttttcactcacatgaaccaggacaaactcagtgtgccttgggtaaggagggtggcgacactgattttaactgtcaaattgatctagagttgtcagatgggataatttaaccctcaaatgaaggtgatttatcctatgtattgtaatcaaatagtcatctaagtcactccccatgagctctggtaaatcacttttagtacatattgaaagtgaccgtattgtattttattgcagaattgcgtcttatagtaataactaatgcatgccattggcttttgctctagcaccgaattacactcacttggaggcacatggatccaggtgggcactgttgcttccatttgcttgtccacagtcagaactgagaggcaggtaggaaaactgtactgctgcagtctttgtagattagctcaattcagagacacctgtggtcttgtgaaatgccaaactttactccagtggcatttgggtcaatgtgaactaggatgggcctagcaattctattaggtgaatgacaagtgctttgtaatgaaacagaaggactttatttaaacagatataaggactggacagaaatcaggcttaaattataccttatctgggctcctgctgtaaccttgtaactggtcttaccacttgtggtctcaagactattttgtcctgcagcccccagagcaatctccctgaaatgcaaggtcaactatgctggcccccggcttaaagccatcatggcttcccaatgcctgtgggatgttgtccacactcttagcttagcttacaaggctctccatagtctggctcctgcccacctgtccagcttcatcttgcgccactgcccattttgaactttccatgctacctacataccgtgattcacttctccacactgttgttcatgtccttctgtctgcctgagatgtgctctcccagcttcctgactctgacctcctttgcctggccaactccttctggtgctggaagatgcaccacaaacatgcccccatgggagcatgcgcagatgctctcaggctgtgctcataatttcctgagtctctcccctcatcatttcacttctcacatagcattattatgacttatttaggcctgtagctctactactagatggactgtgagctccttgaaggcaggaacccatcttaataatatgggtatcccaagaaaccagcacaataactggttggcccagaggagatgctcaataaatgtttgtggtattagtaaatttatgaaaatacctctttgggttgtcacagaagcacatgagcagtggagacaagattctcatcttgaatctgagtctcctttgatctgaggagcttcctgttttgaggttacacatttattttagagacagagtctcactcttgtcccccaggctggagtgcaatggcacgatctggtctcactgcaacctgcacctcctgggttcaagcgattctcctctcttagcctcctgagtagctggaattacaggtgcatgccaccacgcccagctaatttttgtatttttagtagagacagtgttttgccacattggccaggctggtctcaaactcctgacctcagatgatccacccatctcagcctcccaaagtgctgggattacaggcatgagcccccaagcctggcctgaggttgcatatttaggttggaattagtgtgcatgttctccatgaaggtgaaatttgtatggctctgggacctaaaagcctaggcaagggcatagagatatattagcctggggtggactggggaatgttttactagttagcattacgtgagaaattaagcaagtcttacacacatggatttgagacccagaatctgctccatttctggggcttttgtgtgttagaaataagtacagctgattatttcatttatgttggtggatttggggctgccaagcttctctgaagggcccacattttcctttggtactctatttctcattttgcccttagaaataaggaatcttggagtaaattccagaggtggtaggagaagggagaatgcattcccacattggtagctaaggttcataagctcctagaaaagaagggaaagatctctgagcctagaacatgggactcccctttcttactgtaatttgcagacagattggggcaagaaactccatgcagcttggaaacatgtcagagtgtgccttacaaggaaacaaggcaaatacaggaggaaaaaggtaggctgctgtttggtctttagaaacaagcattttcttacatccttttattcccggtatatgtcctatgaaagtcattctggtagcaatggtaatagtactattaataataatgatgtacatatattggatgtgttcaacatgccaggcaccatgccaagctttttacctggcttacttcatttcaatttataactttatgaggcagatacattttcatttctatgttacagatgaggcacagagaggcatagaaacttgcccaagcttggaggagctgggatttcaacttaatctaacacagcactgtatgttctcaagttgtcactatattacctcccaaacaacatttacactaacaagtgcagccaatgtttattgagtgctaactctgtgctgggcacattgccaacctttacatgaagagcctcagttacccctcagcaccatctttggggtgggttattattatccttatttcaaagatcaaacaactgagacttagagattcagtaacatgtccaaggtcacacagctagttcatggtgggacctgagttcattcttaggctgcttgtctcctaagcctctagtccaactttttaatttttttattttattttattttttgatagggtctcactctgtcacccaggctggagtacagtggtgtgatcttggctcactacaactctgcctctcaggcccaagcgattctcctgcctcagcctcctgagtagctgggattacaggtgcttgcctctaccacctggctaatttttgtatttttagtagagatggggtttcaccatgttggccaggcttctcggcctccctgagttctgggattacaggcatgagccaccatgcctggccatagtccaacttttaaattttggtttaggaagtgttttttatcccatccatccagatctccctctcatagtcagttttcacctcttccctggggatacggctcaaggagaactttcatcatcttcaaatgcaaagaccacgtggcaattagagtgtgggggattccaagccccttctggtgattgtggacttgaaaaacagtagtggtaatgaataattaaaggttaaacaaagggaatagttctagagactgggtgaaggggagcctgttttattccactgagtttgaagccagaacaccatgtcttggcactgacatgccttggagacttcgtattgatgatcatggctaactgactctttctcagctctcagtatcattcatagtcaggactttacatgtgtgtgtgtaatgtatatatatctgtgtgcacgtgtgtgcgcgcgcgcgcgcacgcacacacacacacacacacacacacgtaaagtcctgactaccagtgataataatacatagttttttgggggaagaagggatgcctcttgtatgcacagcactcaacttctgcttttgggcagggaagatggaaaaaaaaggtaaaatggggttatttgtcccaagttgacttgacagtctaagcagggggataaggcagatgaatatgtgaacaatgttttggtagattagcttggttagaggattttcaaactttttgaaattataaaacctacaaatatatattttttaaatcacaaaacaaaaccttaatgaatcagtaaaattctcataatctttatacaggaaaggtagtagagaaaagtttatatcagtttgcaactacagatttatgcccttacatatgagtggtagatatgtgaaatatgattattagtaataaagtgaagaggatgttatagagagggatgcaataaaatttatctttttcatcatgttcctcatctgggttaccatgaaactaatgtgaacagtttccagctccaggcaaaacatttacactcctcacctttcagtgctatcatttgttgcatttgggaacaaatgtgcagcttcagggtgagaatggaagaatatataggcaaaagaagagctatgaaatatattaataacgaatattctcacctgaaaactatgaatttcaagatcacacttaaggtccacttcaatttaaaaaatgtcctgaggatctgaataatgacaattggaaaattaaaagagcattgatagcttaagtgccaatgaactcaaggccaagatctcagttttcatgcaaactggtggctctgacttcgttccactgctatagccttggctgaggatcttacaagtgggtttttgaaatggattcgggtggaggctcagggagtgcacctgttacctccatggggcaaaggctcaatgtagggaacttatgagagttggagagcatgatgtgtgctgtgtagacagcacagcatggggacccagcactgccctcatcgacatttctcttagaaaatgtgattacaaggcaggcagatcacaaggtcaagggatcaagaccatcctggccaacatggtgaaaccctgtctctactaaaaatacaaaaattagctgggtgtggtggcatgtgcctgtagtcccagctactcagtaggctgaggcaggagaatctcttgaacccgggaggcggagcttgcagtgagccgagattgtgccattgcactctagcctggtgacagactgagactccatctcaaaaaaaaaaaaaagaaaaaaaagaaaagaaaacgtgattacattgtaggagctggaggattgttactaaatcattcaaaacagcaaaagttaaaaataaaatagcgaccagttaaaaatattccactggtctaacaaggaggatataaataaattatgatgccttatagatataatattaggaatatttttcagccattaaaaactacgttttaggagagtatttaataatggggatattatagataaatacagatagatttaggtataaaatggagactatttctttctttaaagtactttcttgatttttttaagtcagtatatccatctctctttccctagcaaatattctccagagaaacagacaaacatttttcattggccatctctggatataaggtaattttagttttctttctttctttcattttattttttaaaaaagagatggagtctcactatattgctcaggctggcatcaaacttgtgagctcatgcgatctgccctctcagcctaccaatgtgctaggattacaggcacgagccaccacgcctggcctgattttaattttcctatttacatctttctgattaactttttcccttataatcacatattgtctttgcaaccataaaaaaaaagcaacaagcgccagctatttctctagtggcatgttaatcttatgcagtattggaatgggagcaggcagagggcttggtcctagatgctccgtttattagttggctcatggaggataagcctgagcttctgagagtctggggtaaacaagtggccatgccttcctcacaggtccctggaggatcggagaagtgatgtgtgctgtgcaaaggtgaaggtttctagccaaggccactgctggacttgcacttctgcctttctcctgggggtcactttttcactcttcagggcttggctcaaatggtacttccccaggtaaccttccctggcccccacatacgatcaggtttcctctttgaatgcccttgtaacacttcagaactcttatcattgttgcaattttgcattcattcttgaggttattggatgaatgtgtggctcctcctctgaatggtctgtttcgtcacttttgaacatccctccattactggcagatagtagtctctcacaaatgtttggtaaacgaatgaactcttcaatgcaaaggtttagaatcagctggtggggagacagatctagtattttgaggtggttggagggatcatggtgttaaccaagagaaagctcttagcagagtcactgtataatttttttctttgggaaagagtgtgtgcttcaacataccagagagctaaggctttgcactgtaatatgggttaatcaatcaagaaatcaatcaacacctacttatccagtgcagaccatgtgcccagcacaatgctagaggcactaagacttttgggaagtggctttgcctctttctttcagttcacaaaatgaagtggttaagacttgcagaaatcagaagtggaagaatgcaaactgatcagtgattgcaatgactggaaaagggctatgaaacgccagtgcatttgagaccaagcattatggtgatggagtctcacatcctgaaacccagggctaatcctccccaagagagacgtggataggaaaattcccctgataattattgcaaaagtgtcatcttaaaaacaaacaaatatcacaagatgcctccccaaacttgaaagcatgaaacaaaaaagcaaactattcctaatcaggctaattgtagagttagtggctctaaattgtgttggttttgccagttctgccttttggaggtggggacaggggagatttggtttaacttaattagcatttccaactggaaatgtgacaatataactaccctaaactgttgctcagtaaaaatgcagaaggagaattcctcctcagtcacatttatacagaaaccaaggacaggaagagaaagaagacataggctattaggggaaggaatatgtgggctacagatacattcagacgccaaaacttgctgctcattttcaacctctcacctaattttttttctcctcctggaatctatgactataaattcacttctaaggggaaaaaatcagcccatgctcacagcctgctaggagcgcttatacctcccctcctccaaccttccactgcccggtacattattttggaaatttgagcagagttgtctttggaatgacggcgcctcatcaatacagaatttgtgataatctggtccttgggtgggcttgagtttatccacataatggaggtggagtggggagacagaagtatgttaattaagactaaaggcccacaaactcttttcaagtaaagtagccttagctacagctgattcttttctcttagtaaaaacattgataagtttaccaagaccccttgcatgttccctgtctccacatgtgctagaaagtattacgttggtgcaaaagtaattgtaccaataatgcatctgcatttattaagtgtcctttaatgcccacttcactgtagcagtccagttagggactattagcaagggtttatagtattattatgaaagaatctggatactagcagtgagaggaagactttccgcttaaggaaatattgttcccgtaggggcacaaatatatgaacaagcgtctgcaaaaactccaggctagggtcagagcatcttaagtgaattccaggaaagtggtttatagtctagatgaaagagagaaatgcatttagcgggggttcttgaccaaactcaaggctccctctttggatcagagtatggggcctaccttggcgggtgcaggggttcctaggcaggtgggaggtctctatttgtgttgaggttgcagctctcttctccttctacattttatctcctacgtttttgctaccatctggttgttttcttaccacattgttcttgcctctggcctgcagtgggcacccttaagaaaagtccatttagatgtcttctttccttgctagtcttcatgtttgtcagttctgaatttgcatccaatgcctgtcctcagtccctgggccttccccttgatgtcttcaatgtgaaagctattcagccatggggactgtgctcctcccttcaccctcctgtcctccaaggaaaatcaggaagtatctggacagactgttggaacaaagcaaaatatttaagttcctgtcatcgtcccactgtggcttttgatcatttctttcagtagccagtttagtttaattatttatagaaagacattcatagtgctagaggaaatgtcctataaagcatttatcaaagaatgagtctttgtaatctgagacatccccagagcaaaagcaaagtatctgggctgatgattcaggtattacctttggagggaagcaggatgagatttctagagttgctggagtttgaatctctgggttgactcagtagataagcctaaaatctgtaggaggtacaatgcctgtgcacggtcccagtccttccaacaacaaaatgagggggtcattcccatatcatcattatacatggagaaactgaggcacagagaaataaagtacattgcccaaagtttctaaaatacatagtgaagtggaatctagatttagagagaggcagtctggtgtaattgctgtgttcttaatactctggactcctgttgtggacatgctggtcccttggttgttcagtgtctgaggacagtggcttgtctgattttctcagcttcctcgagatggatctacaaattggactgaactacagcctcagaagtttataaggagtttcatcttgataatttggtgggactggaagatgtctttgaccaatagaccagtatccaatgtactcaagatggatcagcctgcttctgccacttcctcgatctttaacttacccaagctatttaatttttgaaagtctctgttttctcacttgtagtttcacagtggtctctcattctgtgttgtgaggataaaagagaagagggagcatgtggaaggcacttggtacatagttaagtgtttcagaaatgtttctagattttagctgaggtcctgtggcatcttagagtattgtccaggaatcttggtggcagtatttcccaaattttagcatgtacaggaatgatctgtgggggaagtgtcaaatctgcatattcccaagccccacccaagtgattcagattggaccaggtggtgctacagtggatgcagccatccagatggcaccactgagaaagctggctcacaggccagcaggggcccctcccaccccttgactaaaccctctgcattccttcagactcttcttaccctgaatggagagtgctagaaacgttcttagtagctttctaaaggctttataaggccaacgagtaataatttggtgatttcagaagcagccctcagaataatatattttctaccccttcccccacccactcttggctcctggccctacctccttcacccctcttcgatttgtaccacagttcgtggcattttctgaacctcagggctcctgtctggctagttatttatttagctgaggaactgcagcacctaattaataggaaattagctgtgagtgtaacatttggcccgtagtcaaggcccaagaagttataaatacgcaccacgtgagtggcctgggcacctgattcttggaagatccagaagtggcacttcctgtgcagttccaggaagtgaagtatgtgctgcataggttgtgggtagccaggagcaggcatcacctgccctgaggccagcaggaccatcctggggagcacaggggcctgtctgcttctccccatttcccagagagctcattgactcttctcaacttagctgtcttttcaaaggccaggtgggagaggacacatcaaggaaatgagagcagaggctggaggggacttaggagagggtatagggtcccttacagggtggcccaagcaccgtgatcctccaaagacactaggtctgctgttgtttcagacacttgcattggcttcttccaggggcacgtgaggtacagcttcatctaacaccttgacagtagggactctgcattgaaggggatctcactgccattcacaggttgcagaggaaggggaaaaatcttttccttctactcttctaggttcctggctggggcccctataacaaaagatggattaagaagagaatagcacacaaaattatttactatgttttatgtaacaggggagccttcataaggtaaccaagatttgaagaacagttaaccctgggtgttttttatggcagtcttgatgaagagtgaaaaggcatggagaaacttgatagggcaaacagtgtgaggtaagcatagtgaactccaggaaatgtagctgggcctgtctggattcctccctgggtccctagtcttggcagataagtatgctcccttcctctgggcacctctcatgtgacctgcttcaggggaaggtcagaaaattcttcctgggttttctcaaatttttttagattaaaatattcaacatgccaaagtgctgtattttggggtagtgtgttctgaaccccatcacagaccatgggaactgagcctagaggaggttagagatcctgcccaaaccagagagaggcagagttcagatttggaataaacatgttcagccctcaagtttgatgctgtttgcagaatctcatagtttcctgattacttcaaaaggaaaatcaggctgggaggagaaaaatgtttttaaaagccccaaggaggaaaagactgagggggaaggaggagcaaaagggtcaaggggaaggtaagggcaagtctaggagttccttaggaggcagcggtgcccccacggaaggaggaggcggtgtctgtgggtcagaggcaaagctattttctctagatttgcttgatttcagttatctcactttcttttttctcaacttcccctgcagggaaataggaactgggcaacctgtctattcccttgtgcgagttaaaaatctgctgataaaagtacctattccaattctaagtgtgtttgttatgagccaaaccctggagggtgggaggagggaggtgcctggttccatggcagagcagggccaggaggtaaagctggttggaggacatcagggaacagaaagcacagagtaagtgaaatattttgccagctttatttaaaagatcgatcgaagcctctttaacacaggcttctacctgagaactggtataatgaatctggcatttatgtgactctggaaggagccttccgaaggaggagaaaaatgtaaaagaaattgcatctttgggtgggtcccagaaggggttgatatgaagaaagaaaataactcattgctgatgtcacagagcagaagatggacatggaggctgcatatcacttagactaagtgggacagagtctcccttggaaagaaaaaatgcctctagtctcactcagggaagcaagttatcaatcagagcccaggctaagaacacagatatcactgatgccctgaaagaaagataatacatcttccttttcccacctctacccattagccagaggcatttcctgaccttccactgaagaagaaaggggtccctcctgatttcttgtcctttgggggatgttaccaattctttactatcccaggcagtgcttaggcaccaaatgactttggagtcagaaagagctgagttcaaacatcacattcctgcctgtgagtttggacatgtttgattatctcttgatgacctcagttttctgatttgtttaaaaatataagataatatctactttacagggtttttaaaaggactaaatgaggtaaaagtcaaaaccacaaacatagcacctgccatgtagttgagacttaagaataataagtattgctgttattgttatgcaaataaaagaatcaagaataatacttggtagccactcaataatcagtttctgttcccttgttaaaggtcacatcagtaatagtgatgctagacattttgtctccctccacaactctcccctaattcaaccctaagccaaaacttaggccaacatcaaccctattcccaacaatatgcccagctgtattccccaatcctaaccccaacctagactaaactataaccccaactctatctcaatttccaactctatcccaactatattattcagggttcttcggagaaacagaaccaataggatgtgtatgtataatatgcctctctcctattgagagagagtgaaagagggagaggggagagagacagtgagagaggacagaagagagatttttattaaaagaaattggctcacgtgattatggaggctgaaaagtcccaagctctacagggtgagttggcaagctggagacccaggaaagctgatgttgtagttctagtctaaagactggcaggtctgagattgaggaagagccagtgtttcagttcaaaggccattagacaggacagattctgtcttactgcgggaggtcagcctttgtgttctattctgctcttcacccaattgcatgaagcctatgcacagtcaatctgttttattcaacctacaaatttaactgttaatctcacccaaaaaaacgccctaacagaaacaactagaataatgtttgttcaagtatctgggtacctgatagcccaatcaactttgcacctaaaattaatcattttaatcatcacaccaatcttatccttaaccctattcccagtgatattacaaccctaaccctaagtctaaccccaacctcagaccaataattactattattattattattttttgagacagagtcttgctctgtcacccaggctagagtacagtggcataatcttggctcactgcaaccctccacctcttgggttcaagcaattctcgtgcctctgcctcctgagtagctggaattaaaagtgtgtgcaaacatatatatatatattttttgtatatttagtagagatggggttttgctatgttggtcaggctggtcttgaactcctgacctcaagcaatccacccgcctcggcctcccaaagtgctgggattacaggcatgagccaccacgcccagtcagtaattactattaaatatgcaacatgtgctagatattgttagttcctcagctttcttctttttagtgtggatacaaatcctactctagttgccaaaacttattaatcaatgtgatgaatccgcatcataaagtcaacttaataatatatctccagagtatggacttgaaagggagctgtgcttggaatagattttactcagatagtcacacaagatgatcagcacctgctttggcatgaggagccactcaggcacacagagggagttctatttgttgtgccagctcctgctccattctcctgaccaagccctgctttaatagggtctgtgtggagttaagatggccagtgatggaggcctgggcacaacaccccagagatgtcttaactcagagaagatagatttgtagaccattaggagctgaaaatatgtgttagtattattactcatatagatcacttagttttctgtcagatttttgtctcagacttatcccctatgatgaaaaggaaacttcttgatttctacaaagattcctactgaatcaatgagcattagaattgaaagggatgggctgagcatggtgggtcatgcctgtaatcccagcactttgggaggccaaggcaggaagattgcttgaggccagatgtttgagagcagcgtaggcaacatagcaagaccccacctctaaaacaaatgtttaaaaaaattagctgggtatggtgttgcacgtctacagtcccagccactcgggaggctaaggtgggaagaccacatgagcccaggaggtcaaggctgcagtgagcagtgatcacaccactgcactctagcctgggtgacagagcaacaccctgtctcaatttttgaaaaatgaaaaagaataattattttatcccattgttctcaactttaaaatcactgatgcttgagtcttgtcttggagcaatccatccatctgtggggtgaaccctgggaattagtatttttagaggcactcttctagcgttactatggctaaatgtttccaccagtctggctaaaacttctcatttcatggatggaaaaagtgagactcaaagaggctaagtgactttcataaaagcagacttgcagggacaaagccagcacctaaggttttataaatactagtccagtgctcttgttcagacaccacattccttctcatcttgtttcctcagatttatagccaaaaacaatgggaccatcagggacccaccttaggaccctcatagcgagtggtcctccagctcagcccatgtgcatccagctgaaaggctttcatacctctgccctgcataggtcttgttcagagaagtgggtgcactgtggcagaaacaattctctactaacccatttggaacaataaagaaataaatcctaatccaccaaccttgaccagacagctgaaggttgtgctcacttggtactgaccttgtaaagatggattgcaattttggggagtcgattttattttgtttttatgtttatttttccttctgggtacctagagttcatattcatcctagagagttctgggaattgcaggtccaatgctattagcatctgcttcattcctctgcctttctgcccaactcccttgttttctaattcttaaaaaatttttctattttttaagacaatttatactgaatgaattgttattttaaaataggtgagtgaaatccaccttaagtactgatttgatgtatttagaaaatatggaggcctctgaagcagaccagcaaggcagcctgtgtatttcccctaggtgtggttccctctttattaccagagggtacataggagattctgcattcatttagtcattcattcaaataatgtttatggatttaattttctttaggtccagggaacttgataggcactaagggaaactaaggtgaattactgtcatcgcttgacctcaagaagcttaaatctaatgggaagggaagaagagtatcctcgaacacccgtactgtatgcaatgtgatgttccctaagggtatggcaataggagtataggaatgagtgggattatttctagctgaggatcagggaaggttctgttgatgatttgacattttagctcagttttggaaaattgatgtgattttgacagaaataagtataaatcttttgtgtaggcaaaggaacagctggagcaaagaaagacaaaggggagggaaagtatgtgcttgtgtgttggggagtatatctttggtcttcatatgataggtaggagggagcatctgaaaaaaaaattatgtgtagacctcacggatgcttatgggttgaaactggctttagtgactggtctacttcctcagttttacagattataaagtaataataataatagcaatatttgaacttaactctcattgcatgctttctataggcagttactgaactacagccattacatgaattttctcattattttcttacaacattccttggaggtaagtattattattatccccactttgcagatgaggaatctaaggctcataggtcagtaagccagtaaaaggcagagttgggatttgaacccaaggctacactctttccgtggccaggattttaaccggggtattcagtactggtgccattatgggggaggaaaagatgatggattcattttggacatgttgagttagaggggcccatgagacctccaggagaagaggtgagtctgaagcttgaagatggaataatttgaaataaaatgaatttgtttctgaaagttgtatcctaacgttggcatattcagaacaccagtcacattgacttgccctgcagaatttccagatgggaattctagcagctcacatgccaaggctgctccttagtgtgtgtatggcttgccagacccatcttccaaagctgcactcaggttttttttttttttgacatgtctcagctcctttctccaccatgtgtgcctgcagtactgtctccttttatctaaaggtgttttgcaacttgaccccttgctgcctgccaaggtttacctctgagaagtatcaagctgttcagcattggctagaacaagctcttctgaccctgtcgacccaacagtgaaaaagtgtcagtgtagggaagcggaagatgttaagcatgtgcatgaggaaggaaatagtttctttccagcaggtgagaagcccagagagttttggtggcctgggcaagctcctatgcctcaggtgaaaaagagaagttcagtaaagctgccttgcctggttttaagttatattgtcttctaattccttcttccctcaccttcctcttgtcctaataccttcaactccaagtctcttgtcatttcctgacagactggcaggtatacctgacagactggtataattgttggaatcaggaatgtctgaccaatggggaaactgtggcagtaaggagtggagaaaacttagtgaagggcttgcagtccatgactaagaacacagacttcacgtgatcctgtaagaagacccgtcagggaagagatctaagggttggagtctgtattattcttctattgctgctgtcacaaattacctcaaacttagtggcttaaaacaagatacgtttattagctcacggttctgtaggtcagaagcaaaagcaggctttgatgagtccccctccttagggtcttacaaggctgcaatcaaggtgttgcctgggtgggctcttatctgcagattctgggaagaacccctatccaagctcaggcctattgttggccaaattctatgcctcacagttatgggattgaagtccccattttttttcttgttgtcagccaagagctactcttagctcctaagggtctcttggattccttgtcacgttgcctacatctttgagtgtagcaatggttcatcaaatcctacttatgcttcaaatctctgatttctgctacttgctggtgaaaatgctctgccttttaaaggctcatgtgattctattgggcccacctagataatcttccttttgccatgtacgttagcttgctaggactgccgtaacaagctgggtggctactgtgtttgaatgtgtcccccaaagtttatatgttgggtacttagtccccaatgcaacaatgtgagagttgggacctttaagaggtgattaggtcacgtgggctgtaccctatgaatggatttgtgtcattatcaagggagaacattagttatcattgaagtaggttcctgatgaaaggatgagtttagctcccttcccttttcttgcgtgcatgctctcttctatcttccactatgggatgatgcagcaagaaggccctcccaagatgtgggctccttgaccttggacttcttagcttccagaaacggtaagaaataaatctctgctctttataaattacccagtctccagtattctattatagcagtacaaaatggactaaaacagtggctcggacaacaaaattttgttgcctcccagttctgaaggctagaagtctgaagtgaagttactgatgctccttgacttacaacgaggtgatgtcctgacaaacccatggtaagttgaaaatattgtaagttgaaaatacatttaatacaccaaacctaccaaacatcatagcttagcccagcctacgttaaacatgctcagaacccttatgttaccttacaattgggcaaaatcataaggcaaatcctgttttacagtaaaatgttgaatatctcatgtaatttatcgaaatgttgtactgaaagtgaaaaacagaatggttgtatgggtgctcaaagtaaggtgactactgaatgcgtaacactttcacaccatcgtaaagctgaaaaattgtcagtcaaatcttcccaagtcagggaccgtctgtattggcaagattgattccttctgagggttgtgagggagggatctgttccaggcctctctttggcttgtagatagatgactgtcttcatatttgtatggtgttttccttgtccaaatttccttttttatcaggacatctagtcatattggatttaggccaaccctaatgaccccatcataactaattacatctgttaccatgtttccaagtaaggacacagcatcctgagatactggggtttaggacttcagcatatgaatttagggggatgcaattaaactcatagcaccatatatcatacataatcataacagtcacatcttatttgctcatactcaaaagggagggatttggacaaaggtgagggtcattggaggtcattcttagaattctgcttgtcaccctgcctctgagtcaggatacctgctcagagggatgtgaggacagctatgatgaataaaaagaatactgctgaccatggtgagaacagctacagaggagtgggtgaaggccatgatcaatgggttgcaagtgaacaagaagtgaagaaaatgcagagactgctccactcaagaagcagctgtggccaagaggaggccaggtggtgagaagagagggaaacagaggtgaataacagttccactaaaatccaagagacctgagcttgctagttgtctagagacaactgacagagaggggcttgcaggcggctaaagccattcaacaatttctggttgtccacatgccccttctatgggaacttgacttggtaccaggtagaggattttgtagaactccacatgttattaaatggcctttgcaaagagacttgtgtgcaatctggctgaattatagttcctttggagattcatgtttgcttacttgtggctctgtaactctcagccttaatatcacagaaatgcatttctatctggtcttcacttccctgattctttaaaaattttatgtgattgttcttggaaggaaagctttggtggaatccagacatagtattggccactattgattgagggtctgctgtatgacaggccctgtgagaagggtgcatgtatattagtccttatttcctttttaccaggtagattgttaccttcatttcacaaatggggaaactgagtctcagaaagcttcagggctgtggctgaggttatagcattgctaagcagtattgctctgcctcctgggttagtcaccgcactcacattaaagacctttttcttctgaaagttggcaattttcttttgtcttgataaatgttattttcctaggatgtacttagagcaataaatgttctgtgaaaacaaaagtgtagtgttcactttctattcccctcccagtcccaaacttctgggcttcccagttcacctatttgagaaattacttagtgaaacattttcatctcccacccagaataattcattgccaggcaaagaacaatgcagagacattacagccagtgagactttttccaaaggtcacacatcgacgtccagggatttgtgatggacacagtgcccaaggcacaacatcacatttgcttctctttctggatgcgtttcatcatgaaagggtttgcaagcctccatctgctgacttgcagtgggctgttccccaaaatgcatgccttgttctcatttccaaggagaattgcaaatcttagaaggtattttaagggaatatgacaggagcaggaacccagagcaattggaattcagagtggtggagtgaagaatcagcaggcatggctgccagagtttgtaggcttgagaagcaatgaattctgccaggagtgagagtgcttggtgaaaaccctggaaagaaaatcacaggttaactgggttttagaggcagtgtaggaatctgtcaggtgggcagcaggtagaaggtgggagagaagaacatctcaggtataggagagatacacaggtttaaatgtcagtgctgtggtgccaagtggctcaagtataattgagtatattagtaatgatgccaaccgcccccgtaataataaacacatacatttttatgtcacctactgtatgtcagggtacattaattatattctaagcacattaattatattaactcgtatattcctcagtgcaaccacacaaggtgaatactgttattatccttgctttacagatcaggaaactgaggcacaaggaggaaaataatcatgccaaagaactatcaatgagcagattggggattttattccagcagtttactctacagcagctctgtccagtggaaatttcagtgatgatggaaatgttttgaatccttgcttttagcaaggaagccaccacccacatgtgctattgagcacttgaaatgtggctcgtgagacacatgaattttacattttaattttgatttattatatttaaatgtagacaggcacatgcggctagtgaggacagtattggacaacacagttagttagagtctgcttatctataaccccctgctgcctttcaaattggggagtgtcaagttgattctgtcatgatagttctagcattaaaaaccaccacaggaatcatggccatcatttatttagctcttatgtgcagggcaacatgctcagtgcttcctgtgggttatttcatgtaatatccatgacaaccttatgggtgatggctaagagcatgaactctggcaggtttgaactaccagtgttcaaaacccagctctgctatttgttagttctgcagccttcagcaagttgcttatcctttctatgcctcagtttcctcatttggaaaatggagtaaataatagcatccccttcatgtggttgttatgatgatcaagaggctgtcctttggaagacagcacagtgcctgacatgggacaaattcagtatctgaaggtattgttattattacccttatactttagatgaagaaaccaaggcatggaaaggtaaagtatcatgctgaaaggtacagctaactgagggagagttggaattcaacccacaggtagcctgatttcaaagttcaggttcttaacaattatatggtggtttatttttttcttttcttttctttttctttttttttttttatttttgagacagagtctcactctgttgcccaggctggagtgcagtggcatgatctcagctcactgcaacctctgcctcctgggttcaagtgattcccttgtctcagtctcctgagtagctgggattacaggcatgcgccatgatgcccggctaagttttgtagttttagtagagacagggtttcctcatgttggccaggctggtcttgaactcctgacctcaagtgatccacctgccttggcctctcaaagtgctgagattacaggtgtgatgagcccagcccatcctgtggtttccgatcacagtttctaaaattgtggtttgtggagaactggtactaaaatgcttcagagtgcttgttgaaaatatgattgcctagactcactaaaaactgttcaattagacttttggggtcagagacctgggaatctgcattttaataaatttcccaggtgatttttcatgaacaccttaactaataataaatcaattaaaaaatttaacggtaagagaagtagaaggagagaccaggttttcagatgtagaagataccctggagagtagggttattctgcaaacagacttaattttagaaagatctttctggtggctggtgttgaagatggacttgataaagaacgtcctgggggtagatgtggggtgtggtgatggggctcattagtacagtgacagagtggacagggagggagggacagattctttggatgttttatagtaaaattgacaggatatggtagattactagaaactgaggagaaggaaaattaattgagaatcaaaaataatcctcaggtttctatgacacctgagtgggtaatgatattattaaccaagatggacaaggaattttggagattcagataaacttgaggacttctttggacatccaggtggagagaatcattaagcagctggaaatttggttttgagttcaaaagaggaatatatagcaaaaataaagtttggtgtcctgtcaacactaggggtggtatgtgacctgtgcagtgggtgagattgtcttggagaaactaagtggcaaggctcagcaactcaaatattgccaagggtgaggggttgaaacaagtgtgtgtagtggcctggtataagagaacaggtgttaagctgcttttattgcagctaatctaataactgcccaatcacacagcttttgaaaacactctatcagccacttagctgtacgacactgccccaagctcttagcctctacacacctggcacctcggggtctaagcctactgggtctgaccctattgagagcactcgggtgctgcccatgccagaagagaaggtcaccaaagcctagcccctgagggacaataacactcgagggctaagaacaggagctagtgaaagaggcataggaaaagtagatagaaaagaagtaggagaacaaggacacagctgtgttggagaggctgaaagaaagaaggatttcaatgagagggttgtcagcaagccacatgccaccaagagctcaagctgaagcctggggagaagttttggcatagacttgacaagctggacgtgcttggtgtcttttgccaccagtagagtaatgggggatggagccagggagggaatgagagtcgcaagtggaggcaaagaacatagattactttcttcagtggggaaaggaatgtgaaggtcacttgcttgagggggagacatggttggcacggggttgtttgtaggataagtggggcttgatcatgtttgtagggagagggaacacagagccagtggggtagaaggatctgaagatagttaaaaaaaatgacttttggatcaaaaccccagaggagggaagaatagtttgtatcttgaaaaaaaccagggtacctctttctttgggctaggaggaaaaggtagagaaaagcttagatctaggggcaagaatttgtaattggaattcttgcaagtgtaaatctaggttgtctgtttaaaacaagggcattggtgaagaacaaggataaacgtggtaatgtctacagcacattgagcatctgcacctgtgtgccaggcattgtttagcgctctttgggaattgtcttttttattcctgaaaggcaaatgtaattggcatacccattttacagcccacaaagagaagttaattgcctgtggtcacgcagctagtaagtggttgagctgagatcagatcccaggaagtctgagttcagagcttgctgtagctgctatacagtgtaataaagcagcaataatgatgacttgcattctcatagtactttttttcttaaaactttatccctattttacaggtgtggaaaccaaggcagaatttttacaggtgtggaaaccaaggcgaaatttgctcaactcatcacgcatcttggtagggtcagagctaggactggagctggggtctcttactttctagtcctgttctgcttcccaggaagcgaacacccacaagtagctcctgagtaaattatgttgcatttctgacatctcattccctctcttcctccttctattccagtctgcctactcctaccctgatctggaccccaggccccaaatgccaggaaggtggcctggcacctgctccttccttttggctggaatctttgtcctcccacatgagggcattgcccgcattccccaccaccactgccttgccttagtatgaggggcctcatgcaggcaagcagtggagtagaaggccgcatttgttttgcttttattgttaaataatataaatctcttggctgcaccaccggccagtacgtgagttgtgtgtcttcctgcatagttgctaatgagacagttaatcatttgtttattttgtatgaagagaggtggcagccatatctctcaaaccagacattgggctccaggaccctcagggaagctgcccacccctggcacatgagtcacccacagtcccagcacaatcctgccctgcaggccccatcaccttcttccctgaggaatggccaagatgcaggcatcagctgatgatgatgatgattactgttattgcagctattatttttataaatactcccttccttgagatgcaaaaaaaaaaaaatgtaatttgcaaagatgctttgttgggagataagtaggcttcctcttgggcacggagtttatctcactcgtgcataggttcctagaggtcgtgcaactcacgagataaagctccaggatcctccccagggaaggccagagtcagtgttcagctgttttcctagatccagggttaaagaggtgaaatcaactatgttcgtcctgtaggctccctggggccgaggctgcttttattagagcaaatcaggcctgtccagaagctgtgctatgggggaggagagagccaggaggaggtgaggaggggttggggtggggtgtgctgcagggattgctgtctgcacctgggctgcccaaactgaatgattgtcttaaagggctcccatctcatcgatttgcatgctgtcagcatcctcctgctattttcttggtgtttgtacaaatcctattgcccgaagcttaaatttcaattaactgggtccaactgtctgtgtcctgaggcacagggaatgggctggggttgctttgttttctgctgcggcactccatccttggcagtctgtctgtctgtcttgaacctcctgtcctgaaggctgcacctctctgtgaattgcttgcattccacagtcaggggcagaattacccagggcagggcttatgttttaggagtagttgatggctagatcaagaaacaggagcatgcagtggagtggaatcatccccttaccatggttgatttctagctttctgcttccccctgtgacatggtgagatgcttttatttttacttcctcatccagatatattcttgatctcatccttctttctcctccctattttcttcttctaaatatgtctttttaacctctgcatctttgttcttgcaatttccttcatcagaattttcttcccttccttttcctaccaatccttatcaaaatccatccttcacagctcaattcaagcgtcactccctccaggaagccctcccactgtccttcccagaagacttgaccttgctttctgtgcttccgattccttggatctcacagttctcccttcttagagtcagagctagcatctcattctgtacatcccacagtacagtatcacaccattcatattattttttttttttggttttgagtttgttctggttgagttttgttgtggattgaatggtggttcccccaaaagatatgttacatcttaattgctggaacttgtcaatgttaccttattggaaaaaatggtcatagcagatgtaatgaagttaaggatcttgagaagatggagagatcatcctggattagccagacggccctacatttaatgagaagcgtttatgtaagaaatacatagctgggtgcagtggctcacacctgtaatcccagcactttgggaggcccaggcaggtgggtcatctgaggtcaggagttcaagcagcctggccagcatggtgaaaccctgtctctactaaaaatacaaaaaattagccaggcgtggtggcggggacctgtagtcccagctactcgggaggctgaggcaggagaatggtgtgaactcaggaggtggagcttgcagtgagctgagatcttgccactgcactccatcctgcgtgacagagcgagactctgtctcaaaaagaaaaaaaaaaaaaaaaggttaggtgattgtggtggtgcatgactgtagtcccaactttgggaggctgggacaggagaatcgcttaaacctgggaggcagacgtcacggtaagcagagatcatgccaccgtactccagcctgggcaacagagggagaccctgtcaccccccagaaaaaaaggaaaaaaaaaaaaagaaatacacagggaagatttgacagaaagaggaggagacagtgatatgaagatggagacagagatgagaacgatgtggccacaggccaaggaattctggcagccaccagaagctggaagaagccaggaaggattatccccaagagccttcagagggagcatggccctgccaacacctagatttcagactgttggcctccagaactgtaagacaataagtttctgctgttctaagccatccagtctgtggcaatttgttacagtagccctaggaaagaaagggttctccttctctgaaagggaagacagggagaggcaggaagaaaacaaaataccagcatgaggaacctgtacccttccttccagattttattatcagcttgggtccttctgttttatttcatacaatccaagtcctgttactcccacaccaggccttgggttgtctaggcagctgggtgaaaggccacatttgttttgcttttattgttaaacaacataaggacagggccttgtcatgtgagaacatcaatactgaataaataatatatttataataccaataagagcaattgacatttgtatagcctttacaacttacagattactctgacttacctcattgcgttttgtatttatggtaaacctgagaggtggttgttgagatcctcattttacatttgaggaaatggacagaggtgggaaggggcttgtgtatgaccatacagcagatgtggttgggccaacgctaaaccatcttttggttccaaatctatttcctttaactgtgcacataatattctttgattatgagacccagtaggtcaaatctgtttttaaaattcttttcaaaatgggaatatcctttgcctgagctagggatacctggtttccttcttttcctcaaggtgtgctcaaactcagcagggtttggtagtagtggagaggctgagagaaagccctgcttattcaggggtctttgttttacaagttgtctctgtatgttgatcctctgttattgtttgggtaggcactggggaacctctgtgcttgcatgtgggcatgtacacacatgcactgtgcgctctgccagctgttatccccctctggtgctcactggcataaatctgccacctgatcatctaaaatcccagtgaaaggaaaattgccaggccaggagggtccaggggagaatcaatatatctagtatagtttatatttgtaccttctctccttaagagttacagtgagtgactctactcctcaaatggagcacctctctccaggagagtaagaagatcacataaatagaaagtgagctttggactctaacagacataggttcatattcaactctgctacttaatatccatattggtttgagttatttaaccttgacaatccacactgtaaaatgggtaaataataaataccctcctctcagaagtgttacaaagtttatatgaaataatgtgcttaaaaagctgggtacatagtaggagcttagtcattgtttattttctccctcatacccatacatgattcattctactgttaaaattatgcttctattgtaaccacactgtcatcagggaacagttagtagcattaggttggtgcaaaagtaattgtgtttttttgtcattacttttaaaggcaaaaacagcaatgactttttcaccaacctaatagttttgtcacattgtcctctagtaatgatgccctttttgcaaaggggaagccaagggcttgaagagaggaactgaaatattaagatttcacatcaaatcagagttagggcttaaatagaagtaaaggcactcattttcccactttagtgggaagggaaataaaccaacatttattgacctcctaatataagccatgtccttccctcaaatattttattctcacaagaacatgatgacatgaatagtgatattatccccattttacagatgaggaaacaggcttagaggatttcagttgctgtaggttacttagcagagaggctgccctccttcccagggttcctggccccagggtgcccagctcctgtgtttttctgctccatcatgcggctttcctcggagtcctggggaaaatacagctcaaggagggtccatgtgtaaggatgaatcaagaggagcatctcattatcacccctagttgtcaaagaacagaatctacagccccttgttgcttgtttcctcccagtcattcagctctcaggagtggagttaagatggaacctgactggtaatgtaatgcaggacccaaggtgtttcccataggtcatgttgtttatggatctgatgtccattatcatttgaaggagtgtttggccaggcgcagtggctcatgcctgtaatcccagcactttgggaggctgaggcgggtggatgatctgaggtcaggagtttgagaccagcttggccaacatagtgaaactgcgtctctactaaaaatacaaaatgagccgggcctcatggtggatacctgtaatcccagctactcgggaggctgaggcagaagaaccacgtgaacccgggaggcagaggttgcagtgagccgagatcgcaccactgcactccagcctgggcaataagggcaaaactctgtctcaaaaaaaaaaaaaaaaaaaaaaaaaaaaaggagtgtttgagtaagggagtaaggccacccaagatatttaatacaaggcaggttgtaagtttaagtgagtatagttggagtaaaaatagaagaaattatatctgttcttaaattaaactccagggctgtgttttgcgaaccaattaactaaaacttggagtcatcctgttaggctttgctgagcagtggagggacttgtggggaaatgtggttgcaaaggagacaggagggaagctgaggaggctgaggagccacagatgagctagggagatgcttgcagcatagcacgtcttcctgtttggttattggaaaacctgggtcctagttcttgatctactagctctgcagcataggagtcattatctctccggaactcaggttgtaaaataaaaaggtccaaccagatgatatctagggttccattcagatataagcgtgtgctgttttttgaatgttagtgcagccagagggcctgaaaagtgacggggaggcagagagccttatcagatagaacaagcagcatttcagcagggtgcagaaggagctttggtggctgtctctgtatgtgcactgggtggagaaatgagtgtgggcattgtggttgcattaggcccctccccatgttctctgttctacagtgccttgagcacagctttattatcttaaagcatttaccaagttctagtgtctttgggcagcaagtccctcaacagactgtgagctccatgatgggaaagaccaactattgttcactgtgatagttgaaaaaatgaatgcatccaaatgcttttggattccagtttctctagagatgtcttttatgtgtcatttttgtagtttggtctcttctcaatggaataatagatactaaatatcatattaggatgggcaggtgaaagtgagtcagtgcttgcagagatagatgaacattggaagctgttcttgaggttctgttcagaaagcctgctcgctcttagtccctttcctgcttgtgggagagtgggggtaaagcttcccggcaaagtgtgagtggcaggcaagcctagctattcattggctcacagcttcggcatagaccccatgcccattgctggcctatggcaaggcacagcaagcttgacagtgcgtgcacctgaccttgcccataaccattaatcagccatcatgtccacagtcttccccacttctataaactactgggacagtcactggaggaactgtcattttttaactcagcgcaagttttgttcgctttagatttttgggctactcccacaatttagcctattccctctcttttttccccaaattttatttttatcttggtaccaggtcaatgagttgagtggggcctggggaaggatgataaaaaagaccaaagatacacatgcaagatgggggcgtgcttatgaaactgtccactggacacccactatgtgcttaacattatgctctaggcttttttttttttccattataacatcatcatttcccggatgctttcctcatggcctctctatgtaaggtatacttcatacttgctattatagttaaagttgatgacataacatttaagtgtctaggccaggacctggcacaaagtaagaacttagtagacattaattgatgttgttgctactgtgttcacatttgatagtttaagggtcttcatgatattctgcaatgtaaaaggagaaaacaaacttggttagttggagatagtccatcatttgtagagcaggataaatattgctgatcattaaatcatctcagactttaacaggtgaagaatgagtagctgccctggttaaagatcgcatttgcctcaacctaagttggggctcagaaggggaggggaaggtgtctgttccagtctctgatttgtttctaagtgatttttattgccatcacttctaggtgtctaagtgatttttattgccatcaacttctagttctcaggatgcatgacatggtccctcattccagaatccagcctctgagctttactcgccatttaaagaatggtgttgggcctgagtgtttctgtccatggtgctaaacacagaactctgggactcaaaagcagatggtactacatggtcactctcatctccatagcctgcgagatgagactgctgtgaaaagaaggctggtttgggagttaggaggtctagtacagtttcaatcacttgctgtgttgcctcaggcaaaccacctaacctgtctgttgcagtgttcccattggtaaaatcgagttgctgcattctgtcattcatatttcagagtgctgctgatttctgtgtgagtaaatgagataacagatgctaaagtgggatatgaatgcatagtatgattatgctgcaattgcctctcattcttttaatcatacattttgactgtatcgttttaatttacggaggcaccctaaggcctaataacatataatgcagcatgcaggaaatcaaacaaacagataaatgcactggaggaagaaagaaataacttttttaatatgttgtttgcaagtggctgtatggctgtagaacctggggtgtgtttctaagaggaaagataatgaccagtgaggggccagcccttgtctggaaggagagaaaaactcataaaatctcatcaccactccaagccccaaaggggagacccactttactgtcacagtcctgaaatctcaacattagcttgatttccttttttagcttggtattccttgtccttcacagaatagttgcaatctccctttttgagttaatcatgcttgctatggcctgagatttgaaaatggagtctgtgggtttaagttcttcttttcctagttatagaaacttcataaagcaagtgaggctcttatagcctacctttcttcatctgtgaaatgggctcagtagtcataatatctccatatgggatgattgaaaagatacagttgtaaaaatgggccttataaaaatgtaccagtagttgtcattgttattccctgacatgctctgttcaaagtattgcatgagcaggttttgccttttccccatcctgtgcctttgtgtgttctattctttttactgggtgtatcttcttcatctcttcttttaaaaatctcactcctttaaagcacaggtcaaatactaccttctttgacctccccaaccataataattttttcctttctagaactcctagatagtctatcatctttactgttcaacttatgatctccttgcacggtggcatctagtttagtcattttttttactttcctaaatagattataagaccctgaaagacggctacttatctagcacagtgtgtagcacagagcaattgcccaatacctgttttaattggaatgcaggatgaatattacacagcactcatggccttaggcttttgtaaaaatacaagcgttgctggaggaggtgactcaataggtcatgggtacttgcatatgcattaagaacattgggtttgggtagccaaatgaaggtggaaaatctggaaagaacaagttgaataaagaagcaggagctgctaaaacacgtttttttcactgtagcagtttttcctaggctagtcctggtcttggaggtgctgtgaaaccagtgtattgacttggaaagatcccttagatctctgaactgggacaagggttgcaattcacggacaccggatgttgtgcaatattcaggtctgccagaaggtggcgcattatcactaatttcatggtctggcagctttgctcctggggatccccaaagttggtgtgggcattctgatgggtagctctcctccgcattttgtgtggttcagagcttctcccctcttatcccctcccctgcctgcattccactcagcttctttatgatgtataaagatgaaactgaccccagtcttcagcctgaagagtgccttccattgggcttccacatttgggaaggttcccgctgagatgggacagaagtgtctcagcagtctctcagttcctgcgtaagttcagaaccaactcaaatcatgctctctgcagtggaatctccccaccctgggcgcggagagagtgagcactcggtgcctttttggataaaccaggtaaagaagaaaacaaattactttttagtacactcctttattcctcattccctccgcagcctcctatgacttctgatttcttgtctgaacttcaggaacagcacctctctctgtgtcttcctcatctcactcctatatggtgtttcattctctttatggtgttatcacatttatttatttatttttgagatggtgtctcactctgtcacctaggtaggaatatcgtggcgcgatcttggctcaccgtaacctccgcctttcaggctcaagtaattctcatgtctcagcctcctgagtacctgggaccacagtcacaagccaccaggcctagctaattttttgtatttttagtagagatggggtttcaccatgttggccaggctggtcttgaactcctggccccaagtgatccacctgccttggcctcccaaagtgctgggattacaggcatgagccaccgcacccagcctgttatcacatttattatcttacattttcacacaatatctctaaaatgtgccacagatatttttctctattttttattagagcgttcacgtttatatcacgcaccatttaatttgaccctcacagcagctatgagaagttttggggcatgagcattaatatctccattgtacagatgaagacacacacaggaagagtaagtgattttctcagaaagtataagatgttcaagaacctgttcatcttgttgctaatgtactttactcttcttctcactatggatgatgcaaataaggctcaaaaggaagatatgacttatccaacgtcctaaagtcaatgatggtataaatggggctggaattaatatctctcgattctcaattcagtgttctttgtatcccactaaggaatccttctccattctctaacagaccattggctatctgtctacccaactcatttcctatgtcttcaaactcttaagcacacgtcaatcagcatttgacagagggtcccaaaggtgaatgcctgaggcatatggaaagctcatcaggaattattattttaaatttaaaatggataaaacaagcactggcaagaaatccatcaatctgctagcaatgactgtgcaaatgactgggtataggtattagaggtgtaccgcaatatctctaatactgttacccagtcatttgtactgttattgttagcagattgagaaaagtgttttcatttttctgtttctatgttttcaaaattttcttcagtgagatttttaacttttataatggaaaataaacattacaaagtggaaaaaaatgttttgtgccacaggtttgggatgtgtttgtgcagctgtgtgcatgggagtggctgttgccacattgtgttaaatgggatggaggctgggtagggcaggaactgtgctccagtcttctccaaggacaggtcattgtgtcattcactggttcccattcctcccctaaagccctggctgatgattttcgcacgctttacttaataacttcctccctacctggagcccggtggaatccacaaagccataagcacacaccagcctggtaggttggggcaggtgggaaggagctctgggaggctggggcatcagaacttcaccctctctggtcagagctgtgggctcctgagcttctccctctgcctgctgtggacttatgtaacacattcacaggacttcattttccagtagattgaaagcaaagccgctgttgattttctccaaaatgatctatttggaagtgcaattgcctggaattacatggtggcgcgagaggttagaccttgctgtaaataactttcctctcagccacacaggggctcagctggaagcagtgtctgggctttagatgacggtgtttggggtgtgtgtgtgtgtgtgtgagtgtgaatacatgtgtgcatggtcttggggcctttgctcaccttgctaccacttcttctacctttggagctttgcatcagaataaggaatgagggcagagatggggaaggatggggttgtgcttgtggtttcttttatcagctggtttatagggcctgtctctggccacctcttccccttattgctgcagggtccttgagtcatgtgaggttgagtaactcaagcacagagtgtggagtggcacaaagaacaagcttaagaattggacgtttctgagttatagcaccacatgtgcccaattacaacatacgggaccttagacaattgcttacatctatgacctcctgtgtctttatacattaaagcaaacaaacctaaaccaaacaactggtataaggtgtgggagttgagagtacctacatttcagtattgttgcaagagttaaaggaagtaatgctggagaaatcacactgcacagtgtctgacacttggtatgtgttctgtaaatttagttccattctgtgccctgccttgcctttcatgacagattgaaattaaaagcaaaagcaatgggcttggaaccaggatggcctaatccaaagttgtgaaacatgcaaagtctggggtgtttcacttctttctatactcccttcccgtatagatagccatagcatacatacatgattcccccaaagaaagactgtaataaacgaactctcactgcagcagatgggacttaatgctgtctgctcctggtgggcatttgtattttaagagtcctgcgtaggcacgtagaggacaatgtttaacccaaagatggcagcattttatgcaggatggcatttagatggcagagctatttttagattagaaagtcttacatttactctggccattcttcagaccagccttatttgcaggcgttagaatgggattatgtgctagatcaagtggacatttttctcaaaactcacctagtgttgtccttttcacatttccccatgaaatttagaaaataatagaatcttatcaaatatggactacatcctcaggagaagacttccagacagttctggagaaggcatctagccgcccacctacctaacattttttggaatcctacactgtaatataataaatatagctgacatttatgaaatattttgctaaatttttatgtgcataatctgagttaattcttactacttccggtggtactgatattatgatgccattattatagcatattggccaagagcaaagatgctggagccaggttacttggctcaagtctcagctcaccagtcactagtagtgtgccctaaggcaagctgattctctgtggcttgatcttcttatatttaaaggaggaatataatagtactacttcataaggctgtttggggcattaagtgattcaatgtacataaagtgcttagaagaatgtctggctattattatcaccattaaacatctgagaaaattgtggatgaggggaagggaagtgattttcccagtgacacccagatggtgacagatccaggtcaagatttcatgccttaggactcccagcctagtgcttttttcttggtatgaggaatatgtggaggatctttaatttttcccacattattatctctcaaggcagctgtcagtcataagtaacagcatttcagaatggctgaaaatctagatgagaacaattgaaaaggtgagagcttgtttaattaaactagttcctgaaagcatgtaaaaagaagttttttcataaagtggtgccaatttgggtgcccaccccagcttggcagttgcagcttaagcactagttagtgggcttattaatcaatggcatcagagccaacatccaggctacagctagccttctagagaggtggtgctgccaggtgcaatcccaagatgagagtcaacttgtatgataagcataggtcaagctctgagttttcattagaaaaaaaataagtggctacttcataaaatatgttaattaaccattgatggagttgggatagaatgcgaaagttacattttctttagaaagtataaaaaccctttagagtttttatttcctaaagtgacccagaacaagccttcaatagaccaagtccaataatgcctcatgtgtttcagagggagagggtgggccagatgaggagggtggtcaccaggagttctcctttgtcctcctcccatttctcttgacctctcttgtcataatggctacagttccactgttagggatgtattattttgggcattgatagtgtttaaagagaaatttaatttccaacatctccaagagacaacaaaattatatagcatcttatatggaactctcttcctccctgttcagatgcagcagccaactaggaccatgcggccaactaagaactggaaaataaggcaaggtgccttgggaggagaaagggtggatgatatatgccgattgaccattttgctaaagcccaggtctactttatgccattttgctctgcaaagtgctgctggaagaagttctgtttggaattaagttagaacagggagctctgatccaacataagagagcatcccactcaaccaagataattaagagtttgtcctttcttcattcctttttccagcataagaaagagcatcctacttgttttggattgaattttatcctctcaaaagatgttgaaattctaactcccagaacttgtaaatgtgaccttatttgggtctttgtagatgatcgagttaacgtgaggtcattagggtgggccctaatccaatgagtatgttctcataaaaaggggacatttggacacagaaacagacacatatacacagggagaatgccatgtgaacatgaaggcagagatccaagtgatacatctacaagccaaagattgccagcaaatgaccagaaactaaaaaagaggcatgaaacagactctcccttagagtcctcggaaataaccagctctgaaaacacttgatcacagtcttttagtctccagaactgcgagacaatgaatttctgttgtttatatcacctgctttgtcgtactttgttgccctaaaaaactaatacaccactgaaccaagataattaagagcttatgtcctctcctttccttctttcagtaaatattagatgagagtctactgtgtgccaggcacaataccagatcctgagaacaatatcttagataagatctttgcttttaaggagttcatagactatcagggatacggataagtaagcaggccattactggctgtatgataggtatttcatgtcttttttcccctctagaccactagctctcaaccttcaccatactctagcttctcctgataacttaaaaaaaaaaacctatgtccaagccccattcccaggcattttgatttaggtaccctgtggtgggaacaaggctttggtattttatgaatcttcctaagaaatcccaaaaggctgttattgatgaaaaccactgttttcaaatatacccatcatcagggccccagtccacactaataaagttggaatggtaatgatattttttagaaagcttcccaggtgattctaatgtgtagccaggtttgagaactgctgtctctcctgagaggtagggatttggtctgtctcatttaatgctgtggcctctctacagtgtctgtcacagaatagacagtcaataaataattgttgagtcaggatctatgatgagaaaaacataaggtgctatggtgcatagaagatgagtgctcagggcagtcattagagaactgagacctgaaagatgagttgacttatccaggcaaggagggaagagaagagtgtgtctggcagagggaacaggatatgtatagagccaaggagctggctgtaacttggcatagctggagcaaaatctatgggtggtgaggggtaagactggaaagcggagcaaggactgggtcatgaagagccttgcaagccacgaggagtttggattctgccataggcttgtttgtgttgtccaggggcatagccatgaactctcaaggctgatttttgtttccttggccttgatgctcacccaggtcgagagtagtatcttgcactttttctctttgaagacaaaagcccaaggagggtgtggcattttgatgcccagggctgtaggcccatctcataagaggagcattgccgtctttctggagagaccatcaagtgtcgcaactgcactgcaccccctacatgggaccttccatcaccaggacttgggagttagattccccagccctccttctatacttccacatcttgggtggaccctgggggagcttccacatccctctttacacatccttcccattcctttcagtccagttttacctggacacacatgctaaggatggagagggaggagaagactcagtgtgatattccccagatggtccccttagggagagctcctgggcagggcaggttgatctgtgcaggaggaacctaaccctccatcccaggggcttgcgcatatatccgctgggtgcttgcttgtctgagccgtgctgttggcagcagtgcccgatttagtactctgcagacttcattaacagcctgcctgttccactccgagttcttaatgaagatgttaaataaaatgtgatgttagtattgccatttgtacagcacttcatatttaccaagcacctttagaacgtttttattcttttccaagtgatagccccaagaagtcgattagtactgctgccccattctacagagaggcaggcccttgggagttcattgatctgttgaaagccaggtagccagccaccaccccaccttctatcaccagtgggcattactcaccctcttttgcccagaactcaatttgttgagctgctgtagctcctcagggcccaaggacatctcacattcctccctccaaattccagactttgctctctaaatattattcctcttcatcattcttacaatgttgtgttttcagtttgggaaagccttagtcttctcttggtcaatttgaatgaatttgcaagtgaaatatcctgatggacatcaaatgtctccctgaccatctaaacacacagcacgcctcagggcccctgttgtccatcctgcctctttccaaagcctgtcaatggcactgtgtttgtgtctggcacgatctgtcttctgtaaacagtcgcaggacaaacagcactgttgtcttcctaaatatgacagtcgacacccccctacgacagtttttacttgtgaaaccataaatcagaggctccaagtggcagcatctctaaagaactgaaagaggaagtaaaccttgtaaagaaaagtacaaaaagcggctcaggtttgcttctctgagccttgttggagcagttgaataaggcttattaataggtttacttagctctctgtgccttagttttctcatatgttaaatggagctattaatggaaacacaggtatgtaaagggttttctgctttaatgacataagcattttgggagggacttcttgcaacactatttttgacttcacacttttaaaaacctatcactaactttctttttctagcgtactatgctgtcttcatgttgccttctttgcgtgtacttcatttctttttctttcttcatccggctttctcttaccttcttatcatctgtcattgcattcatttattccttcttccactgtcctaaatctcatcaccttcttattctgttccttatcctagcccatgggagggtcccctctgctattactgactggcttatcccacaggattctgccttttctccccctacaggctctgcaggatttctttccctttctctctctctttctctctttctttctttctttctttctttctttctttctttctttctttctttctttctttttctctttctttctttctttctttccttctttcgttcgttcattcctccttccttccttccttcctctctccctcccttcctcccttcccttcccttccttgcttccttccttcttccttctcctccttctcctcttcttctttctcttcctcctcctcatctcccttccctcccccatcccctctcccccgccacctcctctttctcctcccactctgtggtccaggctggagtgcggtggttcaatctcacctcactgcaacctctgtctcctgggttcaagtgatcctcccacattggcctcccaagtagctggaattacaagtgcacaccaccacactcagctaattgttgtatttttagtagagactgggttttgccatgttggccaggctggtctcgaactcctggtgatttgcccaccttggccacccaaagtgctgggattataggcatgagccaccacgcccagccaggattacttcttgatggaggatttgtgatgtggtgtgggagtacagagcgaggatgatggtggaaagatgcaaggccccctcacttcgttattaggtgatagaggagagggtgacagtgagatagtaaatagctgaggggattctgagttctttgactcagggagctaccttctggtccaggatcaggtagtactgagggttacaaaacaggtcaaaatggcctggcaacacattgtagttcttcaatggaaagaacattgcactgagaattaggattgttaagtcagaaactgtgaagggtctgagactgcagcctacttgcaagctaacaagttaatctgccacaggtagatattatatatatgtatatggtgtatacagatatatatgtgtgtatagatatatctgtatatgtgcatacacacgtacccacactgctgtcagggtacataatgagagaagatacaaactctagatcaaacacaaagatcattgattacttatggcaaatacagcaatcaaggtgatctcttgcattagttctctgaatcctgatgcccatgggtgatgtggtaagggccagatggtagttgcacatatagtggagcctgttaagcaggagacaccccccgctccagtttagaaaattctctgaccttatctagggctgctggtgacctgctcatactcttccctgcagagagagaagaccttaactttactctagaatatgagcaaatcttcagagaaaggagggagacctaactatcctggaatgtctctggggaaggagacagtctctatctttgttatactggtcaggaaacaaatctgccttctgacctagagagagacactctatttcatttccaagaatttttactatgcaaccaacccagaaaaaattgtcagtagagccctttgctcagaggactcaaactgtgcagaaatgtgagatattcacagagaattgtcttccaacagggactcttaggtgtgaagtgaggggcttagacaacattagagacttgaaaaatgtggaatgtgtgtaccaccactctccaaatctatgcccaaggcagccatcactaattaattggggttttttggtgcaaaaccctaggcagtctgtactatactgattattacctgagtcccctctagctgtgtgaaatcatattcttcacgtttcctcctgtgttccatcttttctacttttgtgaatctgtgtatctatttatatctttatctgtctctaagttggggaaaaggagaacatctcttctgaggcaattttgtggtttaagattttcgtacaaagcaagttcttaatcctaccaaataacattctcaatttagtctttaatccatgagaactgtagctattaacttagagaggcttcccttgcaaacagggattaatagaagaataggtgcctgttgttatatctccttctcaccattggctatgaaagtattctccaaattcctctagagtgatacattggagccatctaactaaggagaagactttaaaagaaatatggcgcaggtgaacatttgcttggagaggggaatcctacatcagaatagatacagtctgagactccttccaactctgagattcgaccaatgatgccacctgggcacttggaagatgtccctttacctttgagtcaatttggactctactcccagcccaagtaatcttttccttcttgtgttctatacttcaaattctgcgtttattcagtgggtagatgtggacttacatagctaacatactggggtttctactgaagacctggttatattttattgccagccactgaaatgaaaggaatcaagagaataatgggaaaagtatatgaactgtgagtagggcatcaaaagatagaggatgctgattagctaagtgaccttggatgcattacctagcctcctcgtgcctcaggtacctttcttgaaaatgaagaagttaaggcctgcctggctgtctatctcatggagatattggcagagcaaatgaggtcatgttcagtgtatgaggtgcccagaaaagagatgttggttgaatgcaaagctggcttttgctgctctgaatctcatcagcctctcgtcctgctccaacccatggaaggtcttccctctgctgtttctgactgggtcatcccacaggattctgccctttctccccagcccctgtaggactatgtcttataagggcctgatgggggacttgtggtgcagtgtgggacatacaaagtgatggtggaaaaacccagtgtcccctcaattttttattgggtgatggagtgggatgatggtgagattgtgaatagctgagaagatcttgtttttttgactcaggaagtgtaagcatacaaaaaaacaaactcactttctcgtactatatattcacaacacagtacttctgtgacccctggccgtcaaaatgtgtgaggatttcttcccaccaagcaattctccaatagacaccagctgggtggcctctaattaaatcagattctgacactgtctacctggagatagtgtccagtcctacaggttaagggctcagtcccacaagacggtcctccacttcagatgtcagttacaagtagtaggttgccaactgtgcttctgaccaactggctataaatcggggattcccacaatcccctccccagatttgattgatttgctagagaaactcacagaacttaggggaacgctttatttacatctacccatttattataaaggatattacaaagaatacttatcaacagccagatgaaagagatgcagagtgggaggtaggtggggaggggtttggcgcttccatgccctctccagcacaccaccctccaggaacctcgacatgtccagctgtctggaagatctctgaaccctgtcttttggggtttttgtggaggcttcattacataggcataattgattacatcattgccattggggatcaactcaatctttagcccctctctgtttcctgcaggttgggggctggatagagctgaaagttccaaacctctaatcatgccttagtttttctggcccccatctaggagctatggtggagtccccagccactagtcatttcattggcatataaaagacactatggcgattccaaggattttaggagctgtatgccagaaatggcattttgggagggggtataggaaaatgttggggtggagagtgaggagttggcaaagaccaacaaagaccaaatatgtttttcacactgtcacagggggctactttctcgtcaggagcaggtggcactaagagatacagaacagataaaaatgaggctggctatgtacacagatgaagtataatgaaaaaggttcatggattaggtctgagattctatccctgttgggtcaataattagttggtatgtgactaatgtattgggaagatgcccggtggtctatgatattgggattttttttttctttttgattctttgggcctctgaagataattcagcagtttaccagaggagtacccattctgcctgctccttccctctctaacttcctttctccctccctccacaaatatttatttgtaccttgtttgtaactgaagataagcacctctgaaatcaggcctgttggcatatgtctaaatactctttaactgagagacatatattcaaagaaacgtttttatatgtccataaactgacacatagattgtcaaatccctaataacaaggttcaaattagaatcctgacactaatgttttcaaatgttctaatacaggtcaccgtttttcctggtacaactcttgtgagtcttatgtgtgtgcatgtgttcgcatgcaactgtgtgagatgctttgttaattaacattgtgaagctaagtgctcagtgaaaaaagtactagagaattgcatattgtccttacagaattgtttgtaaatacaatcaagtaaaagctgtattgaaagaggtaggccttgttcagagccatgttactaatctcaagtctaggggtttgctctgagtgtcttggtgtcttggtggccacatggatgttcctttactctgcttattttcaacacaagaaaggttcttgcaaagatgccttggatgaaaaattctgctgccatggctggtatgcaactcattttgcatggatgttctctcggttctaacctagtttgtgttcaggtaattctggtaatgggacatttgcctctcccctgggggaccatttttagtgtctgtccatccaaccagttagtcagagaaaagagccctgatgtaagtagagaaagaggtatttgtagaactgtgggaaaaagaaaaacataacacactgacctgttttaagagtgcagggtgggttcaaggcttttttaaatttggtttcccaagatgttggggtcactataagcttcgagaatggctgaggtccaaatcctaaaaattactttcatctcagaaaatttgattagcaatcagaataattgaagtgtacctttccagacactatttcctaaataaaatgtatgcataagtgaagtcagacctgatttaagatgaatctttcttccattgagcaggcagtgctttggggataaagggaactggttcccaactccagctttgcattgaactgctgtgtgatctttaaatttcctcctaacaaaatgaggagagtaatactttccccatgggcttgaatgagagataaatgaggtgaagccccaagcacaatgcctgttgcagtgtgttcagcacatggtcatttgctttccttttctaggaaggaagcccggcttcctggtcttctgctgagcttaccctgggttcccagaggctcctttggatgccttgatccatggatatcttctaagatggtcatgataatgtcagtcttcaaagtagctgctttccctcctctgtactgcagagaccaggcacatacagaggccgaagggtggctctgtctcctagggtggctgtcaccaggtgccacatcattctgtgtttatgggtttgctctgataagcagatgaggggggtgctcatccattttttaaattcaagacattcaagttcaacgtatgagacaccaggagtaattgtactatgaactgacataaactgcaatgaggaaagaccttctctcttcccctgtcttagattgcacgccaggatgtgataattaaagcatctgtctctctccagctccccttatcagacatcttaatttatttacttgttaaaaactaagaggagaattcatgctttgttggttttcctctttattctactttcattgttacatattaagtgatctcttggcaaaacgaatacataacatagctataattaaatataattctatttggtatggtgtttccctttcaaccattggcagttcttctaatgacaatgaccttgtaatttaaaacatatcctaggggcatctgtttttattctggactactctgacacattggttgaggaatgacaataacaatggcaggaattgggtacaagtgcagttttgttacatgtgtatattacatagtagtgaggtctgggcttttagtgtatccatcacctgaacagtgtacactgtgcccagtaggtaatttttatccctcatcccctcccattctcccaccttttggagtctctaatgtctttattctactcggtacacccacgtgtactcattgttaagctcccacttgtaagtgagacatgctgtatttgactttctgtttctgaaatagttcacttaggataaatggtctccagtgccatctatattgctgtaaaagacatgatttcatttttttatgtctgagtaatatttcatagtgtgtgtatacatatatgtatacatggtgtgtgtgtgtatatatgtatgtatatctcaaattttcctgatccagtcaccagttgatggacacttaggttgattctatgactttaactttgctattgtgaatagtggctgcaataaacatatgagtgccagtgtctttttaatataatgatttcttctcctttgggtagatacccagtagtgggactgttgaatcgaatggtaattctatctttagttctttgagaaatctccatactattttccgtagaggttgtattaatttacattcctacagtgtataagcattccctttcctccataccttgttgttttttttgactttttaataataaaatatgtttttctttctttcttccatgatggtgcacacataatagattatcaatttactcttacatattaattatattaaagatacagatgcatactagatgcaacacagaagaaagatgccttgtttctggccatagatatgacagagagatcaataaaggccacagaattctcttcctgtttattcctgtggttgttgttgggattttttttagatatagcaagtactcagcaaatttttgctgaatacatttacttagaacaaagggacactggcctcctccagccagccacatattattttatatatattattatgcaaaacacagttgttcagtattgcccctttgcaagatgctccttgacctttatctaagggaattaactgctattattattactcattcttttttatgctgcctatttatatattttttaaacttgaaaaggcgagttttatttttatttatttaattaattaattttttttttttttgaggcagagtctggctctgttccccaggctggagtgcaatggtatgatctcagctcgctgcagcctctgcctcctgggttcaagcgattctccagcttcagcctcccgagtagctgggcctacaggcacccgccaccatgtccagctaattttttttgtatttttagtagagactgggtttcaccgtgttggccagactggtctcaaactcttgacctcaggtgatccgcctgtctcggccttccaaagtgctgggattataggcgttagccactgcgcctagctgaaaaggagagtttttgatgaagcacaaatgtgactagacagtaagggaggaggctgttgggatgactgagaaaagaaataaagagtgtcttagaatcatataggtgagagaattcagaagtcattactgtatacccattgaagggattagattctctgaaggcttaaactagacagtctgacttaatctctctcttaaaggaaaagagttgtatttttgttcttcatgcttttaaaattatacaagaaaaaataaaagcaaaatttataaaagcaatttgtatacattgtaaaaatattcaaatatttacaaaacagcatgaagagtaaaattatctcctctgagttccattctctaaggataaaactgtaaaatgcttcaattcttggctcttctgtttactaccaggattctaacatactttcttgttttataaaatttagacagtagattctgactttttgctatgagagtttagggccatatacgtaaatgctatcttccactcatcattcctcctccgaattctcagtcgtattcttacttatccattatcaaggtatattaacattcacattctgttccctaaatgtaattagattttcacatgctttatagttgattctaaagagtttgtttggatagaatgcctactattcattttttcattcatttgtttatttcattcaacccacactgagagactattttgtgccaggtatgagcctatgtgcaaagtatgtgcaagtgttcacagaattgtgtgtaagacaattgaatgagttttgggcaggagaagatactagatgcatatctcaattctatttctaaagatgtattaaaagaaaatttagatgaaaagggttacggagaaggacactatcatacttttagagaaaaagcaccctggaaattgtttagatacctaaatattgtcaagtattaaataaattatggaaaccagatggattggaatcagagccattaaaaattaaaattttgagaactattaaatgatgtgataaaatgtcataatctagcaatttaataaaataagaaactggatatgaaactagatctataatattatcccagttctgtaaaattttaaaaagatgatatgggaaagaaatatcacaagtgatgacagagatttaaggttttttgtttgtttgtttgtttgttttttgtttttgttttgagacagaatcttgctctgtcgccaggctggagtgcagtggcgcgatctcggctcgctgcaacctctgcctcccaggttcaaacagttctcctgcctcactctcccgagtagctgggacaggcatgcaccaccatgcccggctaatttttgtatttttagtagagatggggtttcaccgtgttggccaagatggtctcaatctcttgacctcgtgatctgcccgcctcggcttcccaaagtgctgggattacaggcgtgagccaccgcgcccggcctaaggtatttttttaaatttttatttatttattttttgagatggagtcttgctctgtgacccagactggagtgcagtgacgcgatctcggctcactgcaaactccacctcttgggttcatgccgttctcctgcctcagcctcccgagtagctgggactacagatgtccaccaccacgcccggctaattttttttgtatttttagtagagacggggtttctccgtgttagccaggttggtctagatctcctgacctcgtgatctgcccacctcagcctcccaaagtgctgggaaggtttcttcctttatactcactttcaatgaggaagtgttatcctaactacaaaacaaacagacaaacaacaacaacaacaaacctattgtcttcaaaaaaataaaaagtaacaatagaatcattgccttcaaggacaagattctcaatctggtgaaagagacattttaagaagttctcataatgtaaaatggaataaaatcagtgtctgagtgtctgtacaaagggataaggatggagttttgataggggtctgggcatcagaaaggacataacaggttgcatcatgaagactgagtagtatttctatggacagaggagaacattcctaggcgtgaagggatggaaatgaatgttgagaagtgagctatctgaaattgctggactagagtgtgggctaaaagatgtagaaaagaaagtggtttaatggcttgtggagaaccttggatgctttgctgaagaattagaatttaattgaaaggccatagggagctatggagaaatttttaaagagaggggtggacttgacctgtattttcagatgcaaagtaaagagagcaacctttggcaccagacagacctggagtcaaaatcccagctctgccagttccttaggataggttcttagacaaatgagttaactcttctctatttccttatccattaattgggggcagtgatttcaactttacggtgtgaacatgaggatagaacaacttaatacagagtttcaatatcatgaatgatgaataggtcttttttaaaggtaagaaataatacctggtgatgaaataatctgtacaacaatcccccatgacacaagtttacctgtgtaacaaacctgcacatgtacccctgcacttaaaagttaaaaaaaagaaaatatttggatccacctatgacctataagctctctctttgagttgttctgcctttccagactgaagtaatgtatgtctcacatgtattgattgatgtcttctgtctccctaaaatgtataaaaccatgttgtaccctgaacacctgggtcacatgttctcaggacctctcacgactgtgcctcatgccatggtcactcacatttggctcagaataaatatctttaattaaaaaagaaatatttgcaggatctcaccccctagtctgtgttaaattgtttctattataatgttaaatatttacaactatatttgttataaatttctcaagtttcgtgctctgctacaggtataaaaccaaaacgagtttaaacattataaacaacacaagcacaataaaattaaatgaagcagtattaatttaatagacccatttgtaatcaatatgaaaataaatctttgtggacgatgtgaatatagtactaactgctacagcccaggttattaaagtttggcctttcccatactctgtgtgttatgttgactcagtctttccccacttttctctactccaacttattgtttatgcagtgaacagtggtattatttaaactttgcttagcatgaacacatcttctatgtatcaggtccacctctcttcctcactggcccatcactattaacatctcaccactgtagacatgcatgcaagtgcaagcattgaaactgcatagcaggactcaattatgtagtggttatctagatgattttaaaaatgttatcagtatgaaaatttagatcacacagacatacccacacagacacacatacacacacaccacacaccacagccctcttatggttctacacctcctatttgtaaatacatatatcctagaagtcttattattattgttttgttgttgttgttgttgttttgagatggaggctcgttctgtcgcacaggctggagcgcagtggcacgatcttggctcactgcaacctccgcctcccaggttcaagcaattctcctgcctcagcctcctgagtagctgcgattacaggggcccgccaccatgcctggctaatttttgtatttttagtagaggtgggatttcaccaagttgggtcttattattattgttaatggcagctttattattgttagtgatcttggttaggtagatgtatcagttggctattgctgtgtcataaagcaccccaaaattccgtagtttaaatcaaccagccatttattatttctcatgagtattaggttggctgtacacacctgctgatatggtttgggggcataatggggctgtctctcatctttggtcagttgcacgtgggcttgttggctttgctgatgtggctgagcttcctcacatctttgaagccttgtctgagatggtttggctttgctccatgtgttttcttcacctccagcaagttagcagaggcttgtttttagggtagtctggacacattcttatgctgatcacagagaagcagggaaagaaatggataagtgcaaggtctctttaggcctcatgttagagctggcagactaccacttctgtggcattctattgattgaaacaagtcacaaggccaatccagattcatcagctggagacatagactctatagtctatttctagatgagagaagctacaaactcaaaattcaaagaatatggttatacgtatgtgtgaagaattggaggcacttttgcaatcaatccagtagagcagttaagaacattgaaatctattaggaagtgacatagatcttcttggtgagagggatcctgccttaggaaagaatgaatgtgtgaggtgctctgccagtctttggtgtgggagtgagggagagggaagagtcaaagatggctttgaggaacctgggcttgggtgactgagaagatggtaaagctactgagatgagatggtcagcaggaaaagtaggtttatattagggggcctggggcatgggagaggtcaaagatggagggagaaaataagtttagagtttagcaaagtgggactcttcccacaaggagaaaccttctccacctagttacacaataaaatcgcctaaagagcttttaaaattgataattgagtctcatccaaggccaattaagcttaaatttctgggtagaaggcctggtattttttttaatattcacaggaaatctaatgtatggcaaaataggaatcattatctaaatcagtgttcttcttgtgcccatacgttagaatcacctggaagccttatgaaaaatactgatgcctgggcctcactaccaaagaatctatttagtgagtctgggatagggccttggcatctgtattaaaataaagtctgtctggatatatgtgatgtaatgtaatgcagccagagttgagaaccactgacctagatagttaattttcactgtgaataatcaatgttttcagggttgcaagccatggcaaaggggcactatgacaaagtctctttaagttcttggcaggtccagaattagcatgaaattgctgggtgccaactggggcatggggacaggagcagtcagaaggtgaattctatacacttcgaagacccaacctggatcaacacctggtgtttgaagcacaagggcttgttagtgctaatcctgcatcaagtagagatggtgggaaatcgccctgaaaagctctatagtgtataaaatgtcatgatgctattgaaacccctgttgtcccattcaaaccgagctttctttacagtagcacctgaaaaatacaacttccaccatttcctttgagaaggtaaattcagtctgagatctcagtatttgttttccttgattggaaagctaaaactgcctcttccttgattttgtcccgttagtctgagctttgaccttgttacatgttagataattccttgatatgcttgttgttaatgccttataaatatttgcagaccaattatctgtctataggcagccactgagtcaacaacagaatatctgggtttttttccatgttcataaatcattcttggcagaccttaatcatttgggtttttggctggcctctctgactttcttctagtttatttttatcctccataagcctcatctattttggagaaatatttaattgcataagagagaagttgactcctgttaggtatgacactgacaatcttccctgggttcagggtttcttcagagtggcatgagaatccctttggggatgggagaaggcttgtgaaaaggacatatttatgagtcccaccccagttctctgaggatgggactcaggcatctggaattttcacttctttaaagggtaggtgattcttatataaacagttttagagctattaccaaagttattgcttcaaatattatacttagaggagaagttggggcaatttcttttctcggtgggagaggctttgctccataatcctcgtcagtaatcaagagatacacctttccttaaagagtttccaaaaatgttctgcatgaggaatcaccatttcatgtcagtcttgtatatcagtggggctggttggttaatacatatggattgtattgtgttcatctgacattaagatataagctgaggcaaagtgaagagaggaggaagaatgaatacaatagataaatagtaagatagaaaagagaagagaaatggagatggggaggaaataaagaagagatatttgtgtaaatatggtttcatctatgacaatgtttagtatcacgcttttttacattttgaagcactttacagtataaaaaatccttttatatgcgatcctcacaactgtcctggggtactggaccaggtaagtgttaacatacccatttcacagatggaaaaattgagacttctgacagcaaccttccgaaggtcagatagctagtgtcaaaaccaaccctggaactcaggacttagttctaaagcaggaattttctgccaatcctaatctatactcagcctgggtaacctagacttgttcttgcttgtgtaatgacaaggccttcattctgaatgagtgctctgatgtgatttgatgtagagtggttctttggggagggacatggcactggcacactgaacagagtggacttggtatcctgaggaggtccttggaaattctcataaaaatcaacaagcttattgaaagagctcatgttacatcttataaacaaaataaaactggtacatgattcgtgagtgtcttcattcttctctttcttccctttcttctcttcaacacactcaacacacacacacacacacacacacacacacacacacacacacccccaagaaattcacctctggctctggaatctggagaaagttcaaagtcatgcagcaatgaccgtcagcatgattaggcctactggaatcaacaagataaattcagggcctgatcaccatcagacattttcttggtctaacctattgtggccaaaggaagggaagtctcactcaggtctgctccctctccttcatttacttactgagcaggctttttttgctttagggcatggttggtactgaccctcctgggactataataaaaactaacctgggtaccagggttgaatgttgatgagtttttttaccctcgttatttctcttgatcattacaacagcctggtgatataggtaatggtaatatccaggcataattacgataccattggtctaggcatacttgtataattctgtagatcagctacccccctagaaagtactaaggtaaatttatgcacagagagggtgaaacaatgcaaagggacactctattgctagttggggcttaggcccctcaaatactgaacaggattttggtgaactgggctgcaccacaaagagaagctgggtggacttgaaccaacctaaaagaaaagtcaaacctacctttctgattttggttaggaagggaaaccaaactctgcatccctgctgagaatccccgaaaaagaaagtggctgtaaaagatggaacctaagcctttccaagccagaattctgtgctttgtaggaaaagacaggcatcagaagagaaagcctcaaagagctttgaagagcaagatagcaagatctaggacacagcttactgtttgaggcctaagttcccctcagtgttggaaactcccactattatggccagatgaagtagttttgcctctttcttggtcactgtctttgggatgtggaggtggtgtgggggctggagggaaaatgtgatatcctggggatatgttttactgtgaggaacttaaggatcggggaagttaagtcacttactcaaccaaggtcatttgtttagtgtgtggggaagctcagatttgaactcttgaatcttggcaacaacatttagtaattttcccattttgctacctatcctctctaccaaacaccattttgttcttatgtggaaaattggttctaccctcctgggcttcctctggcaggagcagtgtcattaaaacattgaagagaacccaaagaatatatttttctccacttaatgcttgctcagggaagacatccacatccatgggagttgtctggctcacagtttaggaagtgtcatgcacatggaggtagtctgctagatgaggcttagatcacatgtctatttcatctcactgttcctccttaaaagttcagatgatacaaatggccacactgtcctctaaaagaagcgttggagtttattttgggaaaggggcctattttaagataaaggacaggggctccctattctgccactgtgctggcttgtctccactccacactcagcaaaaatggaatattctctaaacaataggtgactcagcctttgcaaagtctcaggtgaaatggatttagccagcaaagagagaaaatgtctttttttttttttttcatttttccctggtcctgtttgatgataattctcagtgctcagtgctcctttcatccaaagatctgtaattaattaagcctcacaactcccctggcaagtagagagaggtacaaggatgttcatttaaaaccaatcctgtttgatacagtaggactgttaccaaggctctttaaaagaaaaacctttctggccgggcgtggtggctcaagcctgtaatcccagcactttgggaggccgaggtgggtggatcatgaggtcaggagatcaagaccatcctggctaacatggtgaaacctcgtctctactaaaaatacaaaaaattagctgggcgtggtggcgggctcctgtagtcccagctactcgggaggctgaggcaggagaatggcgtgaacctgggaggtggagcttgcagtgagccaagatcacaccactgcactccagcctgggcaacagagcgagactctgtctcaaaaaaaaaaaaaaaaatgaaaaacctttcttttgtgaaacttctttttaatggactaaattaaaaaagaaagggaagaagtaactttatctgggatacctgctgagttatggccacagacagagtcctaagttaggagctctgatgtcattcttggattaaactaggtgtataagctactgctatgtagcaaatcaccatgaaacttagtggctttagacaataataaacatttattgttaatacagttactgtgaatcaggaattcaggagtggcttatctgggtggttctgccttgagatcatagtaaagatgatagcaagggctgcagtcatctgaaggcttgactggggccggaggatccacttctaagatggctcactcaaatggatggtgagttggtgctggctgttggtagaagactaattctgcatgtggacttctgcaaagggctgcttgaatgtcctaattatgaggcagatgctcccctattacaagggacccaaaagagcaaacgtgtaagtgtcagtgtcttttgttacctaccctgggatgtcacactgtcatttcctcaatgtcctgttgactacacaggttagctctcaacattatgggaggggcctacaacaagggcatgaatatcaggaagaagactcactggaggcctgcttggagcctggctactgtatgaagacatattaaacgtatgtccatctgtaatattagtggtcctctgaaaaaccagcttagaggactaattatcattcatctgataagaagagagagtaagagatagggaatggtgtaattaactttctggttatttgtagttttagaaaaaagagccaccattcttcatggttaagtgattaagcctatattggagtgtacataacaaggggtgatgctcccatttttaggagctggatagctgtcccagaccttatagcagatcactggctcctcattgttggtccatggaccaatgttatattaactgctaaaaggcatccctgaggcatttattaaaaatgtggataccagctttctactcttagggattctaagtctgtgcatttggaacccactgtgctggctcaacttatcaagttatgtggggtgagaattatgacttatggcagttatagtcatttgcttagcatctctccatgatctttttcttggtctcagaacaccaactaaaaataagttcctggttgctaagggcatgaatatcaggaaggaattgatagttgccaatgttgtttgcataccatattagttcaagaaagtgcagagagtagaaagttccctaccataagggctactagaaaggcagagaggggatagggttgctgaccaatagcaacagtttggaagattatcattatactgcatcaatatatgcaaggaactggtctaataccaggtacagaagtacttttgcatcctgcatacattttagtccagtggttctcaaatattagtatccagaagaatcacctggagagtgtttaaaagtacagatctttaggtctgcctctgggattctgattcagtgggtctagtgtaccccaggtggttttgatgtaagtgatctgggaccacactttgatatacactgttgtaggtacagcctaacttaattgcaaggtattgacttcatatctatttaatctccagtagcaagagtttaaccgatagagtgggtgacatataaggggtacatgaatgacagttgctaggtgaactgatgacatgcatgaggggtacagggagactggacaggtgtgaaaaagcattttattagcattatctttgtggatattcccctttcagatgataagctcttagaggtaggacctatatgctatttaattttgcaactcccgcagaggttagcatggtaagctgcttgcatcaggcttacaatagatgtgttaacacataggggcaagttcatctgaagtggccaggaattctgcctggttgggaattgattcatggtacccagagcatgttgcatgttgtgctgactgctttatgactttcgaagttgagtgactctaggttattgccaagctctcctctcacctcttccctctttctttcaagtatctcaggtggtattgatagtaaaacagtcttggcattaatgagtgtctgactggagagtgaaatgtaaataagagttgaatagagcacagccaaagcctacaaattaccgctgacaaataacagggcagacaaagagtatttcagccttaccaaacacctctgctacaatcagctaagaacacctgggaatgtcagggtggcagacacagagccaacaacatgatcaagaagaggacatttgatggcaaagagcaaagcagcaagttgcttgtgcattgcttagagaagaagaggaagaagaatgatagaactactggcttcactcaagaataatttattgaacttctactatgtgccagtacttattataggtactagagataataaggtataccaagtagacataaagcttatattttagcaaaagatatagataatggataagcaaatacttagtacatagtacaatgtcacatggtgattagtgtcagtaagaagaataaagcaagggaggggaatacacagtaaaaataaagtaaatataattcccaatgacattgctatatataataatttgacaaatccattaaactaatacttactgagtgcttactatgtgtcacacagtattgggcaatggagatacagtgataagacaagttttgtaatttcacagtgcctaatttttttaggccaggaaaaagactataaacaaagaaagacacataagaaacatatgagatagtgatttgtgctatctagagaattaaggagaactggtagagtgactgggaaggctgctttagtttggttgagggaattcctctccaaggaggtgatattaaattgaaatctgaatgacaaagaggagccagctatgcagaaagcatcacaggccaagtggggagggcacacgggtgaaggccctggacccagcagatctaggaatagaaaggccagtaaagctttataaaccatgaggggctggggtctggttagaataattaagaagagaaataattttttgtttttcatatatatgacctggggaacaaatataaatcctacaaaactatctttctttccatttaaatattgtctagttctttcatcagagacaggtgtaatatttaagtcaattgatttataatatgaatttcttcctgtaattagttctcttttccccagcacccctgagataattcaaaatgcagggcaagtgttattataataaaattttatgttagtataattaacaaaaataccatatagcaatatgccagtcattaagcgtgttgattcatgtagtaactgggaattcttagttaatatttgtctgcagatccatttatcttccataacaccttagatgaaatgtttctttttgggctcgtattcaagatcttggggtgatctttttctgtgtctagtttccatgcaatctgagctctgcagcagccagtggaaatgcccttagttgtcttcagtttctctttatgggtgctgcaatctctttaacccctgtccatacaggaactttgtacactctgctgtattctccatctagggttcacatatcacccaaattctcttctatgtctctgggaagggaagcaattctttttgcaggtcttcactattgtctttttcttttttccattgctttttctgtgctgtctggagaatcactttccataccattgggtcttcttttccccagttaatataccagagcctttctgctcattcattctctacatttcatgcctctctgaagtattaatacctttctctttacactggttacagatgtatatgcaaagatcaagtggatagattgtgtttgctgagaaactttagtgttgaaaatgcaatgcaaatctttaatgtaagtttactgtatatttgagtgtattgtatatttattctccaatataaatttagcaactttcacattatgaatcactaagccttatgtttctccaaagaagggagcatgacttctcaaaatacaatattgttttagaatgaaaatttgtttcatgaccaatgcaaatcagttctgaaattccaaactccctcagccttgaataactttaaaatgcaaatgctacccataaggaacaaatgtcttttcaattattaaaattgaatttcaagatttggtttcttatgataaaaatgtttgaatatatctgaaaaatctttcttaaatcctactattaattaaaaaggataaaagcagaaagttgcaggcaataacaagaacaaagattgagttacaaaaactagaatgtgtttaattttcatagaagttctaaggcattacattagcaccattagggtagggaaacaggcttatgtctctctctgtctcacacacacacacgcacacacatacacaggctaacgggaaaggacagactcatgtacacacacatacacgcacacatagttgagccaatatgctttatgatctgtgaaaattaggctcaacatagtgaccgaattgagagacaggatgttgatcatagttttgctttctaacttgaagaatatagctgagaagccagggtttaatggttttgatattctggaaaataggtatcatgatagtcaaacgtttctgctctgttgggatacaacagaagtatgatgtctgtccttaggaagtttactagtgatttggggggaaaatggctttatattatacaactcaaacagtatgagccagtatacgcttaagcactagatactgcagtgcacagagacaagtagttatgagaatcaagagaaaggaacattattaatactgtgtggggccaacatggaatgcttcatggaggagaagaagtttaacttaatttggaggaaaatacagaatttagcatcattttctctttaatgatagcaagtcatttttattaataatattgattatctctctgttgactcacagattagaggatggaaaagcatgacaaacccacagggtaactatgttttaaaggtttttaaaaaagaagtcagaaaaaaaagagaaagcctttctaagagcctagtcttggggaaaatgtaggagatgcagaagagaattaatggctaatgcttatcattttgtacaaaataaccttgacacaaatggggcaatttaaagaagggtaagtgactcccagcccactcaccaaggttgatggtggaaataatcatggggttgagggcagactggaaaaagaagaccgagggtaggtagctttctcttctacattatgtgtgtttctgatctagaggtaggaagctcatagctgaaggagcattttagaaactcagcctcttccactttccaatcactttaggtacttaacttgatctagctgcaagttagatgtgtctcttttttttccatcctccttcaagctctatgcagagatgtgttagttgtcatatcaccaacgtccaagaagttatagtgaacaaaacacagttagagaactaggataattgtaaatattttttatagcaaaccaatgtgctacaatatgtaagttagggtgtgactatccctgtgcttcataagtgagaaaattattattgctctaagtcagttttccatcttggctacacattagaatcacctggcgaactttaaaaattaccaatgcccaggaccttcccccacctgctctcccaagaggcatagtgagtctgagaagtggcctgggcattggggtttctaaagctccccaggttattctaatgttctgcaaagttgagaaccactcctctaactgctgatataaacaaagtgcagctggagagtttgttaaaccacagactgttgaattccatcggcagagtttctgattcattagatctgggatgggaaccaagaatttgtatttctaacacatccttgggtgatgctgatactgctggttctggggaccacagtttaagaaacgttgatttaaactattgaggtcaagacaattcaggttgtacaaagtcagcatttcgtaaggtttgtccccagaacatacttattaaaatgcagattctgggcacctccctaaactcactgaattagaatgtccaggaatttgcaattttaaatgagctcttccagtttttcttttggacgctagtgaactatggtggaggttaatagttttatttcttatcttgctccaaatattattttatataagttgaatgtgtgaccctatgaaggtttttgtaattattttatgctatattttgtgtgtgtgtggaagaaaacctctatagattggattgcattaggtaccctgaggaatatcagtagtcaaatttggggaaataaggctgggcatggtggttcacgcctgtaatcccagcactttgggagagcagggagggcaaattacctgaggtcaggagtttaagaccagcctggccaacatggtgaatctctactaaaaaatacaaaaattagccaggcatgatggcagatgcctataatcccagctgctcaggaggctgaggcaggaagaattgcttgaacctgggaggcggaggttgcagtgagcagagatcacgccatggcactccagcctggatgatagagtgagaccctcaaagaaacaaacaaacaaaaaacccaaaaaagaaatttggagaaataagcttcgtcatggggcttatattataacaacagactcacctgtttatatagtggctgcaattctcattgcatctgagatgttcaagaggtaactttcaaaaccacacttggcacattcaacataattaggtaattgcacacagcacaggttgtataaaggttagaggagcatctttcaaattttagaggatattaaaattaccaggggtatttgttaaaagttagattcccaagtcagagctccagagagtcccagctctgggtggcatccaggaatctttatttaacaaaagtagattcttatacaatgggtccaggaatctcattttaagaaatagtggattggagaatatgaagtataaaaattgttttcacagttgacctgagttgctaataaacaatttgctatatatttactatttttttcacattttgtaagtcagtgtcctaatagctaggtataagtgtaggctaaaatggcaatgttcaggatacatcctttaagggtgtaatattattacatacatctgtctcctttctcatttacatattgtgcagctttttttgtccctttctatactattcccccttttattaaaaaatggagcagacacatgattaaaatgaggaccaggtcaagtttgcatttagctaagtattcttcccctttatttccctgtcttggccagcttactgtcattcctctttttccctttgttcttttgtctgtcttttcccctaccagtccatgttccatctttcctctacgttgtctctcctttgtgacctctttctgtggccatttcagtgggcatgaagggaaggggtggtcactgtaaaccttgccaatccatatttctctctccacagccaggtggtggtgtagaaagttagtaaagaataaaaacctacacaagtcttctattatattctggtgtgcaagtgtggggttaatagaactgaataaaatgatttttaactaaaactcagagtccacaggtaagagggagagaggtctggacaaaaattgtacaaaattttgttggtgaatgatagtctctgtaggggaacgctgtgcaaaatgagtcttaactgatttagaatatagctggacattcttatcaagttaactgtccactgttttgaatcacaggggctaggataggattatttctttttctttcatgtttcggatttccttctacctgcgaaaatattagctttcactcaagaatcctctcccaggcagaaagaaggaaagaaagtcttgctagaggagaaatcttattaaggctcatggtgattcaggagtgacagccggggctttttcaatggacttatctgctgtcacagagacccactatcctggaagagcccaggcaaagtctgagggttttgaccatcaaaatgaatgactgcaatatgttttgaattgcacagacaggaggagaagtgataggtattctttatggaaaatcacaaagagaaagagctagcaatcttcaagcctttttatcttcataccaaaaacaatatgaatactttctatggagaaaaattgtggcagcaacctgagctgaacataactacaaacagaaaggatatcccctcctacagccctcagagtcatctggcattttgcttatcctgcccctgaactcaagactcttttatattatagagttcttttaggaaatatttatttcttgaacttccccttattttttagggtatctccccatctttttgccccaagagcctgaatcacttgagcaagatataatatccatgtagataagatgataaagggattccttatatcaaggagtcaactaaaagttaatccctgtgaaacacagaaacccaccacaaatggtaaaatcccaagaaaaagttttgagttttgaccaaagagctaatttcatttcccacaagtgcaaaactttggatgtatttatatcagctgactactatatcttttctcaaactccaaagcccacatagctgatatactcttgtcaactgatattgtttccatgttacagatcaggaaacggaggctattcaaagttactgtatatgcgttgtctaagtgctatttgtatacttgtttatcactcctttgatctgccccattgaggtagacaatgattcttgctacttcttggctctcctatatacccagggctatcctgtctcataatagaagcttgataaatattgtcaaactagatcatatgctttgtttgagtcctcaaggggagacaatgaaatagctggggctagaccctcctctctctctcagacatcttgaaatgcagtcaggacgtagcggtgctgagcccattataagacctcaataaatacctgtcaatggcttgactgaaggactgattcaagactatcatattctttagtacttgtctcatgtacttcaacaaggactttagactaaactgatttgattggttatatttttagacttgttacttctgttttgacagaaagaatagacaatacgactacaagcatagtgaccttctggatttgttcctgtggataatcttaagataatttgaaggaagtttcttaactttttaaaggcacaggtgtcagaagtgacaggcttgataattagtcagcattaccccctcactccttttaatgttgtttctcacgctttgcattggttactagtcaatctgggttgcagttctgatttagatgtcaccgtactctgctttaaaggttattttggatctttgcctgtctttgatgtgttctagtacccatcttcctgtctccatccccagcatctgagaacacttctcatttccccactagattgtttttttaaatttttgagcatgctctgttttattttctgattatgaagggcatttctagtagtcctgggaagagtgagctcacaaaaagacagctagagaactagtgatcatgactattatcacatcaagactttggcttaagcaaaacagaacaacaaaaccccaaaaaaccccacaaaactgggaagtgcttagagccccttctacgtgactctgtctgcatctgcagtaggaaagtttacatttactgttaatctgctgttcaactttttgggaatgaattagcaactcttaaatttctctccatttcctatttctagtaattagctcagtgtcacagctaaggttttcttactgacttcagcatggagacttagcagttacggaaaggagaggctagagctttccaccaactgcatgtcactggtgactccaagagagaatccaacaaatcaactactaataatccttactatttaaaccgtgttcactattatccaataacttggctctcagttatatcttcttaagaattctaataaggcatttagtttatacaaaggaggagtctgatctatgcagtggacatgagagacaaccaaagttttgttcctctttccaatggcatagagaaaaaaataaaatttaggcagaattagaattcagaatgcctgggagttcctccagccttgggaaattccaggtgagaggggaggactctggagctttttaaaaagaccctagagttcattttacccaacaattttatttcataaatgagaaaactgaggcctagagaagtatggcttaccaaggttacaaactaaattatggcagttttagctcatggcttatgttagctagactgctggttcgatttttcagtggaagcctccttttgaagaagggcaagccattcatttttcagcataaaccaagggatgctcttacacacacacacacacacacacacacacacacacacacacacacacagagagagagagagagagagagcaaaaaaagaatagccatcataaagatacatttctgttctggattcaagaggcagaattattaatacaggtagactgccaggaatgcagaatgttaatgcagctgcggaataatacactagtgccacagagtttaataatagataatgacaaataatacagttggggaattgtgtaattcaataacagagtaaatgacaaggaaacacacacaccaatgaatggttctagtggggacgcttaggtgttttcaatttaacttacctctccagccctttggcctactacccttttgagaggcaggcaggacatgcagagatgtgcccagctggggtttttagtttgtgcagtgaagttgcaggtttcaggggctgagtcaggaagtatgaattgtgctcctgggcagttatcagctgatccctttaatgcatgtattactttcctccatgtcatgactggatagtttctttttttctgggggagagggggcctagaattgtcccaggttggccattctctcctattacccactctgtaaatcactgcatatgagggagtggtactggaacatggagcttgaagatgggaagagactgggagttggggtttgggtttagggtcataatgggaggtaaaaggtttagccacagctatggtttagtaagcataccagtgatctggtgtgtacttccctgtcctcagctgcattagagaaaggcagccgctgatcactgttagacctgtattctttctctaagagaatgggatatttccctctcattcttttaaaataagataaaaagcaaggggtggggaaattaattaatgtcagtaaatgaagcatgagacacttgtccggatatgataatgactgtgaattagtgcagaataaataaaatggtataaaaaatgaaccttgccagcacactcctttgggatgggctcagtcacccttataatgcattaactcttcccttgcctcatccttggtcctgtctatgttactgtgtcaaagctcccccactgcagagtctcaaggctacagtattatagcctgaggtgcccaaagggagccctggctccaggagagattgagccagctggtgactgcatactttataatgtaaatagaataacttcacatctatttattaataaaaccacactaaaaagaagcaattgtgtgtcccccggttgggagattcaagaaggcagacagaaagccactggaggaagaaaaagggataagttcctcaaaataagttgctccctttcccccagagccaaagtttacctttgtgctgctggtaagttatctacctcccctctctacttttctgtaagggccccaggctgtatgtcttttatatcgtcttcagatgactacaataaacacacactaattgggcacttcctgtgtccaagcactgtagaataaacagagagaaataaagcaatctccattttcaagttttctcctttaagggtgtggagtagtgcttgacatgtagtaaatgctcaacaaattgttgctattacatcagcattgtttcactgaatttaatccctatgaaattttcactgaagacaagtttgagagattcagagagcccttggccactttattttctttacttttgtttctttgctttccttttctccttcattttcttatctcttctatgtttcaaagttcttagattattggcaaagcaaatgcaaagaacatggttataataacctttgaatgttaacacttaagaaattatttgctattaacagaaactcaatgcagtgtagtcaccaaatatgaatcactgaattcagaaatgttattaattcacactacagtatgggcaggtagacaagtgtcggaatactagtttagagttgtttgatgacagcttatatctttttgtattctcatcagtggtgactatatttgcagagtgatttggaaataataacaaaagattgaatttgtaatgtttggtattttcttaaaatactctggaaccacaacaaagagagggctggatgaaaccatgtggacaattattgttgaagctgagcaataggcttatggtggtacttactatttttgtgagtgtttaaatactgctataataaggaaggctaaagtgttgagggatcctttgggaatgtaagcctggatgaatgacctcctggggcctacctttttcctgcccctccaagtccaagttgggaggtagatggtgaatgttttacattcctggtgtgactcaacataaccttttaaggacagtgttaacatgagatgcctcctgttcctttgggaggtctgtaatttttctcagaaggctaacttatagtccaggtatgtgtgcactctgcccattcagtctttgcctttggtttttctttgatctggaggatcataggaggcaagtgtggaaatacttcttcctggagacaatggcagaggagagtccgtgtatagaaattgatttgttaacccttgcgatggcctccctctcccaccctgggatggtggaagagatgccactgagagcctgggcttgtctggtgaaagagtgggcttaaggaaaaagcaacaacaggatcacaaatgagaccctaaatctggttttttccttgtcctcagtagcttattagagataactacatcacataagctctgtccatgactgtgaacttttatggttttgtctattagagggtgatgtcagaggctgttatcactggcattaatgatttatttgggcacaggtagacttataaaagtaggtgggggtattgattatagtcatgggccaatgagattctgtttcatttcctaaccaccaaacagatgtaaaggacttctgtgtgcagacctcaagattacacagcaaaggggcttccaaaggaatttacaatttgaatgagacctataagaatcaagaggtgcccaagagcagacgtaggcctgtatgtccccatatggttgagttttgataatccttcatttccagtcactgctatggtctggctgaccttctgaatgtacccagtattggctggctttagatctatgatatgagctatttttttactcattaaagtgtttaaatttctgtgcttagtttctcagatgacttttttttctgtgtggaatctggttgatatttttggagaataatttaaatcagttctaattccaccctgaagagctccttttgacacacaagtggctttgtgtcattgcaactctggaggaggccagggcaggcttcctgggtgctcagaacactggctgcccttggaattatggctttatctctgggggatagtacttcaagaaaaaatgccaaggaaatgtttgtcttagtgtatttttgtccattttgcctcaaaaaagatttgtcctgcccaggagcagtggctcacacctgtaatcccaacactttgggaagccaaggcaagtggatcacttgaggtcaggagttcaagaccagcctggccaacatggtgaaaccccgtctctactaaaaatacaaaattagccaggtgtggtggcatgcatctctagtcccagctactcaggaggctaaggcataagaatcgcttgaacccaggaggcagaggttgcagtgagctgagatcatgccaccacactccagcctgggccacaagagtgaaactccatctcataaataaataaataaataaataaataaataaataaataaataaataaagatagatttgtcctgaaacttaaagaataaagactcggtagacatggaatatattttttttcaaatttcaaaatgcaaaagagaatacaggtaaatacttgtatttacttcataaatgccctatttttcacagggtgtatcagtgtgctttgggctgccatagtaaaatagcacaggctggaggacttgaacaacagaaattcattttctcacagttctggaggctgtaagtctaagaccaaggtgccagcaggtttggtttctccaaaggccattctctttggcttacagatggccatctttttcctgtgtcctcacgtgacttttcccccatgtgtacatccctggtatttcttcattccaaatttcctcttgttataaggataccagtcacactggattagggctcactctaatgacctcattataacttaatcacctctttaaaaatcacctatctccaaatacagtcacattctgaggtcctgaaggttagggcttcaacctatgaatttgggtaggaggcagggacacaaatcaactcataacacaagatgaggaatattgttaaatgataaaaacaaaacacttgatccctatgatctaaagccctgctctgcaattctagagattgctttagaagtttgcatttaggtatagtcgtaacatcctagaaattaatttagaaagctgcttttacattaaaaatcaaaaaggtgagcaaaaagaatcatggctctgtaaattttcttttattttgatatttcagaggacattattactattactaaaatattgtgggtggggggaaggaaagttgggagtaggatgagaaagaatcaagtgttgagggaaatttttcatgtttgttggaggaaaagaaaagacatgaaaggaagaaagatgaaagaaagagggagatggagaaataaggcaaaagaagagaagaaggagaaagaaaggaggaggaggatgaagaagaagaaaggggagggggaggagaagggaggaggagataaaggaggagaggagaagaaatgaagagggaatgggaggggaaaggtggagtggggagtgaagaggagaagggggtggaggaaagagatgaggaaagggagaggtaaagaagagagagaaattagtgtaggtagcacttaccatggattgaaaaagagagttcacgcttttccctctcttaggaaactcccagctgcttctaagaaaataagagtgactacatcagagagatgcaaacaggaagagaaagtaaatggaggccctggagagggagagcttgggtattgaggtttggtgtggatagctgagaaccatccaacattaatgagcacaaatgtgtgcacaggctgaaaatgtctctccagggacgctgatgacttgagctttgtgtgtgccattggaaatcatgaatgagaaaataactgactcgctctctcagacaatctggtttatggacctgaagctcttatttgctgtcaggttgttcatctccacgcctctgtgagatattattgaaacagaacccagcactgtcctccttgccaaagtggttgacgttggccttaactttccccagttctgagacagggacagactggctaatgtaagtgtgccctgtggatgtgcaatttagagggaggaatgggaaagtatgttgtatgcagctagggacgcacacacagaggatattttcactgattcctctctgtgggcataactactgtcttgaaggcctttgcttttctggttttatgatttccaagcctctttcctgaatcttagaagtcaaaactcaagctaagctgcaacagaaacttcatcttttctcagaataaaatctattttcttccccttcccatggtaaacaaattatgttgacagacaaatgagggattaggtgaggaaatttgtgattttggaagctcagggaagcagatgtcaggattcagctgagagggaagaatttgggcggggtgggaggctacatggagaaatcagaggcaatcaggaggtgctgtccaagatgaggcatggtggtgagatggataaagaagcagtttctaagatgccactcaagagctctctggagatttacagagagctggacttttttttttttttttgagacagagtctcacgctatcacccaggctggagtgcagtggcacgatcttggctcactgcaacctctgcctcctgggttcaagcgattctcctgcctcagcctcctgagtagctgggactgcaggcacatgccaccatgcctggctaatttttgtatttttagtagagatgtggtttcaccaagttggccagaatggtcttgatctcctgatcttgtgatccacccacctcggcctccgaaagtgctgggattacaggtgtgatccaccacacccggcctcccaaagtgctgggattacaggtgtgatccaccacacccggcctgagttttctaaacttctgggtaaggctgtttgactttggacatgacgctaggcttaactgagcctctattttaccttatgcacagtgggcatactccttaccttacttacttcacaggttggctttgaaaacaaaatcatataggaaaaatattctgaatatgctgaagagccagaaaacatagtattatcactttcttggttttgctgtacccatgtatgaatcttttctgcagcatccctgctgcatgcttgtttctatgtccccatgtcctgcctcagttgaatgcatctggtggtggggagcttactaccctttaaggaaagtcattgtttaaaaacatgtatatataatttttaatttttacagaaaaatgtttgcattgagcccaagtctgcctaataataatagcagtaagctaactctcatgtaaggtatactctgcagcagacccactttgggaactttacatatattaacatttattacatttattattcttagccaccctataaggtgggtactgttattattccgattttacatgcaagaaaaccaaggcacagacagagtaggtaacttgtcctaggtcacggggtaataatttttacctgctggctcttgtttttctgtccatagctgacccaaaatatttgatgaccggtattttgtcctctttgagtgctccctttgccggtctaccatctcctttcccttgctttcttctgcatgtgcctccttctgaagttttcccacagcaggccccactctccaagggtgtttcgacctattcagaaaagagttgcattgctgggtccccttggacctgctgctgccggtcggctgggaagagttataaagaagaaaggacattttcaagctaagctctcctggaaactggtaggatggcgtgagctggtccacaggccccagctgccagatgatgggaattgggatcagctgtgacctaattatgagtctcgtaaacctgcattgtgcccttcattttccagctcattgaccactcagagggggagggaaaagggatgagattctggtcaagtccttcctgccactaccatgtggccaaggtcacaggccaatgatgtccagagggagttggggcaggggatgcgctctttgtcttctctgaatgaagcgagcgaggagtgaggcagagaggaaggaagatttgcagacaagcaagcctcccaggagcttgttggattggaatgtattctcaggtctattgtagagacagaaattccagatttagcattctgtcattgtcagaataacaaattaatatgtcttatgcccacacaactacatatacgcaaatatacaggcatgaaacggaatatctggcagatatcatgtattttataactctttggggacaaagactgtgctgagaattcatttttatactgatagagaaccccagctccccacctccaaaccaaacacataatctccacatcacatagatgtgggcgattcaaattgctttctcctgtcaaaaggtagcatctatgaatcactaagtagagtctatgaaattctcagttgagaatgtgtctataaaatttcctcctttcttacctttttaaataaaattactaatttctctctcaaatctgactgtggaagccttaggactagtgggatattgcagaaagaatgtgacgtttgggaccaggaaggtgctgagattcggattccgcctctgctgcttaccatgtgggcaacgctgactctgggcaagttacttagctctcttagcctctgtttcctcatgagtcaaaactgggaataaataataataaccttttagggttgttttatctctatgattaaacaaaataatagatatgacatacattatgggtctatcacatgataaacgcttaagaacagagactccttttactttccagttatccaaggtatagagtatgagaggggcaggtggctgtgcagtggtacatcttagtgcataatctctagatttttggatttttttatattgagaagtggactgccaaaatttttgttaaatgaaaatattttaaaaataattaccgtcaattaacattatttcataaaaaagacattctaacattctaaagaaagccttcaaaggagtgtgtgaaaattaaataagatcgtgcatataaagtacttaatagtttatattagttcctagctttgataagcattttaaaaagcactaggtatagtttttagatatattagttttagtattggtatagtataaatgttaccataccaagaatcaagtccaaaatctctaacatgacatataaatgggtgttcacacacacataagccatttgtaccccacaaccccagtataaagctatttacagatacactctactccagccaggggtcccagatataaacacttgtaggggctgggtggataatatcattaagtaacatagatagcaggtaagaaaaactctgacgtggtgttagtctgtcttttatccttcattgttgttttaaacatggattcaagctctgaataataataagagccaacatttataatggcaaagaagaatatcatcttgctatgtgttcaagctaagcatatgtttatgtgtaagcatagctttgccaagtataaaaactagtttggaaatcctgtatggactcaatcagcttaatttttacatttttaaccctctgattttgtctttatgtttatcttcaccagttctggttctgcatagaaagtctttagaggaatgtaccctttccgataatgcttccagatccaaaggatgcctcgaaagtgaccaggaattgctacagatggttgacttttacccagttgccaacgttcttctggggatgctgtgcgttttgtgtcctcatcccaactcctagccacttcaggtttttatagatgatcttcagacaaaaatagattaagaattagccaggaggggtcaggcattgtggctcatgcctgtaatcccagcactttgggaggatcaggtgggtggatcacctgaaatcaggagttcaagaccagcctggctaacatggtgaaaccctgtctctattaaaaaaaaaaaaaattagccaggcatggtggcacgtgcctataatcccagctacttgggaggctgaggcaggagaatcacttgaacctgggaggcagaagttgtactaagccaagatcgcgcctttgcactccagcctaggcaacaatcgtgaaactccatctcaaataaataaataaataaataaataaataaataaataaataaaaagaattagccaggaggaatgacaaatagatttcatctttggactaccctctttaggggaaagttgtggttcttcatcctgctggtatttaatggattcagcttcatataggggatactagcttggaaggggagatacttagagaaaaaatgactttcagtgctatagcaaaaaggaatttaaaacatttcaaaagcccccaacctcagtacattccaaagcaggataaaataaatacaaacaaaaaatcaacacctacaccaaaccaggctaatataaaacaaaacctacttaaggtccagatttttttgtcccagcatttaaaaacagtgccagcatggactgaagtaaacacgctgcaatgatttctcagcttgggaaactgtcctttcttatatgtgagatgcctacagaggaagcagaaagatagtaatttctttcccttgcttttctgggagatggatctcagtgtttttgtcccttggtcctagccattttaaagagactgctgccagaagaaccacttagcacaattgtgaaaacctagtccccatccatagcagagatgctttcctttaagctgtactttttgagatattattgacatcaatatttgttaaaaccaaccttcgtggagctgttgctatgtaaaatatattacacttaggtcaccaagtcattagtccaatataggtatttggaagttggtttttagtcattctctttaattcaaatggaattagggtcagaagaaatgttcaagtcctaatcacttagaaacccatatttggcgtgttttgttgcttgggtaaagggagtaagacctcatggcttgaaagaatcctaccagaggtgttttgtttttttttttgtctgatttcctttttcaaacttgataagggagtaggcaaaaaatgtctgagtcaccagaactggggtttcacaaatgaatggtctcgctgtaacctaaagtaagggttgaagtgggggaagatgaaacaataggtggctgtagcactggaagaatatttgcagccccacaaactaatgtctgaattacttaggatacatccctctgtctagagccagcccaaaaaaatatgtgattcctgccctgattcagatagagatatctccaggctacttactatatgtatttattatgaagtacatgaataaatcgccacccaaatacagtaaatgcattggtattaaaaattaacacagactttttgttgtctgtcatcccatcattttctctttaatgaaataacggtctggaataccacctaatggcctgagatgcctcagagtgaggtgtgtttttaccaattctttaacttaatcagactggcctcttgatatggggccaggttcttctgagtaactcactctgaagaaaagcaggatggattgattcatggaatatggaagtgtttgcctagtgggcttcttttcaaaagctcaagaactttttctaaggtccctggtgtaccctggggaaaaaatattcttgactttttttttttttttgtcaaactgtttgtatatgtggggtgtgtgtgtgcgtgcgtgtgtgtgtgtgtgtgtgtgtgtgaagttgcatgttggtacatacttgagatgtcactatagcttttcttgccatttttcattccatttctactgggatgagcaaaattgacagcttctagacatctggaaagaggcttttgatcttaggaagtgaagtacataatcatggccaattttacctatgaggaagataactaagtggtttctcaaatgccagaataaaaaaatgacttcttgtttttcaaaacaaggcatagagatcccaatagcaacacagaatgtttctgtgtatcagagcagaaaaaggggaattgaggtagcattggttgaacacacactatgtgccaggctttacactaatttgcttgaataatttaagtgagtaacagaacaatgtttccactaagttgcagcaaaaactacacatcttagactttccttagtgacatctcgaatcttcagggaaggtggggggtgaataattgaaataactcttgatttcttatattagggaccaggaatatgcccttgataggaaatctgtcatttggaggtcattttggccctttctggaagaaaaggagacattgagtgctttgaggttccaacatcaccacataccagttagtgaaggtgacagtcttctggatctctgaccagcaccagggctgttggcccttgttgctgcccccatcagtctgaacagactcttttcccaaagaaatttgctaaaatgacaaatcagttatcactgtctattaggacatccactgcatccatctatcctaatatcttcctcacgtatgcctcagcggcatgttttacttctatttactggtaccacagtcttagcaaaagtagcacattgattataggagttgtgaagccttgagccctgacaaatggggaccacattgaagaaaatggagggacaagatactaatacaatttccattaatgacctggatagagtccccaggcattgcttatgtatttaatttttattctgattatttttaacattgtaggcagaatgccagaacgccaaccatcttagcttcttcaacattatacagtgaaagccagaggggaaacctaactcatcagatcatagttgacattgggggaaaaaaataaaggtcagcctacaaaatttcttcagactttgattaatacagttgtagatttgaaaaaaatgttttatttgagttttcttcctacatattttgagtttggatgtaaaatattttcttttgaatttggaagaccacttctctaagaatggagagttaattagatgattttcttttctttctcattggaaatgtaaaccgtgttcatttattcaacaaatattaattgagtgtctgctatgtgccagacactgttttaggaacctggaatgctttcaggaacaaaaagagaggaaaaaatatccttccttttgtaaagtttacattttagtaaaaggagaaagaggcaatgcaataaacattacaagtaaattccttttatagtatgttagaagattatgagattataggagaataccaagctgagcagggtaagaggatagaggtgctgagtaggaggataggtgaatccaaagatgaaggggttggttatgtcgttatttggggaatataaggccagtacgtctggaatgcagggaagagggagaagttaactactgggagccagagcatagtaggtctttttggcccctgaaggactccaacttgtactttgagttaaaatgggagccactgcagagtcttgagcagtcttaactcatgtgactagcatgagttaacttgagtcttaagatgcttgtgttggcctctgtaatgtaccaagaacagtttcttgccctatgattccagttttcgataagttatgccatcacttgctgcaaaacagacctcacccaccatgacactgggccagtggctatttattcctgatgaggcattgtaggatctagatcaaactactgtttcttccaagcttcctgattgcacattttcatggaaaaatgcaagggtatgtggtgcctaggaaaaggacagtagaaacggtaatacattttactcttgagcataagttttgattaactttgtcattatttcaagccaatatagccacaaacataattggtggttatgaaattatgcaatcacactgtctgaggcctcattaccctttaacttataaatctgccttgccatctttccatgatcctcttaaagaatgtacctacccaccacctacataataaaaaaagccacaagccccagccttgggggaattgtattgatttataaagagagaggctatcacttgctgttctcattaacctggaaatagacaccacattttatctgctgctctgtttcctgctgtagatctgtgtagtaaatccattaatctgtctgtccattcatccatccatccatccatccatccatccatccatccatccatctatccatctgtccacccatctgtctttccatccaaatttccatttttaaagggactattttgtgtcaagtgtcatactgggaggcaatatatttcatggttagatatataggctgtatgtagcctcagactgtctggaattaaattctgcccattactttagctatatgaccttaagtaagttttgttatttgagcctcagcatcttcctctgtaggatgagaatggtaatcaaatgtatcgaagagttgttataaggatcacaaagttaattaattcaagtccttttcattttgtcccggaggaatagttttagtagtttgagtttgcattcaatcatctcccctttcgctttttcatcagtttattcctttgcagttcatccagcagcctatcaaggacctagtatgtgttaagtattatggagacggggatatttttctgagaaatggaggctgtaggtgtgtctctagcacctaacacagtgcttggcacatggacaatgccctgtatatatttcatggaatgggtgcaactccctgcccttgaaaagtgttcagtgtgtctgtagaagtccagtgccagatgggagtgtcactggtgcagtgagccagggacagggagcagagaaagaacaattgagaatatcagagggagatgatcctccggctgcttctgctggcctggacatttgaagggatttcttactgggactggctcttttgttctgtggtttgtatttctgcctttgtgcgaatgacttgtctgacatttctgggactccatcctgatatgcaggccagacaggtgggatcccagtagggaactaggtatgcctttctgtgtattccaggaagagtttaaccttgggcagacagggctagtctttttgactttatggtatgtttaatatcaacacctggttgggggtagggataataaatgtttggcttacaggacttgcagctttgcaagatacagtggtggtgcatacacttatatttgttatgactcatcttagtgcaaaggcaatggagtacctctagaaaaattgcacatttaaggggataatttcagtggtgactttagtgggttttagaagcacgtgagaagtaaatatgggggactctggagctagaatgcctgggttcatagctcttatcttttctttttctttttttttgagatgggggtctcactatatcacccaggctcaccttgaactcctgggttcaagtgattcttttgcctcagcctcccaagtagttgggactgcaggcatgaaccactgtggctggtcagctcatagctccatcttttattggtcatgttaccttgggcaatgttgttagcttctctgtaccttagttttattgctgtaaaatggttctaataattacaggctacctcattggaagttgagaggattaaatgagatgatatatttaaagtgcttaaattcttggctcataataagcattcagtaaatgtgagctattatttctctttctcctcctcatttttaattttttaaatactacctctattactattgtgaataatgtcattataaaggtgcaactagatcatgtttatgaaggtaggtaattgcctagcacaggcctggcacagataagcactgagcaaatgttagttttctttcacatgggtcattaaagtccgtctgtaaagtctcagggactttctcatcattttccctaaacctaatgcaagatattcacatttctttttgtgcaaagaacaatcttaattcagctgataatcggggcctcccttaccttcccactgctcactataacagagaacaagtactagctcataactttttatgactttgtattgaattaaaattataatgctttattagttatcttttgctgtttaacacatttccacaagcttggcagcttaaagcatcacacatttattatctcatagtttttaagagtcaggaatctgggcacagcttagctggatcctctggtttatggtttcttacaggttgcaatcaaggttttagccagggctgagttctcatctgaaagcttgactggagaagaacctgcctccaagttcacctggttgtaagcacaacttcattcctggagtgttgtgggattgaaggtgtcagttcctagctggctgttcactagaggctgccctcagtttcttgccgtgtgggctttcccatcatggcagcttcaccaaagtcatgagagagagagggagagagagagacagagcctgctaactagatggaagttgcaatcttatataaagtaatcacagaattgataccccatcaactttgctgtattctgtttgttacacacaagtcacaagttcaacgcaaactctaaaggaagggattatgtaaggatgtgataccaggaggtggggaccattgaggctatcgtagtctgccatagcatgcctgacctgtgggttgtcttttagatgctttattttgcctaattttattttattttttaacctcagttcagagaattcaatttattagaacaggtctgaatggtacagaggtgctttaattattcagcagaattctggaaattttaagttttctagaaatgtatagttttgctttactttttctccccttataaatagaaacctgtccttccatgaatgaatgctacagtttcagagatgctttgtttttcccctgattgattgtcagtgggcagtagcctctaataaagggaacagttttaagtttccttttcttctcagcttctctgttaaatggttaatgatctggaagcaagtacttggaggtccttagggagctcctatttaaaggaacactgtgaagagaagttgccttctacagtaaaaaagtggggatgattagtcctccatttacatgtttagtaaatctgaatatttagacttccacggataccccctgccaacccccgccaaatagatgagctgaaagtacaggatagtactctacatgcatctgactgagaaagacttttactatctcaccttagggtcctaagagaagacagctggatggttgcatggcggtagaggtgtcaggaaaagctcccttataattattttcattcctatgtttctactcaatactatttaaactgaaatggggcttcatctgctcctttgtttattcagcaaatacttttgagcattttttatgatccagctactgtgctaggtgatggggttacaataagatacagtcccagccttcaaaaacttatgtgctcaaacgttattctccaaatctttattctgtttctcatctatcattaatgggaatagacagctcattttttattgttcttggaggctagagagtacaggcaaatgcagatgatcaagcctttcttattgccccactcctagttgattccctctccctttcttttacttatgacatgcaacttccacaaaggcagtttatgttagttatctatggctgcataacaaattactgttgaacttagcagctaaagacaaaaacatttattatttcacagtttccatggaggaggaactcaggcatacccttgctgcgtcctgtaactcagaatctctcagaaggttatcattgaggtgtcccctaaggctgcagtcatcctaagggtcgactggcaaaaggtctgcttccaagctttctcccggttgttggcaggatttagttcctcactggctattggccagatccctccctcattgcctcaccgtgtggacctttccatagagcggcccatggcatggcagcttgctttactagagagagcaagtgggaagagccagagagttataaacaagacagaagctatagtctttggtaagctaaacttggaagttatgtcccatcacttttgttgtattctattcaaaaaaagctacttactaggtctagcccacactcaggtggagaaggttatacttgggcacaaatactaggaggtagggattgttgtgagccattatagaagttgtctaccatgggcagaaggacatttcaattctggaaggtatctgatatggagactcttaaggcacaatgagttacccgtgagctacctcttgtacattcatagctgtccaccctttttatattttctgtggtatcagcacagagattgggggcagggggtggaagcatggaataaggaattagatgccaaaactaagaattttattttttacaaagcgttatcacatattaaatctggaaaggacattagagggccttatgcaaatgaataaactggcctagagatcttctatgcagcccccccagggtctgttctactgcagaccctggatctcctataacagaactataacagaacactggatctccacagaaagccacaaaggcccagagatgtgttcgcacagatgtcatcatccctcttctagtccctgcaggagcctcatgggagatcacgtgaccagtatttcacagctctttcccccagcacagaaatatctgccgtgttgagaggcctgtccatctcctagtccctgctagagcctcatggacaatcacgtgaacagtatttcccagctccttctcccagcacaggaacaccctgccatgttgagaggctcactcaagagcctcatgatctgcctgctacctagcaatagctttgttacataggttgattctgccttgtgcctagaaaataaatcatgtttaggattaataatagtttatataattaatatatgtgccatgcttgagccaacacattccatcacttatcttcaggctggctgcctcctgggagccactaggtctcgagctgcaggctgagcatgctgggtaacaatgctataagtctgcttactggacccagtcctacagcctatgaatattcttttctgtatttgaatagcaatagctggagatgcacaagtcttgataaaataattttacatttgttatattcactttttttcttgcctgtcaaaaatgtcagcttttactctctggcttgcaatctaaatggacccaattttaccttagctactttgatatgatattagctgcttagggcaattgcaagaaataccatacaagggttaatctccctcacccttccattcctttgatatgctgttggaaatttcaaagtgctcaaacacggagatgaggaggcagagggtaaatggatacagaatggctgggaaagggagtagcagtggttggctgctcttaagatctctctcccatggcctggtgccatgagtctgtgtccagtgtgatttttggcaatttctacattctatgtgtatttgtgaagtactgtttttgcatcagatgatatctaaggataaattttgtgttagaggagtgtagttacttgggaggaaagcagtgccatattattttatattaaacatcactggcagaaatatgaggatgggtaaatgtctactgataatttaatagattttacctgcctaaatgacattatttgcaatctgtttatttagttagtagcaaatcctggcacattagcataatacctaagggcaaaatattggattgactgtttgtttgcccttaggttatttttaaaaagctacttgtataaattaaaaaataaagcgaggcttggttgctaagaggatggtgggatttgtagactgcacaggagactaatgcaaatcaaagagaccaggaaggaaaggccaggagaacaacagacaacaggtgaatatccagaaaccagcagattctaacaggcaagaggtagaggctcaaggggagacagatgattgattggcttcagagaggtctggtaggaatctaggttgtcagctgggatcgtgatcttcagaacagaccagtgtggggcaagcccaaagcaataacttggggtcaggcatgaggtcagggcaaggcagtgggagaattgtaagctttgaggtatgtgtaggttaggggcttggtcaggaccaccatcagcaggatcaggattagggctcatgggtcttgaacttctttcattcttcctgaccagaggcagggctagtcccagggcctaggacaaggctaagcctgaaggtggacattatgtgacaaccaacaaaaggaggaacatcatactagagtcaccgtatgtcctagtttctctaggacaggcccactttacatgtgttgttccagcatgataatcagtggttctcccctttcacttgaaagtgactgacttgcgtgataagttacatagttaccctgattattttccagaatgtgtttcataaaaatctttttagaagaatgtcatccagagaccacaaaagtagagttctctagtcacataagtatggcaaatccagaatgaaaggaagtttaatggaggagtctttactgcaggatttctcactgcctttatatgctaaattataataggaattgctaagaggggaatagagttcttagtttcccatccttggttgatctatttgtacactttggtactcctgagactacgttatgtggaacacactttgggaaaccctggttagttgaatatggggtcagaaagggaaactggtcattgctcctgctgtaataagggtgcttgcaaagacagcagtcaccagttaaataaataattctggaaacaacaactgcagactctgacaaaatcttcaatttgctgattattgactgacattagcagaggtatatgtgactagccctagctgagtaactttctgaaggatgacttgttctctagctcattggcaaaaccacttactacttagggcatgggaagaaagagaattttctttgttaagtctttaactccatgatgttcttaaaggagagatgaatgaggagataatggtgtgtatgctgtgtctctgtgtatggggaaggggcctcaggaactatgtatttttcaccagcattccaggtaattctgataaaggtagccctcaaaccatttatggagaaacatttcctgggagttctgatgagaaactcatggtgataaaaacccattcatagtggtcatttctttaatcatatgagtcctttgatatgatggccagtgatctgatatttgcgaagttcccactatgtgccacaccctatctatgtgctttcagtgcttaacgtatactgtgtgaaatagtcctcatagaaatttagcaatggccccattttacagaagatgtctaaagatagaccttcaagtgggcccgacttactaggccattccatccgggcccgacaagagggtcacagctcttagacccacccctcagcaactccctaggacaaggacacaatgaggcaaatctctgagcctttgccctaaggttacacaaagctcatttagagccttaacaagcattaagaccattccattacaaacaggaccatatgctgacacattttatctctctgcctggtggaatgggtcaatatcaaacaagctaatccagggagaatgatgcattgatttcctaggccttaccaagtgtgcaggctgaagtcaacctacctaggaaggttttttttttaagatgaggtggaagagagaatacagcaagaaacaaggagaaagatttgctttgcttttgttatggagttacaaatccagacaagtgacataagcagcttcttgtttttagctgggccaaagaatgtttttcttttttaatcttattgaagagccaggatctttgtaattccatcaaggatttcaaactcaaatgcttacaggggcttggagcatgaggagatttagaactgcctgctgggtgggatctatggtgacctaaagaagacctgcctcttctaaaggggactcctgataataatgtattgtatgtttcaaaataaccaagagcaaatttcaaatgtcttactctaaaaatgctagatgagcaagatgataaagatgataattagcctgatttaatcatttcgcattgtatacgtgtcaaaagatcacataatattccataaatgtatacaatcatttatctatcaaaaataataacaaaaaataaaaaagcagactgtgctttttagcattcagagaatagattgcctatggaaaatatggctgttttctcagaaatttcaactttttaaacaaaagttgaaaatctatattttttgaaagtttttctgatttttaaaaacagacttcttgagatataattgatatacaaagagctgtacatatctaatttgatgaatttggacatatgcaaacatcgatgatgccttcaccataatcaaggtaatagacatattcaacacctcccaaagtgtcctgtgctcctttcttttttgtgggtaagacgcttaacctgtgatctaccctcaagaaactttgaagtgctcaataccatattattaactatgggcacaatgttgtatagcagatctctaaaatttattcattgagcctatatccattgaacaattccccatttctccctcccctccagtccctggaactaacattacactctctgcttctatgagtttgactattacagatatgtcatataaatggaaccctgtagtatttgtcctgtgactggcttatttcccttagcgtaatgtcctccagtttcattcgtgttgcaaatgataggatttccttcttttaaaaaactaaataatagtcatgcttggatgaaactttgggttgtttccatatgttattgcgaacagtgctgcaataaacatgggggtgcagatatctctttgagttcctggtatcaattgtttagatatatgtccagaagtgggattgctggatcatatggtagttttatttttaatcttttgagtagccttcatactgtttttcatagctcatactacattcctaccaacagtatacagggggtccaatttctctacatccttactaatagttgttatcagtttttttggataataaccaccctgacaggtgtgaggtaatatctcatatctcattgtagttttttttttttttttttttttttttttttaggagatgggggtctcactatgttgtacaggctggagggcaatggctattcacaggcacaatcatagcatgctacagccctaaattcctgggctcaagtgattctcttgcctcagtctcccaagtggctaggagtacaggtgcataccatcacacctggttctcactgtaattttaatgtttatttccctgataattaacaatgttgatcatcttgtatataattgtaggccatttttgtgtgtttttggagaaatatctgttcacctcctttgcccatttcttaatcaggcttttttcttgttattgagttgtaggcattccttatatattttgggaattatccctaatgttgcaattaatttgagtgtttaaaacattccataggccaaataagacatacagacttctggtcagtgacctctttcacagctacatgtgggtgacgctatgtcactcaaataacgggacactcgtttactgggtgtccatggtgttgcagacatttcataagctacctcatgaagtcctcaaaacgaatccatgggttgaaataatcatgcccatcttacagataaaagtgaggcccagagaaactaaatggtttttccaagttcacacagcctacatgtggttagtgcaggtctgaattctgattggtttgaccagaaagagctgcagatttggggaagttttgttttctctcctctggggaaaaagagtcccactcagggttattccattactacagatggtcactgccccggggccagggccatgccacttttctccaaaggttagtcccaccggtatgtgatgcagttggtggactggctctcctttgattagcatgagcgacgagttagtaattgatcatccacctttctaaggttgccaagcttagatttactatattttgtaaaatcacccttccacgtccttaaagtccacgtgcatagtctatctagattctgatatttcatgtgtgaaattaatcctctcggactgtaatgaaaatgtggctgttagcctctaattaagatgtgtgtatattgattgcagtggtcaagtctgtccactgatatattaaaataaataagcatccattttatattggaaattttgtgacacttcttgagacaccttgagtttctctgagttgttacaaaaccagagcaaagagtcaaagctgtaatttctgcctatcactggcttttgaatagattatgaactcttagaggattgggtttgtatctatatagttctctttatacagagatgaaggctttcacagcagtatctataattgggtgtttaataaatgctttttgatgagggtaatggtatggaaataaagctcttgagatccagagtttgcttggatttcttgcctcattagggaggaaaaggtgaatggggatgcatgggtaaatacgaatgtcaatctcaggtaggaaaccatatgctcttctagcatgaaatgctgaaaagagagaaaccagaagggtgtgactaagacagaaattctgctgattgacactaataccggtatttaccaatcttctgtaacgaggtagactccatttagaatctggtgatgtatcgcatacaagttagattgcttgacaagtcacaccaaggtttactcaaagtcactgccattatggtatataatcacaggctcaccagtgtcccacaagggtgaaggcagaggttaatggttttctttttatttgcattattacttgatctctggctttcctggtgagatgggtttttataagctcttcccatctcactttttgaagtgtttttaagctattttaaggctgttttataggtgccttttcttatgtttgttttgtatgctagaaagtaagtaaagaggatccaggatatgagctattgatactaccaggcacactgaagtaagtattaagtcttttattgagctttctaaatggcaaagtatatttcttttttatttaaaatgttaaaaaaaaaagtggtcaattctaactaactgccctaaatgtatcaaaaggcccttagaagttttcttctttgccaccatggtgaatccttcaagcaaattgattttaagcttgtacaacaatgtgaatgcaatgacactaaagtgtacacttaaaatggtacattttatgtatgtatattttaccacaataaaaaaatagattttaagcaactaatcaactacgaggttgtcagactgattcatagagcatgagcaatattttgtattcagtactataatgtagagaatattactctgttatagtcaagtgtaaaaaatatcatattttattttccttatgttaaatttgggccaggcatggtggctcatgcttgtaattccagcactttgggaggccgaggagggcagatcacttgaggtcagaagtttgagaccaacctggccaacacggtgaaaccttgtctctactaaaaatacaaaaattatttggcatagtgacacatgcttgtaatcctagctacttggaaggctgaggcaggaggattgcttgaacccgggaggcagaggttacagtgagccaagatcgtgctactgcactccagcctgggcaacagagcgagaccccatctcaaaaacaaacaaacaaaaaattaaatttggctctgagttctcatctactggaaaggtgtgtgagaatcaattgtgttatatttaaggaaacccatttcttaggggtctttgaaaatctaaatgagacttacatgagatcaggaaaatgggagaggagagctgcattcttcccatggggaactttgtaatcatttttctctttgccacacaatggaactctgcgatttggcccttcaccgcctgttaggtttatatgcttggaagtcagggagaggctcctgtaattgacctctctattgaccacagacttggccagaggagcaccttctgctcttctccaggctgcagtgttgttttcacctccagagggacctgcagcaatccttttcacctttggcattgcttcaaaggggacatgggtctctattagtcacagaaactcagcaagatcttatctcacttcagaaagctcatatcctctgagtggactcttctacctgcttgaaccccagcatgcagccagcccagattctcagacaaacctttggatgaagaaagtgaaactctgagtgacaaataactttggcttgtctgccctaagaaacacaaattgttagtgctcttgaaagtaaaggttctgagactcagaacaggatggcctaagatcttttctatataggggaggaaaaaaatgtttttctgttttctgaatgtccaaggcagccagaacatgacaaaattttatatatatatatatatattttggcaatgcctagatgagtattagtaacatactagttgcaagggtagctttagagacagagaacttgggtttgaatcaggttgaagcaggttaagttccccatgcctcaattttccccatctgtaaaatagaaataacagtaatttttttatcatgaatttactataaaaataaattaaataaaaattaatatgtgtaaagtactttagtctggcatgtagaaagtacttaatgaggaagctataataataataataataacaattagttaacattaccaaactggttattcagagtttaatcctctggaactctatgcttagctctaatctcaaggagtccagggaagcagactaatcctcactattaaattttgtattgattctcggatgttttcaaagaatcctacatccacatatctcaaaggagtgctattgatttgatcattttatgaaattcttacccttttgctttcagaattctagctagatgacaaaaaggaaataactcacacatgtaaattaatcaaactattttggaactcaaacattgcttgtggaagacttgcagattgagccaagccctgttctttattaactctggataatttgctttctttgtttgatccctggcctttaagtgaatgtcaatctcttgcttttttcctgaagacctataaggcttgctgactaaatttcatggaaattctttgagattcttagctagaagaggctgtaaaggccaagtgctataggtactaacgtctcattgctaacactgatattttaccttgatagtaacttccaacttgacataaaagcttgtaagcaccagatctttgcctctccccatggttgtatgtgtttgaattctttggagaaaattttatgacttgcatggcttagggtttcataaattataaaaatgttttatctctggtttgaatagagtagtaaagcatatccctgatttctcacttcttccataacccagtgccttcttatttctaatgcctcctagtctgatgtcactgagaagatgtttatggccttgcttgccagagaactaaaaaagaaaacaacaacaacagcagcagcaacaacaacaacaacaaaaaacatctaacaacggagccaatgcttactcatgccagtcccaggattccatatatggggacattgggcgtgttttaagccatatgctcataacctttgtgtcatgattcagttggtgtgtcttgatcagtttcctcatctgtcatctcttggaaagcatgtaaagattaatcacagatatctgcttgtattacctagattaatgctagatgattagcagatgaaccttaacatctcagtggcttaacaaaaaaaggtgttaatctcccacttctatatgaagcccaggtgggagtaaggctgtactccacaaagtcattcagagaaccaggctgttgaaggctctgccatttctagtaaatgacctccaaggtggttctcagcacaaacatctattcacagatggagaaagagattttgcatatatatttttctaattttcatttttgcaaaatgtcataataagcaggtaagatggagcctcagttggagttgtggttagtcatggtgaaacaagagttaaaaggtaaaatcgacagatttcctatcagctatttatccatcattactaagaattacggagtgttaggcttagaaaaggtctaggaattgactcattttcctacttccaggagatctggttctagaacccaggacttccagctcccaggcaaattgaagcgcttcttcttccacatgggacccacttctatgagagcatcagtctgttagggttaagtccaagctctaccacttaagagctgaacaagttatattaactgcaaagggataattttagcaacttcctcattaggaggttgtattaaatgcacaatgcgtgacacacagagacttattgtcattattaatatcccaaattttttaaatggtcacaataattccccttgcaacttctgtcatatgaataagcccaggatcgcttgatggatgatgatgaaggattcatggccaagtcatccacaccacctcagccgactttgagtcagtcaccagacatgtaagtcatgtaagtaagaccatcctagagcatacagccccaggcaagccagcctagatcagaagaaccagccagcctactcacagaactgtgagaatgaccaatgtttgttactttaagccactaagtttggtggtggtttattatccaacaaaggctgatacagaaaggatcacaattgaggagtttatgtgagctcaatctgaaagtttatatgagctagatttgcccattatttcactaaattcatcacatggccccacctaactccaaaagagactggaaaatgtaaaaaacccagacagaaagggaagtaggctccaggacagctggccaatatctgccacactgatttaccttgattttgtaaaaacaaaacaaaatcaaaacccttaggtggcaatcagagtgtaacaactttccaggcaagttctttgggacaggccactagacagtcacttttagtttatttgtttctcacaggaagatagagaaaaggaaatgcgacagatgtgatgccttcctgagaggctgtctggtaaatcaattcctgccaaagttctcctacaaccctaagagataaaaaaggaacctgcaggcgaaaaccacaaggtaggaagagtttgaagctgtgatctcttagaataagagcttttcatttattctttctgagaaggaagtctagggcatctgtcattgagagtgctattgatataattttgctttctgccccgtaggatctgaagcagtcctgccccaggcttagagaagtaagggcaagctagcccaattctgtttgctccagcacatctcatcccagagcatttgttgtaaggccctcttctttttgatcccatgtctacatttggatctctggtctgggaggagaaatctcagaggctatgaatctgatgaggaaggcaacttggcagtgcagaaagcaccctgctttgcagtcagactttccagcttccaattctacctctgccagattaattagctctgtgtgatcttgcacaacttctctaagccttaattgtgagaattaatattgtatttattaggagtatggcacacgataggtacttattagatgttagctatcatcatcatcttcatcataatttgattttgcttttcttattccctttgatcttgcctcctagtctaacaggagaaacattagaagttggtggagacggcctagaaaaggaagggtagattagagagcaggagatagtgaaaaattacagttatttcacaattgaaatcctatcccatgtttgcattgttaattatagttttcgaaagactgtcatctaggcaatctcatttcgcatgaccattctatgagacacaggaacatgcagtctattttggcagataaaaaataaatacatgaggagttaagtaaaaactgtgttactgagactgcagtaacttttataaatcaatgtgcaaaaaaaattcaagtattttggaatgagatttgttggattgaaatattttatggtggtctgtaacatcagctcgtgagctcatagaccaaaccccatcccaaatacctggtgttcaggattatcaatataaaaattgatttaagatccccataattcatttactcctatttcctgacatgcagaaagcttactgccactgggttatttcatcagtttttccccatctctccataactagtctacctctgtatgcttggcttctataacattgcttactggtctttcttaaggcatgttgtgttctgggtcagttctctttaatctgtggccaaactcttgctcagatctaggaatgtgtcatctatgtgcatctttgttctaagctgaacatttcttagcactatacctgagtttctgctgccacctttcatattcttttatgatttgcaaagctagcaggaacccaaagtgactttcataaccaagtgtccagggtctccaggagttcaggttctctctagtaaacagttccaagaccgcaatgaaagagatgtcacagagttgtatatagtataacattaactaatatttgaatgataaattattgccataggaaactagagaaagaaaaagacactttgggatggagaggttagggaagattctgtggaagatgtgagatctgagctgtgttctatggggtagctaggtcgaggtaaaaaatgccatagccaagcgatcagaggcataaatatgcaaggagtcttgggtggaatcacaaagtttagcagatgagtacatgaaggtagaccctttgtgccaggaagtaattttgacagaatgttggagataattttgcctgtaatggtttctgactgacagtttattcattcattcaatcattgagttcaacaaattcaatttattaagaacatactatatttcagtaactcttctacatcccagagatacagcaatggacaggaaaggttctttccctcatgctgattacatcttaagtatggagacaaacaattaaaaacaagcagatacacacagtaatatcgtatagtcatagaactatgaaatgttaaagcaaggaaacacaatagtgactataagggtcaaacaccattgtagagaggaaaatcagggaggaccacttgggttgggtgatatttaagctgagatttgaatgaagaatggaagccattcttgtgaaagatctgggtgattggcattcctggcagagggaacagctaatgcaaagctctaaggtggtaacgagcttggtagagtcaaggagcagctgtcattgctctgtagtgcacttggaaaatatgctcaggtctggtcctactattggcacattaagccagaatctctgagatgaggtctaagccacagtgcttattaacacctctccaggtgattctaacagttagccaaggttgaaaaccgctgtattaaaggaaagccaaaagatgaagggcttttttaagcagacagagaacactcaccaggggaatcaatggaggagggaagtgaagaatgtaactgtgcaggaagagtatgctagggatagagggatgctcatcttcgacctggtaatcaatggaatccagactgacctattacaagagtggggtccctatgctctttacatagtctcccttgtcagtttcctgaaatttattgtgccaactatggtgggagttaaagcgttaaggtttggcttatttgttttgggcagatcacagagatccaggactcagagctagggaatagacagctgaccccaagctggaaaaactttcccagatactccctcctgcctaggaagtggcctatgaaaaagcagtttaaataatggcagcctaaaatatagttctatatgcaacatttttttttctatgaaaactaccttttgccttatacaacctgttaaaaagtgggagatttcactaataggagggcaggagttgagcacagatccaatagaggaaaaatactgtcttcaggcagataggggatgtgccactggggccgagatgacgagtttcgtgaaaaacagagttcaaaagaggaggctcttgagtgtaaagataatttgaggggaaaagaaaaagatagaatgtgactggaaggaacggaataggaaaagcagcatgatatagatggaaatctcctcatttctttgacgtccttaacaagaacatcaagtgaggcagaatagtcaagaacttggactctagaatccaaattggatgagcgccttaagcactttaatccacagtttcctcatctttcaaatggaaacaacagtgcctaggattcgttgctgtgaggactaatgacaaattgcatgtaaaaagcttggcacagtacctggcacttagtccaggccccactccatggtattcatcaccagtgtcaaaattgccataataattaacattgcctcaatcacaaaattcatgtcatgttcaccaacagccaatggcttccagataaaagtgagaaggccaatatagagctggggttaaacatgtcaagaattcaaagctatagtgcccctgggtattcaaaaagcgtaaagatttgactaaattcacagccaaatggcatttaccccaggtctaccccataccagtcactggcttctctctaatagttgttatcccttttaattctatagaatagaaaagaaggaattggggctaggctgagcagcagaggagagattggctgtggagagtatagatgacacatgaggccaggtgatctctgagaaaagtttctcccatctgttgcttagattgcccatcttggaactcaggaaatctgagatggctttaaagaaaatgatggcattgagaagtagtgagattgcagggggctttcaattttctgcttgggtgttggtggagagcaccgaggtcaacatccatgcttgcagtataaaattctaggtctgtgtccctgaaaagaatgttggtgtgagctaatgtgaaagatttggggagaatttgtgtaaaaagtaacaacaaacaccaaatgcctagttgagttctctgatgggtaaggtagaatatttgagagatttttttgagaatatttcccactgaaacttgggaaataactatagttaatgaattttgaagaaaagagttagcaaaagagaaagtaaatctgatcattaacattatatacaataaactgaactgggaaccaggagacctgtgtgctagactggattacattgagtaagcaatttgaattatctaggtctcagtttcttcagtctgaaaaagaagggcatgagattatattatgttgaatccatcttttgtttaaatttttgttaaattctatggagtacagagaagttgatggcttcaggcacaagtgagaaagtattttaatcttcttacatttttaggccatgtccaaatcatttgttttttcactttattttatttgaatataatttaggttttctttctcatggggtgaatgaaaataaacactttagaaatgtataaatcagtgtgcatttattggagtatggccaataactttagataatgaaaaggatgattgagctatttaatatgttgatttaagtaatgctgggtgatgagtggtagtgacaaggctcttctcttactaggatatcacatgaacaggttctgtcctaattctgcccttgcctagtacatatgggtgactagaatttggtgagagggggctgtctgctgagctaccccaactgtggttacagcacagttacagagatggatttttaagtacacttgttttccctgtcatttgtcatgaaacagactccctatgctcattatcaaaaagcccatatgctatcttcagttcacattttgctcacctctttctcttcattgcattagtcaagttcagaaactagactgtcagctgccagacaggctgctgtttctctcagagataggtgaaaaccatttaggaattcattatcaaagtgtacagcccaagaaggtgtttttgccttcaattcaattattccaaagaagcacacgataaagaaaagtactcaggacaattagatggactatctagacgtcaaaaatcaaatttttacctttgcaaatgcaggttcatattctgttcttaagtcatcagagggaaacatatgatgttcactgtcagtttagattgtcagaaaaagcttgttcaaaatctgtaaagttgtcactcctcatgtattttcactcaagaaaccagggatccaacttcctgtgcctaaactctctgcctagacaaatggatcttttgggaggttaagtatgtcttagaagaatatctgagctggagttgcaaatagaggaatcatcttttgttaagttgttagaacctagataacatagaagattactctatggggtttgaaaaaactaagacatgatgccctctcatgagacctttacagtctatttggggagttaaggcatatatgcccagaactttattttcagtggttcttggcaattttaaagttccggtagtatagtacaagtacccaaatgtgatgcccacaatgagggctgtggtaagtcagaaaagaggctgggttttggtttcttaggaaatggtaatttacatggagtctcacccacctggaaggattgcagtctttatgtttagcatcactttttgtcatttaaatttctctctaggtggggatctaatccagtccggagttacaggagctagaggtgatcagaaagtgtgcctaatttgacttttgctccatatgtgacataaaatagaaaaaaagtgaggtccccaaagaaaaggtagcttgagaaccaatgagagtgtctctccatgaactgtcaaaacctctgggatccagcagaaacagggtttgatttaagctgttcctgggtacaaaatgcgagctcttacttggcatttatccttgacacatatgggagcaggctttaccagaggcaagaattcaatcaaaagtcaggctttttgaatttaggtctttctcttttcttctgctataaaatggtgagatcatagcccatgccctaattggttcacagatggatacatcctgaggcaggtgggggtaatcctcaagttttcctacaccaaagcataccccagaacaaagaactactcgttctggaggtgaagataaggcctgtgatgggttgtcccatttgatcactgtggatttcctctctgtgatatcttctgctcccctggaatctagtattgaggaaaaataaccttaatcaggaactgtcactcttcttcaaagagtaggacagtcaactggcctctagcctataaagaaatattcctttcagatagactctagtatataatatcattctgctattcatcaggaagtggctgaataatttattatacaacttgtctatagatcagagtagatgaataataaaatctttagtatgtaaaaaccttacaagaaagttgagacttatggtagcaaaggatccagaaggattgggtcattttgtagttattagtaaacatatgtctgtgataaagaccactttggcaaaccgaggtatctctctacccatcatcctgcttcaggagaacttgggctctgataagtatgtacgtaatgatcaaatcccccacatttaccaacctgctccagtcatcattgtggtagatgtgtgcacgagaaaaatgctcattttattccattccatggatacttacattctctgcgtgtttatttaggaagcattttattgaaatgattcctcattatgtgtaacttaataccatttattcattaatttatttactcagtacacattaattgagtacatacaatgtgcctggtgctgggaaagcaaaagaaaaaaccaccatacttatcctcaaagtcatctcagtctatttgtagaggtgaataataaatgactgtaatacatggtgaggaagaccaccattaagtcagaaattgctaaaggagttagcaactaactgtctaagatgattgggagcattcacagagaaggttatatttgttgaggaccttgaaggagtaggagttgcctaggtaaatcaaggaaataaagggaataaatatcaaaggacccacatgtatgaagacacagaagacatagctttagagaagtttagagatgtttgtagagcatgctggaacacaagaaatgcttttggaaagactctgtaaaatatttataccctaatactaggtatgcaacagtgaacatttaaagtttattgaattaagtcaaccaaagaagacccaagttgtgggattcaagaatagcaaggctctttcaaatgcctctgaaacagttgggggtggacctctccatggtgctgaaacatcccctgttcaagccttcctatctatctggattattggctcctttccatgttcctaaccctcattctgcatgcagtaattacttgattgaccatttcactcactggccctgccaggaccttgccttggatactacctgtccaatggtgagcttattattctttcctttaacctgcacagaccctggatgggcatttgatcaactgaaataattaatgggtagaaacagatattgtcagtgaagtcctttaacttctttctgcttgcttttctcccagatattttagcatttaattaatctggatgcaatttattagttgcttgggttggaatttctttagccttttagcccagatcacatatacttattacgtatttattggaattttcaggaaactgtagttcaaggtgaaactttgaagatagactcaaacaatgggcatgtctcacaatgatacagaggactcagataaagttggtggaatagagtggaaagaatactggatttgaaattaaaagttcaaatcagggtttcaccacttagaagctgggtaaagtcatttagtttattttgaagcctcagtatccttatttgtaaaatgtagacaggttattccctgtatactcacaaacttgtgctaagactcaaatattctcatgtttgtgaaattagtttgaaagtgatgcagttgggaacgattactggataggttggaaggttgtccaactggtgcccctcatgatgggaagagacagaacactgcgaattagcacagtgaaagttaggagctgtgaagaccctagggggcagaggaggtacaggcattaatattatggtgctgagaagttaatatctttctttttaaaaaatagctcggcatagaagctgtcagtagggctttctccccggtcagatttatgacttctgaatgacattgttttactttgccatttggaggataaacaaagctggagagaacaaaagttttattttcctatcagtgacaaatacatagcaatcaatgtaattgaagttcaagtggaataatttatgggggatccattgcatgctcctttgtgtactctgtctgtctgtctctctctcttcctctatccccactctaattcctttcaccgtcatttatttctgcctctttctggtattcagtcctgtatatattaaaagcataagccaattagaaaataattgctgttactctgcttggcccatctttcttgatgtttaggttagtttggcattttattctctccaaagaatgtatttattcaaaaaagacatctaccacatttaatgcgggccatttagatattaatcatcaaaggtaaacgatgaagaaaaattttagtctttaattcttttcttaaaagtcacatatacagagagctaattgacccatgctatgcagaagtgctctgcctgaagcccagggttaatttttacaatggccacttagccaattgaggatggttaagtgagcaatattttatagactcttgtattaattattttgggggatggatataagtttgtggatggggaaaacactctcagattattctaggggagatgaatgatatatctttacaaaaacatataaaaaccttaatttcagtgaatggtttataatgtaaaataccacaatgatatataactggataagagggcttctctgtgagtagagcttatctgtatatcctgatgaaatttaaaaaaaaccccatggaatatatgtttttgggggttaacaaaaggaaacttgggaaccaagaaaaaggaaggatgtaaattaacttattgttgtcctttattgtttgaaaaattcttatcataaaggatggtagcccactgatttttaatttcactgataagtgagcaggaaggaataggtaagagatgaagatgaatgatttaggtcatacttcaataaaatatttttactgtttatttcctgtatcacaggtttttcaaagtagagcatttcttatctggctggtatgatttaggcattattttatcactagaaaagccataacgatgaagggatggtatgttcaaagcagaggattaatatttactacatatctactatgagtaagttactatgcttttttacatatacttttttacatatcatttaatcaacagtcttgtgaattaggctattctgacagatgagaaaactgaaaatcaaagacactaagtagcttggtaagtgttacataaccatgatatgtcagagccattaaatcgaggtgtgcctaactctaaattccatactctttatattacactatgatgtctaataaataatttggttgaaagagtcatttttattcaagataggagagtagactcattgatttctgttagtcttttctatgaatctgttatcggaaatagttgactacaattaaaataattcctggcactataacactactagacatcttcatgtcatgtagccaacatctttttttcctttgcaccatataatctgttttctctatgggtaaaaatcacattttaatgatggggtggaacttcctttattccaaaactcatttgtagtcggggttgggcacatatctaggtctgataaatcagaatagcctattcttctgtccacagctatttatttttaatgttttcaagctgattttacctttctgctagagtcatcagggaagatactctctttccactggggttgttaaacaagtagaatgcaaggctagactactagcaggcatccttctcattaattagcgagagaagagcttgtctgaactatggagggaaaaatagagaatcaatatctaacggtattctttaagaccctgaatccagccacacttgaaccatttttctaaaggaatgtgaattcatagtgtttttcttttatcttgggtctatgttatttgattttaaaatatattaaaatctagcaatgttattttatatgtggctgatacattatatatccatagtcaaggagatagcactaatcacataccatgacaatagacacaagtctgatctaaactctgtatagatattggcactgcccttgttttccagattatctctggagtgctctgagggatcagttggttggccaacaaataccatttgtgcctcaggctctttgtaaaacctaggggaatgtctgaatttcccttgattgagacatctcccttccctgtcaagtcctgaaggagctgtaaactcaaggaataatgccaaaggagaaattagtgtctgccttattatcaattgtacttttgttcataactcgcaataatttggttgctgcatagggcttagcctcaaatctaagcagactttctctgcctcataaatcaaatcttaactctaggcagtggtaaaaccacagtgcccagtaatggttagtaaagaatacaagagagtgtaggccgggtgcggtggctcacgcctgtaatcccagcactttgggaggccaaggcgggcggatcacggggtcaggagattgagaccatcctggctaacacggtgaaaccccgtctctactacaaatacaaaaaaaaaaaaaaaaaaaaaaaattagctgggcgttgtggcaggtgcctatagtcccagctacttgggaggctgaggcaggagaatggtatgaacccaggaggcggagcttgcagtgagctgagatcgcgtcactgcactccagcctgggtgacagagcaagactctgtctcaaaaaaaaaaaaaaaaaaaaaaaaaaaaagaatacaagagagtgtgacccatagttcagactactcaagtctatgtgggtctgcttcctgaacagctggtaaacagtggagaaagccatactcaaatgaatttcctttcaatttcagtgcgtcctttcactacaaaacagcccaatcaatgtcctgggttctgttcactcagactgagaaaaagaagtaaatcatccatagattttggcattttgttattatcacaaagtatgctagacatacacctcataagtgattttgacaaaaagatgtgctgcaagcacagtgcttgaggggtggtcacgattatggatatcactgtactaatctcagaaatcttagtgtatgtttttttttgtctttactggatagtttcgtatttctacctgcatgtggagttctgtcagggccacattcttccgggatatataaacgtggagaaaagtccttacactgtggtacagtgatccgctggaggaaagtgctatatctgtgcattttgcaagaagtcattctatagcatgtgtatgtctattaacacaatcactgaaccagagccaaggttccaaagggactatctgagatcatctttctaacccagtgattctcgagctcaggtgcatggcagaatgcctggagggtttattaaaaacactgattcctaagctccacctaagaccgattgaatcaggttcttttagtgtagggtgcaggaatttttttttataacaacttccccaggcgatttttctgccagtctatagaatggcctttggggatctctttatcttttaccttcaagttaaaacacatcactctgaaacttcatgagccagatacgaatctaacctatattcaaagaggtttagaaaaagataccttcaacctctctcagcacaatttttttttctattaagctcccttttcaaaatacttgaactccacctggacctaggcaaaatgttttaaaatggcatcagagtgaatcaaatcacattaacctgagatggtgggcaaggatcatgaaaaaggacagagggaagcctgaatgtgagtttgcctgaagaggaaatgatgattccaataagtgccttttctttccgtttgcattctgtgcgtagctaatccgctcggcataatcctcttaacggcatgtgttccatcagtattttatctgatctacttctctgacaatcctatgtttgctagtttccttgtatttttgagaagctctagatgttacatggaaaattcaaccttgtttctctgttttcatacaaagtggggttcttggaattcttagaaaatggggaggaccctttgcacaggctgaagttgtgtgagaagtctggacagagtttccagctttcaaaatttagtaggggaaaactaaatagaggctttctcccttgtctcaaaactggattttaatttgcacactgctggtatgggtcaggggactgttgtgctgaatcagaggatgtaggatacagggaatcatgaaaataagcattggcccccatgcctaggtgatgagaacatttgtcagtagatgttaaggttcctttataagcttgactattgcttttatttgcataaccaaggaaattagaataagattggggcatccttcatttaccatagataaagacagggattctcttactgtagacccagccctatctgtgcactgcctcctatggggaataatctgagggctaaaatgcatgaccacttgccatggtactaaagtccctcagctggacttcatgccataatcacttcatcccattgggaattcagatccctctaaattaaaatacccctgagatgggtgtaaccttaatccctttatcagcttactctgtaattatcaattaatactttaggagagattaactggcaaaaaatggaaatcaagatggcatttctcctggttttgctcctcctcgttttgttctcctggttttgctcctcattagcagtgtgaccttaattttttaatttctctaggtcctgggttcttcatgtatgcagtgaaggaactaggtgatagaatctttgacctctcttctggttctgttttagtgacagaattcactaaattcacatttctggattcctgactgaaaggggattcataagagccttgcttacttcatggctttcctcattgtgtccatggaactcaggccacatgattgtgggtctagtgaaacaaagagagtgtggccagagaatgaaagccataggaaacctagatagccgcataattacttagttgaaagccttgaacagctgaattccagagatgagtttgcaaaagaggagtatcatatgggatgtcacacttcaacagcagaaaaataggctgatacgatcagaaaggatgccaggccattgtggacatctgccgtgcagaatgacatcaagtggctgtctgaacatagtctgaaatctctctctcttgactttgaagagacccctgggcctcaaacttcaaatctgcaaagatagcactatagccagcaggcctggctttctcatgtcaacatgatgcaaacgtttctgtggatacgggatttggagtcaggaaaactatattccagtgtgacatctagccaaaaacaaagaaaactaacaatgttattgttaactttgagctttcctctactttaagcactgggctaaatgtttcatgtactttctttcattcaaatggtgaccttaggttcttctgtgagtcttcatttctttttcagtaaaaatggagcatatctgctttatctgataatagtaactaacaattaactgaatgcttacttgtgcaccgtgcactagggtaagcactttcgtgcattattatctttgtacaataatcctaagaggtaggtagggatgatgactatttatagacaggaaagctgagttggactaagtgaaataaacagcgatgaataaagtctgtggaagaaaggggattcatattttctatgcttcctgatatccaagtcacccagaaatacaccaaagaagctttcagttttcacacctggctgtatgaatttattccatctcagtgagggccaaatggaagactatttgtacagggctgtgtggattaagggagtgaagtggcaatgagaaacagaattcaagtaatctagagctggatagaaactacttatttaagagagcacttggattccagagtttgagtaaaggctttattgactaacttcctaaagtcaccaagaatatcaataaactaaatttacccctttatttatccttacacctttgtattagtccattctcacactgctacaaataaatacctgagactgagtaatttataaagaaaggaggtttaattggctcatggtactgcaggctgtacaggaagcacagcagcatcttctctgcttctggggaggccttaagaaacttgtaatcatggcagaacgaaagggggaagcaggcacatcttacatggctggagcaggaggaagagatgaagtgggaaggtgatacacacttttaaacaaccagatcttgtaagagctcacttgctacacagtaccaaggaggatggtgttaaaccattcatgagaactccactcccatgatccaaccacctcccaccaggacccacctccagcactggggattacaattgagcttgagatttgggtggggacacagatccaaaccatgtcagccttcttttctgtgttatttttatgtccagccttactgaactttctaagctccaattttttatgatctgaaaaatggggctagtaatagctttaactggctagtggtggtgagtgggaggcaaataggagaattaaataatatagcagacattaaaatattttgtcaatgataaactaatatggatagctattaggcctaatagtgactgtgttgattgctgatttattatttgtcactgatgacaggacaatatctctcttattgagaagaaatgccttccttattttcttcttaaaaagattatcatttgcttattttcttcctcctctgtgaagtaaaactttatcaagaagaattaaacatttaaaaaagatgtgcagtaattggtagggaaggataacgagaagaaaagcagacaactgtctgctgcttagcatatccatgagtgtgttaatttaattagaactgccctgtataaatattaaactcaattcacttttgttatgatcctttgcttttcaaagtattcccagttacagattatctttttcaaattcttctgtgagtttgagggagttaatggaagtaaaacaacccaaattggaatgaactgagagaggttttcatcttatcacactttgcttctttctgttattttcctttgcctagttcctggcccagcggcaaaggaggtgattgattttcagtggttttgcctttcaagatgttggcaatgcaacaacttcccttcagtggaattcccattttgtgtagtattttggggtggaggattgaattgctttacatctccacactcctgattaaatgtgaacccccacctgacgtttccaggtcagtagccaggatgtgggatgtagtgcgggatggttgttttatttgattttccccacaactgtgtgagggcaggatatcattgtccccattttacagttaagagtagagtcagtaaatcacagagccaagcatgtataatttctaacagaaattatgggtttagtacctagattgagattttgatagattcaggataaaggtagtgaaaaaattgcccatggaattggtttgaactgaattcatgagaattatagacttccataggcagaagggatcacttttagagtcttttttcagaatgaggtgagtgaggcagagtcgtgcaagtacagatttggggtcctatctttatttaaatttttgatactttgtttagcatggatatttccattcatttttgtgttttaaatgttgcattaaaaattctgtatctagattaccaattcttttggtacccccttaaattttctgcctgatgcaagtgaggcacttccctcaccctattcccagccctgtatagcaggcacaatgctaggttgtttaccagtcatagccccttatttttcacatgaagaaactggggcctaagatcacaaagccagcaccaataacacatggctcttgactcacagtatcgttctcttcttgctagtggagctaaaataataggagagacaaacgtcaggagattgtaacctcataatagagcctgactaaatgtgccagggaaaaaagtgtagcgtccttaaactgtacaagtcagtttagcaccaaatctttcactcacccagcaagtagaaatagctgcaagttgcagcaggtggaatttagattcggttcaaagaagaattacttgacaatgtgggaagtgaggtgctacattgtttcctagataatggcataaaataagagtgggaaattcaaatcccctgagttgggtgtaaatggtggcaactgtgacaaactggagagagagatcatagtagaaactaagttctatacttaacttgattactagagaagcaatgtcttttctttctttctgggtctcggacacccttttgatttcaggtcaaaatcattttcttgaagtaacgtgaaccccaatatggcatcatcctcttctacctatccatagaacctccttgattctacttctttgttttgtctttgcagctttagtcaacagaggctgttcccacagttcctcatccttccctcagttatctatttctgtagctctgggtcctgaattacagcattttctaaccctttgatttggctctcttctgctctgaaaagcattggctctttcacagttactgtacagtatccccactgtggcattttctgactcccatgctgggccatctcatcccccatcaacaaatcaccttgctaccacatggccttttggtaactgacttttatgtagaataacatacatgtagaatgtgtgagagaacaatgcaggcaggagcctggctttgctctgcactgaatatttagcactagcatagttctctgctgtacaaataggaagtcaataatacttgttgaattaataaatatttatacagtgcaatttaattaattccaagtttggcatcttctaaaattcacataggaattttcaatgtggccaaaagccccacatttcatagcaaaatcatgacttggctaatcagagagataaaagaaagaaagaaagaaaaagctctgccctttgcatgtggcctgataaacaattatgccctccagacaccagggctgtgaattccgcctttttaaacaggcccagagtcagcttatttggagattttcagcaccgtggacagaggcaccaggttactttttatctgtcactccctgaacagcaggatgaagaactactcagtttgggacagggctctcagccactgtggtgaaaatcaccccctttagcagaaggaaatttacttagaccctttttatttcccctttcccttggaaaaattgcattttcagttgtcaaggcacttaggcttctacaagttatttttcaggtgcctggaggatggaaaagggttgccctggaaattgatatcttcttctgagtttggcttaacaggggaaccaccagtgcccttgcggatggctgaggtgtcttttatgctaggtatggctctcttccagataaccaagtgtagacaggagtaggcccagttgttcatggagcattggttttaggacttgacctaaaagctgggtcatactattgccagggcaagaattacaaaagcaggtaaactctgccaagatttttctagtggaacatacacattcatggggatgaatccttcccaaactttcaggttttactgtatttggctgtaaaattcaaaagccagattgactaattctcagtgcctgttaaattcttttaggagcaaagtgatacattgtccccacccctgcctttcctaagaactcattttttcccctactcattagctgtattcaaatgcagagctttgctgatgaacagcaaagtggcttcttgactattgggtctctcactttgtcttctcctggactctgtaagtagccctactttcatttattttctaatctttgatgcctttccttcattttcttgaagcacctttacttttcatagtctgtctctttctttttgccccttttatggccattacacacaaatctgagctggccctcttctcatggcaatagacatcctgggctactttcatgaggaagcttaggacaggagctgatggagattagccaaaatgtcagagttagcctaccctttgacctgggcctggaggtgaggttttcttcttacacttactttggaatgagaaatgagagagtgaagttttcttcctacacttacttcatgtcaatcttctcagtgtctaattgctatgatcagaaattcagagttatcccaggctgggtatttgcataccacaatgagaattgctacaactaatgttgcttgatggaagggcaggagctgaaattttacctgagccaccaattttctcaaaaccttggcctgagagagaattcaagttttacccagaagtatctacattttgttttttacaaaagggctcatgatagagctcagttaccttctgctatccatctgtgccaatctgaactgaatcagagtatcatttccttttttttgcatgtgctggtgtctcctgtgttggccttttagagtctgacacggtatttgggaccctccatgagattggaaggagttccattaagtgatagataaagatgtagccagtagaggccaaaggtactcaaatactttttatttaaccttcttactttttgtccttagggaaactgtagacactttgagactgtttattttatgcttcttttctaggaggtaaagcttttgggggaaggttttatgctttcagaattttcagttaacatttctgctttgtgatggtctcccaatcccatctccttcaatgacagctccaaaatatcaccagttttttatttttcttattcaaccctaagttttattggagaaccttattcctgcttcatggagaaaactggctaggcgtggtggctcatgcctgtaatcccagcactttgagaggccgaggtaggtggatcacctgaggttggaagttcaagactagcctgaccaacatggagaaaccccatctttactaaaaatacaaaaaaaaaaaaaaaatagccaagtgcgcgcgtggtggcacatgcctgtaatcccagctactcgggaggctgaggcaggagaatcacttgaacccaggaggcggaagttctggtgagccaagatcgcgccattgcactccagcctgggcaataagagcgaaactccatctcaaaagaaaaaaaaaaagaaaagaaaagaaaagaaaaagaaaattgatgatattttgtgtgtgtgtgtgtgtgtgtgtgtgtgtgtgtgtgtgtgtgttttagttctccagcccccttagaaagattctttcttccacaccaattctcatttccttttcttcaggtttagagatgacttctctcattcaagaccagttccttctctcctatctttcaggagatttctctataattcattctctctctccacactcaccccaccccactacatgatcttcaacctctccctctctcttctctacttgtcttcattctgtcagcttagaatcatctttcctgtgttcccacctagcaaatatcctttctttgacgccacatctctttagctcccatctttgtttatcttcgctttcttcttcttttttttttccttcgtatccaaatcatcattcattacacaactcattgaaatctgaattatctttcttttcatccaatgaatcatgcctaggtcaatgatttatttttccaccaaacttgctattcttcgagtatttaccatttctgcatgtgacaccactatctatctcagctagctgtctcagaaacgtcacatcttccacacccatcaagctctaattactttcttcctcaacagctctcaatttcctgtcctctctatttctgctaccactgcctatattctgagctttgttgtttcttactatgccactacatcagtctcccaactgatatctctctctctctccctccagccttttttttttttttttttgagatggagtcttgctctgtcgcccagggtggagtgcagtggtgcgatcttggctcactgcaacttctgcctccaggtgattctcctgcctcagcctcccaagtagctgggactacagccaccacgcccggctaatttttgtatttttagtagagacagggtttcgccacattggtcaggctggtctcaaactcctgacctcaggtgatccgcccgcctcagcctcccaacctccagctctcttctagttgtttatcctcctgtatcactagtgtacaccctcactcatattcactgtgtaaaatgcaaagctgacctgattaaaatctgtgttaccttcctatttcctgtggggtaatagtccaatcttctgtataaggctgtccacgatccatctcctgccatttttcctgctttttgttccaaccatcatttaccttgctgttcaccctccacaacacccacagttgctagtggttccctgtatttgatacgctgtttctcatgtttgcggtttgtgggagccttcccctttgccaatattggcatttgcctattttcttagttaactcgtggtcatctgttgaaaatcagctcgatatcatctctccaggaagccctccccgcatttctgcactcactttctccatccgttaccaaggttgaagcaccttcctttctgttggtataaagtaccatgcatatggccactatggccattgcactcatggtactgagttacctgtttttgtattttttttcctcaatgtgcctccatactcagtacatcatttttttctatagtactgggcaaggttcttgacacacatgagctgcttaattaagtttaatgtatttatgacaaatttagagcaggtttgaagaaattcaggcttttccccattaagtaatggtgcaccccattaagtaatggtgcactttgggagaaatgggctgaaaaagttttaacgatagcttttgcagcctatttgccccaattgtgtaaatactaatttaaaaccaaatgacttctagaaagtctgtagtcagtcttcaccattgggagataatgaggcaacatggattttgctgcctctctcttaaataacatgaatctactgtggagacttttaagcctatgatgatattttatatcaaaactgagataaataaaaaatgttcactgacaataatgactatagataaatgctgtcagttgtaaggaagtgtcaatcacagacagacgtcagtggatctgtgagggccacactgaatttttgcatgtgtaaactgtataaaataagattttaaagaatgtcataatcatattcagaaagtggaatgagtgtgcatctgaatggctgcccaatctataacgaatattctatctacagggcaataagcagaaaaggtgatgcagagcagccagccagatactatcatcctcatttctttaacatgtatttctagatccttttttgctcagaacattgttatggcattcctcagaacgcttttagtctctctctttctcttttatacttaaaattctaaaccagattctggtgtagagttctgagattatcactgtgccacagtgccattcaacattcctgggattacatttttctttacaaaaggtagcactttggtattcccctaggaccctcagattctccttttttcttttcattgctgcttaccagaaacaggtgctcctcaacctgtatttgtgcagtattttttgcaataggcaattatatgtacttttagtgataatagttgtttgtacattaacaatagtttcacttttaaaattggtgtattttccccttccgcatatgtgtatgtacacaaaggaatacaaacaaggacagacctgattgttcctttgttataagtaaagaccatctaattataataaagcacaattaataattgtgtgtaatgagcaaattagagcaataatacaagaaaatgagaggcaattccttgaaatgtttctgtcttatcttttaattgaaaaaaaaaaaaaagccttccatttccctcaggtagagtgaaactgacaactgagctgccctgcttctgccaaatatgaagatatctaagactctgcttctctgtttactgggcaaagtcctggagggagagtggggaggggaaaggaagaagtctgttgaacttggggcttagtttcactctggattatgtggcaaattgattttgataacaggcacctccccattcatacctatgttattcttaggattatgcagtaaaatagtttaatagtaaaaggatagaactttggtgttagaaagacctaatttctggtcctgactttgccactttactaatttgtggttttaagaagctacttaagtattccaagatgtagttataggtcacatggtttttgtgacacttaattggatagtgcttacttcaaggcctagcatgtagccagggctccatcaatattctctatgagagaaagaggaggaggaaaagactaaaaagtccgaaggatgatatgatgtagttgaaagaggatgcacttagacacttaaatcctgtattcgtttcttactgtctgtattgtgttgggtaaagcaacttgaactttcaaactcaccattttccaaatctattaaaaaatggataatcatgcttaatatagaacagttctgagaattaggtaagaaaatgtctatgtaagtgcctagtgccacatcttgccattagtaagaaccaagaaatgctatttgtggtgggatgccattgatgttgggtagagcttagctatgatttatgatactcccaagagactttttttttaatcgtgtgaagccatgtgttctattctgctcaacgttctcatcagactcatgattcctaattcttaaagcaaaaaatggggtctgagagtgtttcgtggcatgacagttgtggtcagaacccctcccatattcccttattctcaccaagtcaatgcaacttcgatcaggcatgcatttttctgcctgggggcttgctctttgctaatggatctgctttgtatcctgtgctatagaccagaagtgcagagaaattaatgtcctctttcctcagtgttcatcaaacaatggctggtgttgttttctactggctcctagaccttcctcagtgagctaaaattccattttccctagatagtagctggctcttgccccgtctgtaggtcacatccccgcatcacgttcctaataatctacctgcacttcactcttggtctgaaggtttgcttctgaggaaacccaaactaaggcatggggctactctagtaagccagcccagtgatgtttatggtgaattatcataagtagatctcgataccaggatttgtattatattgtacagaactggttataatagaactagctctagctggtctgaggcttaatatgtagattgaaataaacatgcctgagacctacagattatttttcttttttttttttattatactttaagttctagggtacatgtgcacaacgtgcagatttgatacataggtatacatgtgccatgttggtttgctgcacccatcaactcatcatttacattaggtatttctcttaatgctatccctcccccagccccccacccatgacaggccccagtgtgtgatgttccccggcctgtgtccaagtgaactcaatgttccattctcacctatgagtgagaacatgcagtgtttggttttctgtccttgtgacagtttgctgagaatgatggtttccagcttcatccatgttcctgcaaaggacatgaactcatccttttttatggctgcatagtattccatggtgtatatgtgccacattttcttaatccagtctatcattgatggacatttgggttggttccaagtctttgctattgtgagtagtaccaccataaacatacatgtgcatatgtctttatagtagcatgatttataatcctttgggtatatacccagttatgggattgctgggtccaatcataattctagttctagatccttgaggaattgccacactgtcttccacaatggttgaactaatttacactcccaccaacagtgtaaaagcattcctatttctccacatcctctccagcatcttttgtttcctgactttttaatgattgccattctaactggtgtgagatgctatctcattgtggttttgatttgcatttctctgatgactggtgatgatgagcatttttacatgtgtctattaattggctgcatagatgtcttcttttgagaagtgtctgttcatatctttgcccactttttggtggggttgtttgatttttcttgtgaatttgtttgagttctttgtagattctggatattaaccctttgtcagatgggtaggttgcaaaaattttctcccattctgtaggttgcttgttcactctgatagtagtttcttttgccatgcagaaactgtttggtttaattagatcccatttgcctattttggcttttgttgccattgctttttgtgttttagtcatgaagtccttgcccatgcctatgtactgaatggtattgcctagattttcttctagggtttttatggttttggatctaacatttaagtctttaatccatcttgaattaatttttgtataaggtataaggaagggatccagtttcagctttctacatatggctagccagttttcccagcaccatttattaaatagggaatcctttccccatttcttgtttttgtcaggtttgtcaaagatcagatggttgtagatgtgtagtgttatttctgaggcctctgttctgtttcattggtctgtatatctgttttggtaacagtaccatgctgttttggttactatagccttgtactatagtttgaagtcaggtagcatgatgcttccagctttgttctttttgcttaggattgacttggcaatgcgggctcttttttggttccatatgaactttaaagtagtttttttccaattctgtgaagaaagggtcattggtagcttaatggggatggcattgaatctataaattactttgggcagtatggccattttcacgatattgattcttcctatccatgagcatggaatgtacttccatttgtttgtatcctcttttatttcattgagcagtggtttgtagttctccttgaagaggtacttcacatcccttgtaagttggattcctaggtactttattctctttgtagcaattgtgaatgggagttcactcatgatttggctctcagtttgtctgttaatggtgtataggaatgcttgtgatttttgcacattgattttgtatcctgagactttgctgaagttgcttatcagcttaaggagattttgggctgagacgatggggttttctaaatatgcaatcatgtcatctgcaaatggagacaatttgacttcctcattgtgtaattgaatacagtttatttctttctcctgcctgattgccctggccagaacttccaacactatgttgaatgggagtggtgagagagggcatccctgtcttgtgccagttttcaaagggaatgcttccagtttttgcccattcagtatgatattggctgtgggtttgtcataaatagctcttattattttgagataagttccatcaatacctagtttattgagagtttttagcatgaaaggctgttgaattttgtggaaggccttttctgcatctattgagataatcatgtggtttttattgttggtgctgtttatgtgatggattacgtttattgatttgtgtatcttgaaccagtcttgcatcccagggatgaagctgacttgatcatggtggataagctttttgatgtgctgctggattcagttcgaaagtattttattgaggatttttgcattgatgttcatcagggatattggtctgaaattctgtttttttgttgtgtctctgccaggctttggtatcacgattatgttggcctcataaaatgagttagggagggttccctctttttctattgattggaatagttttagaaggaatgctagcagctcctctttgtacctctggtagaatttggcagtgaatccatctggtcctggactttttttggttggtaggttattaattattgcctcaatttcagagcctgttattggtctattcagagattcaccttcttcctggtttagtcttgggagggtatatgtgtccaggaatttatccatttcttctagattttctagttcatttgcatagaggtgtttatagtattctctgatggtagtttgtatttctgtgggatcaatggtgatatccccttttttttattgcatctatttgattcttctctcttttcttctttattagtcttgctagtgatctatcaattttgttgatcttttcaaaaaaccagcccctggattcattaattttttgaagggttttttgtgtctctttctctttcagttcttccctgatcttacttatctcttgccttctgctaacttttgaatttgtttgctcttgtttctgtcgttcttttaattgtaatgttagggtgtcgattatagatccttcctgctttctcttgtgggcatttagtgtaaatttccctgtacacactgttttaaatgtgtcccagagattctggtatgttgtgtctttgttatcattggtttcaaagaacatctttatttctgccttcattttgttatttacccagtagtcattcaggagcaagttgttcagtttccatgtagttgagtggttttgagtgagtttcttaatcctgagttctaatttgattgcactgtggtctcagagacagtttgttgtgatttctgttcttttacatttgctgaggagtgctttactcccaattatgtggtcaattttggaataagcgcgatgtggtgctgagaagaatgtatattctgttgatgtggggtggagagttctgtagatgtctattagttctgcttgttgcagagctgagttcaagtcctggatatccttgttaatcttctgtcttattgatttgtctaatattggcagtggggttttaaagtctcccattattattgtgtgggagtctaagtctctttgtaggtctcgaaggacttgccttatgaatctgggtgctcctgcattgggtgcatatatatttaggatagttagctcttcttgttgaattgatccctttaccattatataatggccttctttttctcttttgatctttgttggtttaaagtctgttttatcagagactaggattgcaacccctgctttttttttttttttttgctttccatttgcttggtagatcttcctccattcctctattttgagcctatatgcatctttgcacatgagatgggtctcctgaatacagcacactgatggatcttgactctttatccaatttgccagtctgtgtcttttaattgggggcatttagcccatttacatttaagggtaatattgttatgtgtgaatttgattctgtcattatgatattcactggttattttgcccattaattgatgcagtttcttcataccatcaatggtctttacaatttggcatgtttttgcagtggctggtaccagttgtctctttccatgtttagtgcttccttcaggagctcttgtaagacaggtctggtggtgacaaaatctctcagtgtttggttgtctgtaaaggattttatttctccttcacttatgaagcttagtttggctggatatgaaattctgggttgaaaattcttttattttagaatgttgaatattggcctccactctcttctggcttgtaatgtttctgctgagagatctgctgttactctcatgggcttccctttgtgggtaactcggcttttctctctggctacccttaacacttttcccttcatttcaaccttggtgaatctgacaattatgtgtctggggttgctcttcttgaggagtatctttgtgatgttgtctatatttcctgaatttgaatgttggcctgccttgctaggttggggaagttctggataatatcctgaagagtgttttccaacatggttccattctccccatcactttcagggaaaccaatcagacgtagatttggtcttttcacatactcccatatttctttgaggctttgttcatttctttttactcttttttccctaaccttgtcttcttgctttatttcattaatttgatcttcaatcactgataccctttcttccacttgattgaatcagctattgaaacttgtgtatgcatcatgaagttctcgtgccatgattttcagctccatcaggtcatttaaggtcttctctcactgtttgttctagttagccattcatgtaatattttttcaaggttcttagcttccttgcgatgggttctaacatcctcctttagcttggagacgtttgttattaccgaccttctgaagcctacttctgtcaactcgtcaaagtcattctccatccagctttgttccgttgttggtgaggagctgtgatcctttggaggagaagaggcactctgatttttagaattttcagctttcctgctctggtttctccccacctttgtgctttcatcccacctttggtctttgatgttggtgacctacagatggggttttggtgtagatgacctttctgttgatgttgatgctattcttttctgtttgttagttttccttctaacagtctggtccctcagctgcaggtctattggagtttgctggaggtccactcaagaccatgtttgcctgggtatcaccagcagaggctgcagaacagcaaatattgcagaacagcaaatattgcagaacagcaaatactgcaggaaagcaaatattgctgcctgattcttcctctggaagcttcgttccagaggggcagctgcctatatgaggtgtctgtcatcccctactgggaggtgtctcccagttaggctacacgggggtcagggaccaacttgaggaggcagtctgtccattctcagagcccaaacactgtgctgagagaaccactgctctcttcagagctgtcagacagggacgtttaagtctgcacaagttgtctgctgccttttcttcagctgtgccctgcccatagctgatgtggagtgtagaggtggagtctagaggcagtaggccttcttgagctgtggtgggctctgcccagtttgagcttccaggccactttgtttacctactcaagcctcagcaatggcagatgcccctcccccagccaggctgccaccttgcagttcaatctcagactgttgcgctagcagtgagcaaggctctgtgggtgtgtgacccatcgagccaggcacaggagagaatctccttgtctgccagttgctaagaccttgggaaaagtgcagtatttgggcgggagtgtcccgttttttccaggtagtctgtcatggcttcccttggctaggaaagggaaatcccctgaccccttgcacttcctgggtgaggcgatgccccaccctacttcagcttgccctccatgggctacacccactgtctaaccagtcccagtaagatgaaccaggtacctcagttggaaatgcagaaatcacccatcttctgcatcgatcacactgggagctgcagactggagctgttactatttggccatcttggaatacccactccagatttcttttcttaaaataatacctttctaaatacctgttggagtgcttgagttggtaggggctatgggaatgtcatctgactgattttgtcagaggactttgtggatttgagacagggtgggtaggagaggatcatcacattgattccagaactaaacttagggcttgaggtcactttaggtggggtagaagtggggatatctggcatactatgagatttagagggccactgtagcctcataggtactcagactttatagtgttggtttaattagggattttcttaagctggctgccctgattcaaggtgatggttatctgagcaccaggtaaggcctgggaagggtagaggcaatatggctagatgtccatttcctataatctctaaatttgtatgaattgatgcattcatgatctgagatcataaatgaagtccataaagtccataaacctcctgatattttatgtaaaacttaatgcatatgtacacttttctagagaggaagtcttgagcttttggattttaacaggtgtcctcaacatattgaaaactgcttcagcttgatgtccaatttcagtgctaacaattgttgcagaagtgtttttgagcactaatcatatcaattgcaataatggtgctccttggggtctcaggtgagctgagacttggagccttgggatccagaactcacccttaaataagcatagcatctctcttggtgggggtctgtggaggtacagggaggttggagagagttggcattacccaatttagtgaggttaagataaacactgcagagtaatccatggctgacctcagtgatgagttatccattttgcaatctggccttttattacattgctgttgactttgttgttgttgttattgttacatgtttgtttttctttggatatcaatgcttttatgggaattatttctcatttcgttaatcctagcctagtttccttcaaaagggtcttgagtgcaggtagcctcttcagggtagagtaaaacaacaaaaaagtcaaagccggaatcaagggtgtgttttctatcatacagaatattatgatggaccactgaggctcagtgccactagggactctcttgggaggtgcatagaatgaatattaaaactctctgcctgaaagatggaataaggcagaatgtatttactgttcccatttccccttggccaaggattacttcatggggcattaactgtcttacatttccaggtttactcagatgccctgcaggttcccacaggcttcctgcatgctgatagcagaggagccctggggcacaccatgagagatacatgatacagctcaggcaaatgctatcaagttataccaaaggcacctctttgcagcagctggcatgcaaaagtgaacagagaggatatgagggcacaagaggtgtctcatacaccttctccattctagcatctctcctcactgagaccatggtaatcttaacttgtaggcatgcagtgttaataaatgaagccaaagtgctggatttgatccctatgtaggtcacttagctgcccacagtgaaaagtagcaccatggacatcaaagtgaacaaacccctgcctgagtacttatttccatggatcaaaaggatggggaaatgctgatggagagttgaactttataatcgggaaaagtccattcaaatgggctattttattcaattcccaaatagccctagactttatataacttacatggtggaattcatgcttttactaacaagtaagttaaggctcatagaggctgcgtgacttgaccagggtcccatagttaatagactgaaatgtattccttcttacttcaaacttgttcacatcatccagctctctggcaacacattactggaaaagaaaaatagttcagagaaggatgtgctcatgaggactgcatagagttgcaatcttcttgggagggtacacatgcatgacctgccaaatctgaaatattaggaacttttgcttgcaacttgttccatctacagcatgggtagaggtggcaacagagaggtgactggggagaggtttgcccaagagacagcagggagattctgggaataaacaggagttgggttctcaatttggcaactaagcattcttttgttattgcactttctcaggctgcagcagagcctgattagctttaaaattcatttccattggtttcttctttcatgatagttttagatgttgttttattggcattcctatagatgtaatttaaccttggtagtactgatgaactggttgttctcttgtaaattttagaaggaaggtggacagtctgggagaaccagaactgacaggagcaatagggtgcattgctaactggcaccctgtgctctgaggtcaaaaggaaacataggaaggtggtttctgagggcaagacctaggctcctctctcaattctcttttgatttcaaattttgtttcttaatttactttaaacacacacacaaacaactttacataaatgtgtacatatgatttcagtacattttcctaagtgtattcttttctttccatttttgtttgatgtctcccctcttctcctttttgtccatgttggtcccctaactctactccaagatagttcatattaataacctagtataaatcctggcacatttttctctatacacatataatttatacatatagaaatgtatacaagtttttcaggtcattgttttataaaatgggatattatatacttattttgcatcttgattttctttttagaagaacactattgtgcatcatagaataaatacaaaaaagtttaaaacatatttaggtactttaaataataatgaagcaaacatttgtagtatgtctatctacccactgcattaaagaaatagggaattaccagtgccttagaacctgctgtgtgccactttgcaatctctttttcctctttccctcaggaactctactttctggaatcagtcctgtgtttctctttctatattttgcttctgttgctcaacattactttataaaaattttttcatatcaaaaggcagtgctctaattcactctttttaatgggtgcataatattccagtctgatgatatgttatatatgtggtattctccttcctgtaaattataattttatttccatcttacttttttctaccatgcacaatgttgcaataaatatcattgtgtatttgcactggtgcttttatatctggtgcagtccaggaatggggttgataaatagaagaggatatgtattttaaatatgaacaaatactgtcatatggcttttcaaaacattgtaacacttcacatactcaagcaatgtatgagcacacccttttcacacatccctgatagtgatacgaattattgcttttttaaattgtgccagctgagaagtgtaaagtgatatttcattgttattttaatttgcatttctcggactgttagtgaatctgagcatttttgcatttgtttgtaggccatttagctgagcacttctgtaaatgggctattcatgacttcttgtttctacaatggagatatttgtctttttcttgtctttccatagtaatatttgtttaccttgtttagggtatattttgccatcaaatatgttactttttaatgtagttagatgtctgtttttaactttcacatcttctaatttccagtcttcgtagagaatgttttccccgtccccacctttaaaaagtgtgtttagtttttaagattctttttaaatctttgttttcattttttatatttaaatcttaatccatttagaaatttatttttgtgtttatagatgctagaggtccatgtttactttgttcctgatgataatgataataacaatagctaacacttactgctgctatgtggtaagcattgttatataggcactttccacatattgcatcgctgacttggccttgtccctcacaactctgagacataggttttcttaccatatccattttacacttgaggaaaatgaggcacaaaaaaattgagtaattagcccaaaggtcacagaggaggtcaagtggtgaatgtgggatttgaactctgggaatctggcactgaaatccactcttattatagttcctcttatttgttaggccaggactatttatgaaaaaagccactcttttcccactgaattacattacttttcttgtcatttattaaattctcacatataccagagtttatttctcgattgtctgtctgctccctgatcttttcatctattcctagcattttttgttgagttgatgatcatggtcgtataatgtctgatatctatgaagtccagtcttctgtcattgctctttttttttcatttatttttttttgagacggagtctctctctgtcgcccagcctggatgcagtggcgagatctcagctcactgcaagctccccgtcctgggttcatgccattctcctgcctcagcctcccaagcagctgggattacaggcgcccgctaccacattttttttgtatttttagtagagatgggtttttaccattttagccaggatggtctctatctcctgacctcgtgatccaccctcctcggcctcccaatttccaggcattcatacttttatgtataatttatgtttattttattcaattaaagtagccgatgggatcctaattgaagttgtattaaatcaatatgttaattttgggacaattgccatgttcatactaattactccataaatttaaaatatagtatgtttcctcttcattcagaaattaatttatatcttttatatatttatattttctttgtgttgtcttttaaatttttgggggagatgtatttataaatattttaaagcttttgctgatataaatagaaatatttttctcatttctattccttagtgattgttactagagttgagaaaaggtactgattttgtatattttatatataaatcagtaggaagagcactgtcaatctaatatttttaattaattaaacaagaaaaatacattcatgtcattaagggctgaaacagcttttgataaacttcagcaggcattattaatacagttcaggtaaaattgaaataaaagatgattgcttagatatataaagattatttactaaaaacagcaacagatttaacaaacatggagatcattttagttaaaattagaatgcatttagggatgtcccttgttatctatattaaacattgcatttgctatagcctccaaggccataaaacagaaaagtaaaatagttggtgtaaatatcagaagaggtaaaactatctctttttgctgatactataattccttatcaagaaatttaaacaactctagttaaaaacttacagaatgaataagatactttgataagctatctggatataagtatataatatcaatcacttctttattctatcaataattaaccatttttagttctcaaggttcaaatttcagagaaggtggctttgagctataggttggatcatttcccatgacttggacagggagataaaagcttcttaggacggccccactagactctaccaagtggaacaaaggtgattgctcaaatttgagctgaaaggggaaatggatgatagacagaagttttttaaaaaataaactccacatactgtatgtaactgcacttcagaagtcaggtgcctagcttttaagaggataaatctaaattctttgcctgcttcttctagaatccttcccaaacccttttccgttgccccctccctttttacctgttctacactgcatcccaactggttgttacattgtcccctgcacacgttttgcacattcctctgttgtttgcccatccattcccctcactagacgtattctattcctttttctttcatgtaattctgattcgccctgtagggctctctgcacgttcccatcaaatgcttgttccattacccaagaccaggtcccttctcccaaaccacaggggctctaggagcccactctaccaaagacctgaagaacctccagctgtcacagtctcttcactcctaggactgaaggacctgttctcttctccgcatctgttcctgcatccctgtgacatctgccccaacgaaatcagaagaggagaagggaccaggactctcacttcccagactatacattgttcagcttcctctttccccctttctgacatggaaatagcgagcgaagatttgagggccagttttttcatgttgttgttttgggatgttttttggtgtgctgtcatagattttattttttcatttagagaagccaggtccaacctaaacagtttcatactcttaccaagaggatgctttgtccttcactgtttcaagtttgtacaggattcaggaccatgttttgcacctagtaaatgagtcttcgtttatccaaactattttgagttctcacctttatgcctttgctgttgctatgtcatttctcctgaaggcccttctccttctctttgttcacttgattactcttagtttttacatttcagctcaggtgtcaactgctccaagaagcctttctcgagctcatgctccccttcaccaaactgccacaacaacctgtgtgaatcttgatcaccaagcttacagtgctgtttgagataattatctgctcaagtttctggtgttcccattagactgtcagtgcctcatcgatgtgctcagcctctagctgtgaatggtgcacaggtgaccccagtggatattttttgaataaaaaaataaatgtatggatgaactgagcaatgttttgttaccatggatgttggtcatatcatttcatgatttgctatctaattttgccatttctcctctaattccattaccctcccagctcttgtttctctacgtgagcatgttgtgtgaatgctgagtgaacttttagtttactatgcattcatagtgcattcattccagtattcatttcttccttgggtcctggcctactccttccttttctctcatctattcattctaatctcatttgaacatcaagctcctcccactgtcgatactttatcatcattactatcccttttagtaacttagtaaaaaagcacctctaggatctttcaacttactaaagacttttcctagaggaggagacaaatctgattctgcaaactttttttttttttttttttttgagacaggatctcactttgtcacccaggttggagtgcagtagtgcgatcacagcacactgcagcctcaacctccccaggctcaagtgatcctcccacctcagcctcctgagtagctggaacgacagtcatgtgccaccacgcctggctaaattttgtaatttttgtagcgacagggattcagcatatttcccaggctggaattcctggacttaagtgatccacgtgcttctgcctcccacagtgctgggatgatatgctgcaagccactatgcctggctggctctgcaaacttttacttctatgaccctttctttctcttggtttctccttgacacttctccccaatgaacccatggtgcaatatgggagttggtgccctaaaagtgactacctcctaaaatcactcacactcaattattagtaaagttcaaatgacaacttttttatgataattgtgttttaaaagaaaatctgagggatagtaaaaacaaaaaaaaaattcatgccagaatttcaggcaagcaccagttgagaatgtatttttgtgtgagcagggtgttatcagtaaggttcaacatgttctacataagggactggaagctctgcccgggatgtatgagggcaatcttgcctggcctaaaggttggactgtaggtagcacaggacttccgggtttggagatttagaggataagtctaggcttcacccaaataccaacaataagaacttgagtagttcctgggacctccctgagcctaagtataaaatgaggacagcaacacatatctatactgccatgctgttataagaaataaatgagataagaaatataaagccttaggagtcaatacagtgcaatggtggagcatgagtattgcagagtccgattggttgggttcaaactctggacctgacactaattaagggttaatgaccttgtgtaagcttttaatctctgtgtgcctcaatctctctatccatatgataagggatacaagacctttctcatacagtggtttaaagatgagagtaaataatatatgtgagaacacaaatagaagagcatgcatatgaatagcatttaatgctcagttaatgaggctcttatcaaagtgacagagggcctccatgtaatcagagaagggtccacttaaggctctattggcatttgctgaaggatcaagacttgctgtattcctatctatgaatagacctatggaattaaaacccagtacaagcattttttttttctacttatatctatgtatgctctttctctcttgccttcttgataattcagaagcagaactttgtcttattactgacttccagaagaaatttcacaactctcataaagtttgtgatttttgtagactatactgaacatttagtgactcccagggaggatcattttaatcagcatacaatagtttgctcttcctcttcccttccattttcttctttccctttctccccccttctctagttttttaatctcacctcctctccctgcccttttctatcctcctcccctctcatttcccttcctttatttcttctctcatttctactctttccccctttctccttccttctttcctgccctcctcccctccctcctcacctcctcccctttctccttttcccatccctccttccctccttccacttctctctcctctttcatctccctttctatcctccctcttctctcccttccccactctacttccccccattcctccctggagttctccctttttacttttcttcaagtgggcttatcaaagtattttttttaaataaaataaaggcaagtctttctgtaagaaaaaaagtcagaaaaacattttcttctcattataggaccaaaagtgcccttagagatcaagtagcccagtgatccccagactttgcttgttggtcgcgataccctgggcagcatttgaaagccaggccctgcctccagtggtggttctgaatcaaaagatcagtgtagaggcttggagtggcatttgtgtggggtgtgccagaatatatttattttaattcaagaagatttggatttcagtcctaagtctgtcacttgctaatggaaccatcttggctgtgtgctattaaaacttccagagcctcagtaacatttgtaagaatgtggaaaataatatcttcctcaaataacaagcagtgatcagcagattggctggcacatagtaggtgttaaaaattgtttcttttcttccttccttttgagtatggtacagaatcctggttatctctctcaacacacaggatggtgataaaggaaagcctgagtatttctgtgccttgtagcacatcttagaaagggagaagggctattcagcagcattgttcatgctcaggcccaggcccagctgcctctaactgtggtcatgagaagtctcagacactggcatgaagtcagcaaataaaaataaacaacatagccaagtatgatggtgcacgcctgtagccccagctactcaggaggctgaagcaggaggattgctggagcccaggagtttgaggctgcagtgacctgtgatcacaccagtgcactccagtatgggcaacagggaaaaatctctgtctccaataaataaataaataaataagtagtaattagaaataaataaacaacatttttgaggagaagggatgaagttgattaatgggtacaaatacaccgtttgatggaataagacctagtgttagatcagtaaggtgactatagcctataataatctattgtacccttcaaaatagctagaagagaataatttgaatgtttctagcattaagaaaatattaagataaacatttaagtgatggatatcctaagtatactgatttgacctttataaattatatcaatgtattaaattatcacatatatcttgaaactatgtacatctattatacatcaataaaaaataatttaaaaccccatttattgtgaattcactttcccaggactattttaattaatcatcataacaaccttatgaagtaaatgctatgattatctttaaccacattgacttggtaaaatgtctgtaggcagagcttttttatttttttgaattttggctactatttgcatgtctgtatcatttacgccgtcctttgtctgtgtttcttagatcccaaataagtactgaggggtcctatattcatttcaaccatactgtattgagtacctaatataaaaaatccagcctctagtttgaggagctgaaagaatgaaccctatgcagtcctgattgtctgggcttattttcacttgctctgtgaagcacctgagcccttgttggtgaaccctgctacagtccccactgagtttaagacccactcttttcaagggtccccatgttaggtttgcctccacaccttagcttccaaagctttgttcccccctgccaatggggcactctagccccatccacccatcccctctcagagttgtagaaaaggcttctatcagcaagaatccagagaggttattcatacatgggacacttgatagtggttcttattctttgaggaggaggaatacttctgatttaatggtaacgaagttctaattttggtaagtccggggatctgaggctagagctgctttgtcacaagtcttgtttgcatatgctgtgtatttctacccataccctcatccaacttatctaaatcttgctcctttttttccattcttgctgatttaattttatccctcaactcatggttccaaataatcccctgtgttagttgtgcctacagcaacttgtttaactctctctaccaggcaataaggtggaggggcaggggaaggataaatgcagcctacttgtgatttatcacagttggaaagaaaagggaaaagacatgcataacactttttaaaaaagaaccagagaggcagagagagaagagtgtgtggagggagatgaagggtgcactctgatgggaacagatggcccaaaaggtaagtgggtggcagagagtaaaaataaccagggagtgaccaagccttcattttctttgaaacactcacactttagggatatattgaaactgctaattttgttggcactttgacacctcctcctaattaatgagaaatttattaggaggatgactgaggtgagcaagctgcttacaaagagagaagggagagaatacattgaacctattcagcttggcggtcacgaccaagcgaggtgccattggatatgtggttacttgtgggtgagctcaagtagaagcctcgggctgggctcctctcctggggtggaacccttctgctgggctcctttcctcctggctccctgtactcactgctgctctctggtttaccagcatagaggcacaaccccaaaacaggcttcgtggggaccaaattggcttttggatctcaagtgtgtctctgagtcactccagtgaacacgttataggtcactctgtgcaggttagtggcccgaaaatctgcccttcaaaggaaaagaaaagtgaaattctcatgacttttacactttttgtcaaatcttctgcatagagaccttctgagttggctctacctagtctgtgattccaaatctcaagcaccacctgcaattgtccatatttttcacccacaggatgctcatgttaccaggaacttaaaagagtaaacgtggttgctgacattttagcgttcgtgggccagttttctgagatcaacactaggcaaggtactggggagtgtcttctaacacttttcagactttgaacagctaactccattttctgggagagcagggttacttgacaggtatctaaatcctctgtcctagccatccaccaagccacccatttgcccttccaaatcccttatgcagttcattatctgtgcaacatagaacagtcgagagcatgggctctggaggcccattgggagcttattcactcctctgctctgccattcatcagcttgagttgtcttaggcaagtcacataccatcctctgtgtctctatttctccctctgtaaaatgagatcactaatggcattcactaacggatggttgtgagagttaatgaggtaacagttataaagaggttagtactgtgcttggtataaactaagcacaaaataaatagcactatgacatttaacactataacatttaactttcaaaatgatttcatatgcaattttgtggcagtgtcttcatacattgggtagtacagagttttaaagattatcctttaataaatggaaaaattgagtcatgtaatggattagagactttcccaaggtttacaactacagaggaatagaattggctctagagctaagtcttctcattctagtttaattgtttgtttatttgtttctatgcaaacatgttcatactcttccttagcatgtttcatcctatctctactagtgcaacaagatgctgagaagagggaagaatgccacaaaactgcatacaccaaagatgtgtggctcaaaggatacaacttttgacttgaacagtcaccaggccttgtgatcttgaacaaatcattctgcctgtctaaacattaattaattcctcaacttttaaatggaatatgatgactatttccctttatatgtgtatcttagatgtaggcatggagctaaaatagaaactcaaaatgaagtaacagtaagggctggcagtggaatattattgatcccagaggaaaataaaaattttatttccaacgttgtgccaagatggtggcaagggtggggaaaccatgtgtcctagaagaagaaaacagaagaggttaagttacctctttattcttttgtttttcagattcaaaggttgtctttttaacaaaatgaataatgcaggtggtgattatggaaagatgttaaattttgatgatgttgaaatgtgagattggtatcctgtgtgtgaggagctcttgtctcctttttcaaaggcaaggttcctatgtgtgcactttcacagaccagccctgcccctgttgcctggaatctcccttctagcacaggctgctgctgaagaggtggttcagaccattttccaaggcaaatccaaagaaaataatggtttccattggttctccttattcttcagccttcccagcttcccccacccctactccagtcttcatgacatcactaattcatacatctattatgcaactcatgccaagaggctggttaaattggaaattgctctttgttaaataatactggtatagatggcatttccattttaatccaaagctcttgagattccaaaatccttcaaaactcaactaaatttcaaaaggtgtaaatcaagcactgcattttactgactctaaaggaaacgtttatgtgagagtagacctccctggagcttcttaaactagccaatgttaatcttggtgctgagacatattgatggtatgtcatatgtaataggttaccaaataataatgcatatactaaaattatgctaaagatttactaaaaatttaaattaaggcagatcaggcttatggctaaaataacatcatttccatgcacctgcattctgacatgctctctggagattctttgctatgggagtgtgccttgtgtataaatagcatttatgatgttggttgcactagaaaaaggaaagttatcaactttaagctccactgaattaacaaatacctgatctccatttttgtagaccatcaagaaatagcattgtgatcattgggcttctccctagcagttgatggtaaaaaaaaaatacatctaggagacctctcctctcctctcttctcctctcctctcccctcttctcctctcctctcccctccccctcccccttcccctcctcctcccctgcctgtcccctccttctcccctccccctcccctcccctccctcccttcccttctcccttcccttctctcttctcttccctctctcctcccctccccttccctctcctcccctctccgctccctcttctcttttctgagaccgggacttgctctgccacccaggctgcagtgcatgatcatggctgaatgtagccttaacttcccaggctcaagaaatcttcccacctcagcttcctgagtagctaggaccacaggtgaaaatgatcacacctggctatatttttttctatttttttttttttgtagagatgcagtctccccatgttgctcaggctggtctcgaactcctggctcaagcaatcttcctgccttggcctctcaaagtactgggatcacaggttcaagccactgtgcctggctgagatctctatctttaatattcctcttccctcctgcttaattgaatgaggaaggggcagtgtcatacaatggaaggagcatagtaactctaacattaataggttgtgtggccttgaacaattcactcaactgctctgaactttagtgtgtcatccataaaatggagctaacagtgactagtttgttttgagaatgagaaccaagatgcgtaaagttcctgacacaaagccaggtgcctagtggcctttagttcttatgacagctgcaggactacctttgtcactgtgcttttacgtctcctccagtgcctggtaagaagagtttatgtatatttcacctgtgtgagtacaaggcccaacttctaactgttaataagagacaactttgcctccctcacagctggtacttaaagcgtcaaagaatatctacactccagatacttgttaagataattcagtcagaatcgactgcaatctagcacctgccagaggcttgctgaaggcatctgttacttatttattgagcacatgattatataactcttgtttactgtacacccagcactgttctaggagtcttaagaatattaacttatttaattctcacaacaaacctgtgatataggtactatcatccccattttacagttgagagaactgaggcacagagagggtaagtaacttccccaagatgacagagctagtaagtggtagagcagcatttgaacctagatggtttggctccagagtttgggaccttcacaactatactatgtaagaaagactggctaatcgttatgttcaccagccattcttccagattcatccagttctttctctgagcttagtgaaattatcagaaaacaagagacccaaacatgtgacttcagcactcccttcccccttccaacagcttcatgaccatccttcagttcctgagtcacctttctagatggatattctgtgtcttcgacaaactcctggtaggaattgtcttccatgttatccaacagttctaacatgaaaacccatgtattaaagtatctaaacaaagtgtgtttctgcataggacctttccagctttatttgctatgaaatgaaaatgatgaagtctgttagttccctttctatgaatattttcattgctattactctggctaacttctgtgctcaggtgtagtctccagttctgcctagatagttgctgatatttactttctctacttcctttagggggcatcttttctgtttttatccctgatggttctgttttcttattgattaatctcatataatgcctctgaatctgttggatgcagggaaagtataaaccataatccaataagcagcttatgatgattttcttaccatgtaaaatgtttcaaggtgtgtggactaaagtagaaggagatgaaaaaaataatgataaattatatcatctattatggatagctaccatttgctcattgcttactttgtactggcactgtgctaagtgcattacctacattattgtttcttaatcctcatggacatggctaataaatgacagggctctaattcaaaaccaggtctttctgacatcaatgcctgtccttgtaaactacactgtatatgaatttggctcagacacatatctcacattttgccctagtgaaacaaagtgtattttctccttttgaccttgggtgaagagagttgaatacaagtctttccatttgtaacacactgtcatcagtagcacaaggcctccctggttttatttatttttcccttcatccctaattatatcttcaatggcctttccctagagatacccattacaatagcttttatatatatctttaaaaatgcatatacccttgtaagatatgtaacatgcttttcttgttatttatttaaaatttattttactggcagcatgctgtatatcttaatgcatttttttaccttttccattcaacactgtttataagatctttcatgttgctatgttttcatttagttggttttctgtaactgctgcatagcatttctctgtatgcatccaccacatctttgcatctgttcctctagtgctaaaactctgcttcaattccacaattaccaatagtgtggtgtgtggccctgagcaaaaattgcttggggatatattcccaaaagtggtgttcctgagttatagggcaaataatgcttaatcacaccaaatactttcagattgctttccagaagggctgtaccagttcagattaccaccagccatgcacaagaaaaatttctaaactgtctctattcttgacaatacttggcattatcacctttgtactcattgccatttgacacgtataaaattgtatttcataagtaaagttcttctgcaagtttggaaaaagttgatttggacttgaacatgccactaaggctgcttaaaatgtcttagatgggatgctgattgagtgaatgcagaggcagaggaggagcaggctctcatttgagccctccttgcaattggtttatgtgtctcttatgacaactaacattgttttgcaatatgcagtgattatttgtgtacttgtctgcagcgagcaccttttggattgtaaattgcatctttcttccttacctgtgtatgccctcaatgctttgcttgttgcaagactccagtaagtgttttctgaaataaattgtctgatctctcgaaggtcctgcctgacaataaggggccattggctatgaaagggtggtaggatctaggagtggaaagtcacagatgattattttctattctaatagggtgatcggtttatttttttcttttcttgactgttttcctccctactttaaccagaggtgcttgcattaggatagatgaactatatgaaactgctctggtaaaaccaaacttttgaacatactggatttttccccctaaattgacaactaaaaatcatgccatgctattgactcattgtcctcttcagtaatcttctggttgggattgggaagggaaatttccagaactacaaacacttctcttagggactcaggtcccaaccttgctgggcagagtgcatgatgtgtttcataatgcatgagtgtttatttaacaaacagcaacactttttaattaaactgttgttgaagatacagactgtataacctttctccaaggcctggatgctcactggcccttccaagatgctgacccctcgctagctgcaggcctctggggcagtacatgctgtgagagttattacaagccagctggattagagggccacctctcttgaatcattcagaagctgaagtgcaggctctgggatggagagtttctcaatatgccaaagctattggaatgcaggcaggtctggagacacttagctggaacctgggggaaaagagtgttcaagataacttcatagaggaaattccctaccgcttttggctttaaaggataatcattggttcttgctggtcttgtactactatttcctgagctactctgaaatagaattgcttttaggtttcaggtcttcatttatagagctatatccctaaaagattagatacgtctcagggatgtttttcaggatgctttttcgcatcatggtgattgtattagtcaggttagacttgattatgctgcagtaatacattacttcccaaattttagtgacttagaacagcatagctttacttcttattcatattacatgtttaacactgggtaacagtggggctatgcttatcttggacgttcagggacctatacgctcagaagcttggctgctttttgatgtgaccatctcgacatgagtctttagggttttctacagcagagaaagaacaagaaataaattgtctcttaaatgttcttaccattttcattggccaaagcaggtcacatgatcatgcttacctataactttgtagagaactgtaatttttctgtcttctcagagagaaaagaggactggaaatgacagagaatatgaataacatataccacagtttcattgggcatgagaaaatggtgatactttgatagatctcagaaaattacatacactcagcaccatatacatgcccttgaagagaagagaccatagactcttaaaaatgtaagtatctcagaggagattttggccagtgaatccaaattatacagcttggaagtctacaggtttatgccataggggacacagaggggaaaatgaggaactaagatgggaatcttgcccacacatctccttcaaacagggcagtataggaaagcatatacttccaaaatgatatgattttcagtcctactctacctcgaacactcttcctggaacatactccaatttgtcatcggctcctcttaaattcagcactcagtcatgaaaatgttctttcatacctggtctcatcagtgtagaggccagaagacctgttggttttccttgctttggatttgttattttggcaattaacgtttctgacaatcatactatacctttgactcattataagcctcatgtgggtttctctactccaaggaggcataggagtttaaaataggaaaacagtagtacgttgtgatggattgtatttttcaaagaaagtcacaataatatttcccatcccatgcactcttctgcaatgtatccttgacattctgtcatcaagattaagaggtagactctctctctaccctcttgaatgtggataggccctatgatggcttcgatcaataaaatatggtggtttaacgctgaggcaggtggggcacgatgtctcacgcctgtaatcccagcactttgggaggccgaggtgggtggatcatgaggtcaggagattgagaacatcctggccaacatgatgaaacccagtctttactaaaaatacaaaaattagtcaggtgtggtggcacacccctgtagtcccggctactcaggaggctgaggcagaggaatcgcttgaacccagaaggcggaggtttcagtgacccaagatcgcgccactgcactccagcctggtgacagagtgagacttatatctcaaaaaaaaaaaaaaaaaaaaaaaaagtgctgaggcagtgaggcagctctggaaatagcccttaactggcttggcagcttctgttttctgactcttagaagccagttgccatgtaagtaatgtgactaccaaaaaatgaccacactgtgagaagcccaagtgtggtggagaggccttggggaaagagataacccatgaggcaagaaagaggcccaggaggtcccaggcatgggaatgaagaaaccagcttgcacatcctgcccaggctacaatggactgtaaccacatgagaggttccaagattaaaccactcaattgaccccagccaactcatagcaccatgagaaataacattgttttaagccactatattttggaatagttttcttaaaaatataaagtgatagataaccataatagaaatttgtgctagaggaaaatccttaagactcttgaaagccattttgtctaacaaagagtgtaaataagatatggccttaacgatcctaagtaatttttctagttaagaaataactgtaatcagttgagtgtttttccactttatgtgacttcagttgaggctgcaatcatttggtgtctggatgagatgggacatccaaggtacctcattcacataaatagctggcagttgatgagataactcagccagagagaacctatgcatgatctctccatgtgaccaaggcttctcacaggatggcaactgggttccaagaagggctatctgaagaaaaactattcttagaaaaccaggcagaaaaaataaaatttcttatgacctagcttcaggagtcattcattgtcacttttgctatattttgttgatcaaaagcaaggcaaagggctctccaatattcatcgattaggggactacacaaagggaaatattaggagtcatggtttattggggggctatctttggagacaagctaccttgatggatagagaaatgataacggaaataggtttgatgaaaaacgtggttaatctgaattgcagtaggtctgatggttggttggcaagttgtccttattctggtgtatgggtgaagggaataagcagtgagttagctcttacctagatccatcccctagaaagtaactgtgtccagttatcaatgggcagggcttgctgggcgttaagcacaggtaacctctagtcttttactatgtttctgcgacagtggcataaaacagctttttaatgagacctactgagatgcactgacagatctcttcctttccttttgtgtctagcccatccaccttcatgtaaatgatttatcaagaaataagacctaggattttgagatgggtacataagagcaaaagagaactaggatgagatcattctcttttgcctgcccttcagcattctcaatgcaagcaggttggggttctaaaggaagagcagggatgactggaaccctatagcagtgagtctgaggaatgggatcatgggggacccagaaggaggaagcagaactggaagatgtttccattctgtgaaagtggcttttggctttgaggcagcaacagtaatatttcatgtcttccgtggtgtctcctacctttaaatgtcagtctctgcagctgccttatctcctgtagcacatttcaattaggtattccaaattatactcttttcttccaggacaaatatgccagaggtgatatttactgttacagcagcatttaaaatacttagggggaaaaaatcctagtgaatagcaatttctcccttataataataataaagcacaataataatggagagaggaggtgaattctggctttgatgccaataactggctgacttaaagtgaacatcttttgtctccgccctcttttgtccccctcctcctattcccgcctcagtgtgaaggttatagtgtttggctctgtcaagagcaacctcacacatcttcttcactggaggctcacaaatgctcctcagaatgtctatttaactatctctaggtaggactgggctctgactgggctcctacttcacccattacctgtttcttcctttgtcctgagaatgtttgcatgaagccagaatctctgtttgtttagaaatttaccaggcaccactgcttactcctcacctatgggacattgtaggtcctgatggaacaccccggcctcctctctaggaggtatatgggttagaaacttatgtattgtacctttccttcttggaatcaagtccttggcctggtaatgaaggtccttcgatctggtctgcattttccagctccatctcctactaatctttatatccttatctactgtttccctaggctgttgtcttcacggccgccatggtaggttttgcctatcatcccaaaccttgtgcaggcctaccacagtacttgacatatggtgggggtctcagtcagtattctcccctatatttagaacccttccactagatcttgtcttcatatttttgattcctgctcagggatcagattatgttccatgtcctccactgagccttttctgacctcctcagcgcactcagtgccgttccctctctgaatttctaaagtgctcagcagcagcagcactcatttggcacttggtatatactatcttatgctattttgtatgaccatatgttgtctatacaactacattataagcacctgatagggataactgtgccctgtgtgtttttcctatccctttgattctaagatagttccttgaacattgaagatgctcagttaatattcatttattaagtagatagatcaaggagtaaatgaaagcaaggatcctaagaagcctgccttttggtgccaatctattcaatttggaattcacaaacttacctaaaacaaggcctttcaatttcctgtttcccctgtaaacagagctctaccaccaggatttctcagaagctctttctccacactgaaccctaaaactgaaggttcaggtagagagcttttccagtgtgagagaatttttaaagcatctggggtttggcacatccagtgctttgaaaatcaaggtgtcttgatcattgggtgaaggggattagaacagcaggctgtgttttcaagttcaagtccataagcagacaggaatagaatcccacaagagtttgttctgtctctgccatttactagttaatctctctatgcctcaatttccccatttgtaaaatggatttaataatggctgtctaccttataaggttgctatgaggtgccagtgtgataataaacgtaaaagtactttgaatattgcaaaacactgtatgaatgtcaggaattaggcaggcaacaactatttcttgggggtttgttctgcatgtagccctgcactatgtgtagatagaggcctctgtacattacagaagactggcagaggcattggggattcatcatggctggaattctggttctcagatagatgaaagctggaaaaagtattatagcctagcaatcacatctgaaaggttggcagcaacaattgagtcagagaagacgggaggtgaagtattggcaaaaatttgaccctggtcattctttgaacacttcagatttccacagattctatccctttaacatttctgaacgttatgattttgcttcctccccacactggcagctctgcctcaatgaaaccgtgttgcttttttggttgatcaattgtgcccaacttcctgatcatacttgtcctgagagcctgtgttaagctcatgccggctctcccaccccgcccccaacgccggccaaaaaaaagactctctaaaaacaggtgcccccgatgatctcacactgctgctggcattggcagcagcccagaagggccaaatggtgacttcaggtccagggaggctactgtcctcagctctgttttcatgtaaatgtcgctcctgctgaaaggaagtggatgcaaaaaaatatctgctatggaagcagaactaccccagactaaaatgttggtttttttttttttctctcccccttttcttttccttcaagttttccatgtggcatcagcagctgagtaagggaaagctaagaggtttaagtgtgctggggctgggtgggctagattaataacccaaagccttccaagctggcggtgctgggtgagacaggccaaccagaaagcgttaggttatggggagccctggccacagagccagaccctaccagggtggaaggtgaaggagcagcgagctctgcgtgcttgccccgagcccccaccttccttccttcctcctccctctggtttctttcctcccattttatcgagtccctctgagatggctgcgcaccagtggctccagcctctgaccgttgctgccctctgctgggaagaaagctttactcggtgtggaaagtgctaagctctaccagggaccagcttaatgcagaccaagtccacagtctgtggctagtgtgtgatttggcccagaggaaggaaggacaattcagaaaacccttgcaccacagtgtttccctagtggtttcaggtgggggcaggactttggaatctattagggaaggattgcttgaatcctcagagttctctgttcaagaggaacatccctgggagaggagcctcctggctcctctttacctgggtcagacatgatgtatggagactccaccatggatgacccttaaatatgatggatggctttagttacaggacacaattctttctcaagggaaggtgaccaaaagaagttgggtcttgaaggggctgcaggatgggcctggaagtctcttggctctaaaggaaccatcatagaatggggattctgagcaaccaggaagcagcagaaaaatatgcaaagccagatgggagtggggaatattgcccattaatgggcaagagtacatagaaaggtagataataaactggcttcaccacttctcaactttccccagagctggctgtgccagtaaactgtgctcagctggctttggatgagagaaggacaagagggtgcctatctccagcatggctgtggggtcgccctgctccatctctggatcttcagcctagagtgcagcccagccaaacaagagcgatgacctcactgaccacatgtaattctgcttgagggatttattttcttccatgagctcctgccaagactcttggttaaagctaatggggctcccccagccagtgagtgtctcctagttatatgtgtaaacaacgccaggcaggaaataggtttcctgttcttaatgggcttgttaaacctcttatcgagtggggtttaaatggctttattatgaataataataatagtaaataaacattattattattagtagtagaaaaattatgatgtcagccctgactaccccttctcattttaatcttgccaacgtggaggtctttggcctctaagtgcacaggaatatggtgagtgacactgggacttataactggagaagatggcagaattcatcttcgttgcctgcagctttccaatcctgagcccttttccactttcatcgtgtttccatctccatcattcctttcattcagggttttcatgatcttattctatcagagaagatagaactacacatccctctccttctcagttttatttagcattgaaagccatggacagaggttctgaggttaaattgaggtatcgggtagaggggattttggagagagcagtggatgctggtaggggagctcagttggaagtggggctcatgttctgatcttcagtgccgaatgtctgtgtccctccctcagatttacatgttgaaacgtaatcaccaatgtgatggtattaggaggggggccttttgggaggttagtaagtcatgagtgctttgggattagtgctcttataaaataggcccaagggagcttgttcaccccttccaccatggaaagacagaagaagaactagaagccaccatctatgaaccaggaggtagccctcacctgatgccaaatcttccagcaccttaatcttggacttccaagcccccagaattgtcagatacaaatttttgttgtttataagctacccagtttatggcattttgttgtagccacctgaacagattgagatatccagtttatagctggaactggaggtataccaggtatcccagactttggtaatttatgtatcaggttcactattttcaccataactccctacaacagtattgattttctttacaccgattatcttgtttgacttaagtagatttggcatcatcttacaagcaatatgtctttgaaatcctgggttcaatgtgttagccaggttttttactgactgcatattgaaatgaatatctaagagctaaatattttttcctaaagttcatcatgtggcaaatgtgtcacaccctccagggaaaacataccacaacatctggagacactgctatagggtagtggttcttaaactttagtgggcatgagaaacactggcagagcttctaccagaaacactggtagatagctgtgctcttccccagagaatctgattcagcaggtctgtggtgggaaatatgactttgcaggttttttttttttttttttttttttgagacagggtctcattctgtcacccaggctggagtgcagtggcgcggtcttggctcactgccagctctgcctcccaggttcacaccattcttctgcctcagcctcctgagtagctgggactacaggcgccagccaccacgcctggctaattttttgtatttttagtagagatggggtttcaccgtgttagccaggatggtctcgatctcctgatctcaggtgatcttcccgcctcggcctcccaaagtgctgggattgcaggcatgagccactgtgcccggccttttctttattttttgagacagagtctcattctgtcacccaggctggagtgcagcagcgtggtctcggctcactgcaagctccgcctcccgggttcacgccattctcctgcctcagccttctgagtagctgggactacaggtgcccactaccacgcccagctaattttttgtatttttagtagagacggggtttcaccatgttagcaagggtggtctcaatctcctgacctcgtgatccacccatctcggcctcccaaagtgctgggattacaggggtgagccaccgcgtccggccgccttttatttttttttgagatggagtctccctctgtcacccaggctggagtgcagtggcacaatctcagctcactgcaacctccaccttctgggttcaagcaattctgcttcagccttcaagtagctgagactacaggcacccgcccccacacccagctaatttttgtatttttagtagagatggggtttgaccatgctggccaggctggtctcaaactcctgatctcaagtgatctacccgcctcggcctcccaaagtgtccagaactcctagactcaagcgatcctcctgcctcagcctcctgagtagctgcgactacgggcttgcacccggaaactgcagttctaacagttgctcaagagatgttgatatccaggggccacactggcagtggcactggcctggagaataagggcctgttctccatttccacatgtgaaaatttcctcatttgaaaatggggataatgtgtgctgtataaaatgaaataattttttcttggtgccaatctgtctatgcaatggaatgtttgtgtctccccaaaattcacatgtggaagccctaactgccaatgtgatattaggagatagagcctttgggaggtaattagatcataagggtgaggtccttagaatgaaatccatgcccttagaaaaaggaccccagagagttccctcaccctctttctgccatgtcaggatacaatgagaagtaagaagtctgcagtacagaagagggctatcaccagaagctgaccatgctggcaccataatcttagacttccagaatgcagtactgtgagaaataaatttctattgtttataagccacccagtctatggtacttagttatagaagcccagatggagtaagccaacctgtttggagtgtttttgagctgtcatgcttttcaggttcagcttaaagctcagatgggaaatacaggaacttctgcaggttaattctggttctaagttcaagtcctaagaataagcccattatgcaattctgggtggccaagcagttctccagcagcccccaggaagtattctatctcacagaatcctggcaaaaggagacagtcttctcagtctggtcaagggctatgttgagtgtgagggaacagaggtgaatgtcccttgctgtgctcaccatgttctgagagacaggcagacaaagcgtaatttacaatttgattaagtgattgcattggtgactttttaaagccgcccagtagttgagccccctttctgcatttggaagtttacccgtatgagtctaaaagggagacagggccctcattccatgactgaggcccccaaagtctagtctcactttcctcagtctcagtgagccacagaagccaggctcagtgtctgggaggagaaatcctctctgatggtggcaggggtggggacagcagccccgctgggccctgtggggacagtcccagcagcagacagtcccagttgggcttatcctgtgatgttggcctcactgtcttggcagcctctggcatttctgttctctgttcatcttccacatatggttctcaggttcactcatcaaatcccttcccatttcacccaatcaataatgctgaactaataatggtttttagagcagggaagtggcacaatcacaacttattttaaagataactgaccactctctggagcatggattggaggatgagtgactcaaggtggggtgactagtgaggaggtgatgaaggagatgagaggaaagaggaagaaacactcacagagtaaacctggccatatctaatgactggaagcctgagtttctcttcaaactcagaagagaaaaatgaatttatggttttgggcgcagctttagttttgtctttggggatgagtatgtattttgttgggaaggtggatgccctgaagcagggttgggaaacaagattagaggtttttgaataagactgtgtttgaatacagcttggctatggtcttctccatttcaagtctgttcaacttaacaaatattgagcccttactaggtgtcagacattcttgggtatttagaatacagtatattttgattttggtgttgaaaaaggtgtggaggtatgcagggaaaaatctcacatgcttttacctacacacacacacattcacgcaacacaaagtgcacgcacatattggtcttgaaattccccaaggaccaaaatggacccatgtgatgagtctgtgttataacagggaatctaccgtaggttcttggctaccttttgtgaaccttctgtcttctttcctctcacttacaagtaatcccctgagtttttacctcctgaaccctgtgatttcaagggttcacaactaaatgcttcttatgctgagcaaatgtatacactgctaaaaccatatactcactccttgtggtgtgtttgttaggaagctgccacttctgtcttctccattctttggaaaaggctgtgagtaaacacagagcactggctatttacatacctagctcctgcttgctttttcaaagctctttgttcaagtgtcagtgctggtttgtaaaacatgaacagagttggggtaaaaaaagtaattacagttcaaatctggtgtttctactgacatgatactgagctgcctgactgctcttctttcttatcccttctctagttctgtcttttcagttgcaagttcactctgtctctgtctcccctctctctcccttgctctcactctcattctcttgcttgctcttctgtgtgtcagaaagctacacacatgaaaggtagctggcctcatagccactgggtagcccatccttgagagcctggccaccttcagtgtgtcgagatgccagggccctctatggctttttgcacagggaagttctagtgttttcagtttccagagcccacaatgagctgtcctccaaatccagatctaaaaccaaaccttctcttggatcagaccaatccagaagcactctatagtttcaggggtgtccaatcttttgacttccctgggccacagtggaagaagaagaattgtcttaggccacacatataatacactaacactgagatatagagtaagctcagttgttgacatagcaagtttgaaattacagcagaacttccagaaaacatcacaccagagttttctatccttccaactatattttacattttttgctttcagaggctatgcttcttcttctttgttcttctcttaattcagcccatgagcacatggtagattatgaatggatgctttaggaaccatgtagatggaggtttgtgaaaatttccacggaacatggcagttgagaattggtgactgatatggtctagctctgtgtccctacccaaatctcaccttgaattgtaataatccccatgtatcaagggtgagactaggtggagacaattaaaaaatgggattggtttctgccattctgttctcgtgatagtgagtgagttctcacaagatccgatggtataagggggtataagaggctaccccttttgcttggcactcattctctatcctactgccccgtgaagagatgccttctgccatgattgtaagtttcctgaggtctcaccagccatgcagaactgtgagccagttgaaccacttttctttataaattacccagtctcagttacttcctcatagcagcatgagaacagactcatgctggtaccacagagagtagagttctgctataaagatacccaaaaatgtgaaagtgactttggaactaggtaacaggcagaggttggaacatgttggagagctcagaagaaagaagacaggaagatgtgggaaagtttggaacttcctagagtcttgttgaatggctttgaccagaatgctaatagtgatataaacaatgaagtcctcagatggggatgaggaacttggtgggaactggaataaaagtaattcttgctatactttagcaaacagactaaatttgcatttcacccctgccctagacatctatggaactttgaacttgagagagatgatttaaggtatctggtggaagaaatttctaagcagcaaatcattcaagaggtgacttgggtgttcttaaaagcattcagttatatgtattcacaaagatatggtttggaattggaacttatatttaaaaggtaagcagagcataaaagtttgggaaatttgcagcctgacgatgcgatagaaaagaaaaacccattttctgaggaaaagttcaagtcagctgaagaaatttgcataagtaatgaggagccaaatgttaatcaccaagacagtggggaaaacgtatccaagatattcagagatcttcatggcagtccctcccattacaggactagaggccaaggaggaaaaaatggtttcatggattgggcccagggccttgctgctttgtgcagtctcagaacttggtgctctgcatcccagctgtggctaaaaggggccaatgtagagctcaggccattgcttcagagggtacaagccccaagccttggcagcttacatgtggtgttgggcctgtgggtgcacagaagtcaagaatttaggtttggtaacctccacctagattttagcagatgtatgggaatgcctggatatccaggcagaagtttgctgcaggggcgaagcccctatggcgaacctctgctagggcagtgcagaagggaaatgtggggtctgagctcccacacagagtccccactggggcactgcctagtgaagctgtgagtagaggactagcatcctccagacttcagaatggtagattctctaataggttacaccatacacttggaaaagctgcagggactcaatgccagccaatgaaagcagccgaaagaggggctgtatcctgcaaagccacaggggtggagctgcccaaggctatgtgagcccacctcttgcatcagcatgccctggatgttagacacagagtcaaaggagataattttggagctttaagatttaactgccccgctggattttggacttgcatgggacctgtagccccttcgttttggccagtttctcccatgtggaataggtgtattcacccaatgcctgtaaccccattgtatctaagaagtaactaacatgctttttattttacaggctcataggtggaagggatttgccttgtgtcagatgaaactttggacttcaaattttgagttaatgctggaatgagttaagactttggaggactgtgggaagggcatgactgttttttgaaatgtgaggattaagcataaaataatggcaaaccgcacaagaattattacaattcaaggtgagatttgggaggagccagggacagaatgatatggtttgcctctggggccccacccaaatctcaccttgaattataataattcccacatgtcaagggtgggaccaggtggagacaattgaatcatgagggtggtttctgccatgctgttttcatgatagtgagtgagttctcatgatatctgatggttttataaggggcttccctgtttgcttggcactcattctgtcccctgccgccctgtgaggaggtgacttttgccatgattgtaagtttcctgaggccttctcagccatgtggaactgtgagtcaattaaacctcttttctttgtacatttataaattacctagtctcaggtatttcctcatagtagcgcaagcacagactaatacaatggccaagaagtgatcataggatggtaatataataaacacatggaggggaaagtgagtgtagttgcaggttttcaggagaaaatctgaaaggggtgaccaaaaatgagtacctgaatgatgcagctttttgaaaaagtctatttgtaggtcattaacaaattgagattcaggaaatcattgtatggtttaaataggataaaatttttcactagaatgcttgatctctggggattcccagaagcccattcatgaaagtggttcattcatgcaacaaatattttaacaaatgccaagtatgttgtagaattattttaggtgctaggaaaacagcagtggataaaacaaaaattccttagagtttatattctaatggcgagtcataagtaatctacaaaataaataaatatacagtattctagatgatggtaagtgttttaaaggaaaaatgaaacaacaaatagtgatagtacaagcgggggtggtggtgataatttcaagtttaggtagggtaaagaagaagacatggatagacaggaagcccagatatagcatagtattccagggaccaaagcaagatgttcaggaaactagaggcctcaaattctcctactgcaatctgactttgtaccccaattaacagtgacagcatactgctttaaaataggaaataaagtggaaggaaagcaaatgcttgatagttgacctgacattcactgttgcaagattgggaacgtacaataaatgtcactgatggagaaatattcatgaagtaaaaatgtcagttttcaatttggcatgaggatggtttgacatgtattagtcatgcacagaatattatcataattaatgcattaataatacagctgtcctttttctcccaatcataagttaaaagggaggaaatagaggcaagtgaaagagcagctctcatcctgatcagaccttttctcttggcatttgtctcttcctctgcccagccatttctgtggcattggcttctgatcagtatcagtcttgatttatccatctcagttcttccttcacctttcatgaacaacaccagtggttttgtctgctgagggctttttccttaattttcagccatactttaaaaaatattttaaaagagagagatatatatagtaaaaatgagacataagcaaaatcaagaatataaaaatctcccataagctcactacccagagaaaactactattactattttggtgtttgtactgatctcggatagctggcgctgggatgactcaggggatttgattcttctccactgtttctcattctccagcaggctggccctagcctattctcatgtcattggcagaggcacgggcaagcttattctcacacctgctttttaagtctctatttgtgtcacattcactaacatcacaaagcaaatcatgtgattaagcccagtgtcaaggggcggaacattctgtcctacccatagttggaaggtactgcagggttatgtggcaaagggaagggtgaaaacttggggcaaaatttgcgacttcctatactgggtcaaaagacacccttgtttcaaggcttatgatagatgtttccaaattgctttctagaagggctgaaccaaccccactaatggtataagacttcctggctttccagttctctttagtcttgctgattctgggaatgatttatgaccttctgtctgggctgttttgatttgtatctccacctgtcttttaaggctgcacagtttttctttgtggtaattctttacttgcagaatacccccaaagctccctaagactctggtctacttaccttcttcatcctgatttcttctgcctgctttatctaacacttgtgctgaccaactcccagctatctgaatattcagtaatccatgtaggcctactccccaagtgttctaagttggtaggagttactacacatcttttaactttgctgcctacaccagcagtaatgtaattgttggtcctcattattcccagaatattggaatttttagggtcagaaaagagctcagaatccaatctcatttttatacaatattattccaaagatgtatgggtatttgtgtagatgaagataagggtatagatagaaatttgcatagaaaaaaggttgaaaggcattgccattgttaatatgctagtatacatctgtatatgggaattataggtgaattttttttttgcgatggagttttgctcttgttgcccaggttggagtgcaatggcacgatccctgctcactacaaccgccacctcccaggttcaagcgatcctcctgcctcagcctcccaaatagctgggattacaggcttgtagtaccacgcccagctaattttgtatttttagtagagatggggtttctccatgttggtcaggctggtctcgaactcctgacctcaggtgatccacccgcctcggcctcccataggtgaattttaaaaaatctttaatgttgcgtacagaaactgagggtcacagaagttaaataactcacctcatatcctaaagattaataatagtgaaactgactaatgcccagttctgctgattcctggtttaatgctctcttgagataataccacagtatgatctctgaggcctagctgtcttttgtttgattgtttgtatccaagctgtattggcagtttcttttggttttataagagtgctctgctgattgtgggttcacagggaaataaagaatgttttttaaatgattgagtcatctaagtcagctatgtaaatgtatatatatatatacacacatatatgtaatatctgtatgcataaattaccatgacttcaaaatttgacaaatggttcaggtaaatagtggattttatcttttaaatcacattaaggctcccaagtggatgcatcctgagttctggacacataatttatcataggcatcacatggattttatgtaattatattaattatttagtacatacaaaggtaagctctgcagaattagaatagaatcggataagtttttagggagatctaaattggtaagattgatcaaatttcttgctatgagtaattgaaggtgggtcactgtgatggagtgttcttcactggagctaagcttcactagagctattcggagtaattggggactggttaggagaccaatgcatcaacatctgtctataggaagtatggattcatctgctttgaaatgagtctttagtttgtttcctgcttgttctttatttctttttcacctgaatgctctttcaagaatattcaaaaacacaaaaacaaaaacttttcccctggagagtggggattagctcaagaatcaccatgatgatgagaagcagaaaacctggtttggagagtcctggacctggagaacaccaaaaagatgttagcatcttgagtatattgttctgatctaaagtcagatgttaaattttttactcacttagggctgtctgtgagactttgcggatcacagagagaatagacactgagaaatgaacgtgaactagtgggtacaaaggaaagggcacccgaggctgcttcatcaagctagaggagtgggaatctcagcccctgagaatgagcatctacaggctcttttttcctagtgcttctgtggtgtttgtttttcattgtgccacttggtttgcagaaaagaaaaaagaaaaaaaaaaaggctgccctggaagctgaggttttacaagtgctgagagaactgtcaacctattatagaattcagacagagactttcagctagagagggtttaggtattctgtgcctggctggactctagggactcacgcttgatcatactaggattcaagaacaacgcagttgtcactgttagcccatgatcccacacgtacccagacacattctctcacggcaagtacatctgcacctggatgccttctactagtatgacatacttaaaagtatcttggatatgccttaaagatcattgttggctgcttcttgatggcaaagtgctcagttagagccagtttaaacacatgtcaccagaactgaataaatagattttgataaaactgattcagtgaatatctcccttagggcgaagctcagccttctccacttcactggtgctatgaaaatcactagtcctcatttccaagctgtgtctgaattcagatttaactgctaaccattgtttaagaccgcagtgagatccacagggtagtctcaaggtgtgattaagacacttgggagtggtggtggttaaaaaaaaaaaaaaaatagagccaaagtgtaaggaggcaagctggaggcacgtggttatatgaggagaaaaattgcagtgaggccttctcatcaccctcttcagggtcaatgtgatggcttcgtagaatcaagtgcaagtctgtggctccattatctcaactggctagaagagagtgctactaaggcagaggtgggagcatgaaagttcacctaatagcttagttttgttaagtctcattgccacagtctgcaccttatcctgatgttctcactggaaaataactagcctagttcctgagaaggaattgtgaacagggcattgcctgtttgtcaaaaagttatttaaagtcactccagctcctcacttaacctctctatgcctgtttcctcttctcgaaaattacagtaataattattacagtaataatagaatagtacctatctcataggctttttgggaggattaaatgagttaataatctgaagatattgaaaaccacacctgtcatgtggtaagtggtcttcaaatgctaattgtttttatctttattaactgccatacccatgtttgattggcagctacatcttgtatgagtctttaatatttcatctgtaatttctgggttgctcctgccacagagaaggagcaagggagccattggtactactgatgaatattaggaggtggagacaccttgacaactgctgaaatgtactcatgcctgcctgcttgccctaactgcacttagtggcctggatttaggagctgccaatctcattacacaccagttttcatgactatcctcaacttactcctttcttaccactgctcagcacttatcctaagttgacaccaggctcattggtaatcatggactcacttctcccatctgaagtattcttgagttggctcccaagaagcattctctcttcatctccaactcaagggtgagctccttttcgtggaggaactaccctgtgtgtcctttccctccctctctccatcaccatcagcattcaattcagtattctgcacacacaggagtttagtctcaatttaaggtaggtcaggtttcattcacccttgagctccccttagcacccactacagactcattggagaggtgactattagaggtgcttgtggaaatgaatctcaaatagtgtccttctgcctgagtccttcattgaatccctcacttgtatacatgattcatactctggtagctttgatcattgtacaaaagaaaagtagtaactcttctttggggccaggccaggactgtggagcccaaagggcttttgtcatccctcctggaatggagttacctgatctggatattggaatgtttacatccttagtccttgaaaaggggaaaagttatgcttatcctcaattgtttaccatgacccttcctgtcacatcatactgttctacgaacacaagaatcatggctaacatttgtaaaccatctactatatgccaggtactctataatggaaggtattttacataaactttttatttaagtctgtgaattaggtataattcaatgcatttttaaagttaaagaaactgaggcttagagagctacttgaccaaaatcacaaggctactaattagtacaagccatttgatctaatactaacactaacttgttgtaactagcttgtcttgctcttaacttcttatctcagtccatttgtgctgctggaacaaaataccacagactgaataatttataaataatggaaacttatttctcacagtcctggagtctgggaagtccaagatccaggtgctggcacgtttcatgtctgctgagggctgctctctgcttccgggacgacagcttgttgctacttcctcctaaggggaggcatactgtgtcctcacatagctgaccttttatagaggttgctaatgccactcacgagggttctgccctcatggtttaactacttccccaaagccccacctcttaatacttatcacattggtgattaagtttcaacacatggattttaggcgacaatcagaccatagcatttcttctctacaggtttataaaaatacttttttgtcttgtatatattttcattatttttcctgcttgagtatacattttcatctctgaagacagggacacatttatggacattccttcctctgctctctaagactgcagtgattttatgtgcacatacatacattgaaaatgtatagttggctagatcctggaccccatataatagcttactggttactatacagcaggaggaactgaagagaaagaaagaatcaacagcaaaggtgcccatacctgttgcaatttgtattttgctcatgtcctagttcagcccatccaagggccaaccctgatagggcttaaatgttctcagcattagcttctcttcattaatatctgtttgtacctttctttgatgccgtatctatcctccataaggtacttattaattttcgcatcatcctgcttcatgttgttctgtccattatctgtaaggctcaaatatagaaagaaagtgcatccatatcagtgagagacagttcagagtgattgtgggtgagctcatggtttcctgcagctgcaggactagagagagctacttcatgatgttggagatctggagtttaggaagcctaggaggtattcaagcagcagtcagtcagcttgccttgcatttttaaaagcatgtctgcaattttatggtgtgttctcctctcccaccactgctgttttcctccattactgcttaggttgctaccctgagagagaagcagccatgctgattctttatcttttaccaaaagggcagcagcagcatctctttctaaattgttattatgaagagaatagctactgtggtttgaatatccccttcaaaactcatgtaaaatgtaattgccattgtgatggtattaagagatgggacccttaagaggtgattaggccacaagagctccattttcataaataaattaatatcattatttcaagagtgggttgttataaaaacaaacttgcccccgtctgtgtttcagtctcaccctcacttgcccttctgcctctgtcatgagatgacatagcatgaaggcccttgtaaaatgtcagcaccttgatattgaacttcccagcatctggaactatgagaaatcaatttgttttcgttgtaaattatccagcctatggtattccactatacaataacaaaatggactaagacaataacccatccacacgatacaatgcatgatgtagaaagtaaatacattgaaataaatacaatgcaaagaaggtctttgttatccaagacgctctgtcctgttctgcagagttaacaaccatcatatctctcatatgatacttcttactagaaaattcccaggcgtacacaggtgtgtgtgtttcacccctttttgcctttataaatggaattggctggaatgctgctgagatcccagctgctgaccctcctgtcaggtgccctgtggttctcattagggcctctgggatactaacattcacacaggcaatgtactttcccttcctgacgcctctggggcccacccgggaccgtcaaacagaccctgcaaagcttaggagatcaattccaacagaagtccagagccatggtgctcttggaaaaatcacaaaccaaaatatagaagtaagactttttcttcctaaattttaggaagaataagaaaatttagtggacttatttgtccactaaaatattaaatgtgaggagaggggaaggcaaaactatggatgattattttcttttttttatatttctgtaactttaaataaggatctatatttataatgaaaacatttatttataatgaaaaaaacctcaatctatcaaaaaaaaaacaaaccccaaaaagtattgccagttcccattgaagtggaatcttaggctctcaacttattaaatgtactaataaagtttttattggtaagcagatacaaaatcgctttataagaatccccagggaattactaagcattgttttgtaatagtaaaattggatcctaatgagcatagtggtagaagtcactgtctgcagaaattagaaatgaaatagagttgattctgggtatgtctgcattgaattagtagagtgtcttggaaagcttgctggactatgatgtgcacggtgggtaacaggatctcccagggtgttcaaagcagcatgattccatccccagcttgccctgcttgttgaaaatcactctctaggacagtattttctgtgctgtgggttttagcctctgtgggcctggaatattactgctggtgactgtggacccttccaaacataacatactgtctgccacaaataacacagttactatttattgagtgtttcttatgtgccagccaccgttctaagaactttcatgcatttacttatccagttcagtaatccggtaaagctaatagcatgttgattaccttatgattgaggaaactgaaacacaaagggctgaagaagattgtctagagtctctcttctattaggaggtggggtcatggttaaaaagagccacctcctaatcactaaaccatgtcacctctcagattagtggatgacatctcctgtatgtggaccatctgtctgtatgtgtgcctgcgattgttttccagatatttgtagagattgttgagattgaacaagcagaaattcatataagagccatactgagtttacatcagcttttggtcatcagtattttctgtcagtggatctaaaatgcgactcttttcttgtgatgatcctccaagtatttggctgttctaaaaaggctatggtcccaaaggctgaacgtcattgttctagaggaaggattttcctgtgatgatcctccaagtatttggctgttctaaaaaggctatggtcccaaaggctgaacatcattgtcctacaggaaggatttggtcatcaaacacacaccatccctagttctttcccaaacagctctcctccagctctgtcatgtctccaccaggatcaaatggcatggtctctcattctttgtgatgtagacagacactggtgagataaattgataagcactgctttgggagtcatctgttgaaatacaaaaataactttgtaacataacctccttctccttagaaacaattattggaggaatttatgaattttacatcttgtgtgagaggctgacagaacctccaatcagaaaggccgtgttctagcgtcaaatcatccatcatttgtgtaactttcagcaagtcactctacctctgtacctctgcattttcaatttgcaagagtggttgcagagttaaactagatgatggtattatatacttgtttttggtttgtctatttctttattttaaagaatgttcaatatctactccataacaggcatagcattagcttcaggatttccagcagtgagccaaacatacagagccctagttctcatggggttgatttcctatttgaggaaaagagacaaaaaggaaatatacaaatacatacattattaggtggtgataaatgctatggagaaaaataagaagaaataggggagataaggggggggggtgattaatttatgtagacattcaggaaaggcctcaatgttgaagtagtattcaagctcatacctgagaaaattagagcctgagccaaaaggctatcagggcagatggtcacaggcagccagtgcaaaggacctgaggtgggaatgtgcttggtgagttggaggcacaggaaggggcctgtgtggctagtacagagggaggaaggctgagagtagagatgatatctgagcttccaaggggccagagaatggaaggtttgggagtgagacggagccatggacaaattgaagcagagtgaatatgctctgatttatactgttaaaagttgatcactcctgcggagtgtggatagaaatttagggacaagggagggtggagggagactagttaggagactattgtcataatccaggtggcttggccatgaagttagtggcggaagaggtctcattctgggcatatcttgaagctatgcttgatggggttgttggtaattgggtctggggtatgagaggaagggaggggccagggtgacaccaagcatgtgattaaggcctgagcacctggactgatgagctgttgtttgctaagatgggtaaggctgagagagatgcagttttaggggaagggttggatattaggggttcagctttggacttgcatttccgtgtctaggagacactctagtagagatatgaaattggtgatggtatgagtaaggttggagtttagacaaaaatctaggctagaattatggatttgagaatcattagcatacacatgctatttagaggcttgagactggatggaagcgtagataaattgagtgtagctagtgggggccaaagcattgattctcttcccaaatgctagggagccctattacttggagcaggaattgtcagacagtgaccagattttcatgtctttttgtaaataaagtttaattggaaccattcatctgcatttctttatctattgtctgtggctgttgttgagctacaacaggagagctgagtagttgtgacaaagactcatggcctgccaaaggccaacaaaatctaccatctggctgtttagagacagggtttttgtttttgtttttgttttttttgacccttgatttagagatcaaggagataagaggcatccagcaaaggaagctgagaaggaatagccagagaggaaagaagagtgccaagagttctgcattgaaggaaagatggtgccagggtttgaacacacagcattagaatacgtgaggctgggcaagttacttccccataaggacggtagtagcacaggattggcataaaaattaaagtagatgatgcatgcaaaacacttacagctgtgcctggtatccagtaagtattcagtaaatgctcttacagcatctacttctatttgcttagtctgtagtcctcagccaaggctctgtactggagacaaatcaggatgtttgaggattagccccaccgcctgatcaggtaagcctatgatctatgctcagggacctgaggaagaaggaggaaggtgagccatgtcccccgaccctgaccgtgtacaccctgtcccccaagaggaccttgaagaagagcccttcagcatctgctttttacttcctatctttgacaaacagtctttatggaaagcttttgagcaaacggcaaatccatctttatgagattactaatgtcaacacattttgtgtatcaggattttataggctcctgcgggcctgtgcctgtgacaacattggctggcagtgctcgcctgaggaattatgcaacatgcccctgatgctggagaaggatcttgatatcccactgaggcccgggacattttctcccagaaacagtcttgaatgagaagcttgaagaggggagttagatttactggggcttctctaaagattctgtgtccaaagcttgaatagggaaagaaatactttgcatccatgtagcaggttctgcattcagcataccaggtttgctcctagttaaagagtcatggagcccatgggagtgtttgttctttgggaatgtcataaaagagaatttggcctctcccacttacatgttcttgcatttcttattggtccttctcttgcaattattgctactttccctggtcaacctctagagcagtggctttccaagtgccttctgtggacaggtagtatcagcatcatctagaaacttagagacgcaaatcctcggtgcacccccaacccatggaatcaaccgtttttaatgtgtgacctttggcagattagttacccctctgaaatctagtcttaccctatgaaatatgggaacgttaatagcacaggattattgtaaatattaaatgagatgattttaatgagtcttccaggcgattctgattatgctacagttccactcctaaagattcttctaaaagattcccatttttggacaattagaagttcctgctaagagaaattttcagattttatccctctacacattcgcaactatttttaatctgagctaatctgccaatcatctttccaaaatgaattaatactctcccattttcttaaaaattttgtaggatatcaaccattttaaactttttcttaaagactcagggcatcatcatgaatataattattgttatattagatgttgggcctttgtcatatttctatattttgtgttgtttaccagtttttttcagcttctttaaaaatagaatctttagtttgctaccttcttcttcattgtctggatatcagctatttttttaatagctatatccagtattatccccatcactttctaattttttacttttaacttgattttgcacaaggactgaaataaccaagatgattaataatgtactcaaagcaagaataaatcattaaacataatagtaaataaatgagaagaatttattgagaggaaataaatgagagggattttttttgaaagtataagcttctgtacctgagttttgcatcataaagtctggattcttgggtaccttactatttacttctgatcatgtcatagttgtcttgaataactgaatagctgatgttttgaataaatgaaaagtttttgtagcatactcaccactcaatcattctcctgaatgttccaccctcatcatgttatacctttctatcctttgcatatattgttgacatatacattttcctaggtgatacagtttgtaactgatatcatccaatcacaagtaaattactgctctgtggaataaaaggtaataactaaatgggacatgtctcctctttcactccctttttgctgttgttccacttctcctgggctcctgatgaagtctaggggagagtatacagggctgagatgtgaacaaccctaggatctaggcttggctctgccactaagtgactatgtagaactaggcaaatctcttggcctctctgggccatgagatgcaacactataaatcagtacgataatactcgcttctccttccttatagcagtagagcaagaatccaaataaatagtacaagtgagaactcaacacaatctacatctgtgaagcatcattcttaaggtatatccagggcatttggctccacgtagacctagaggttgctttctcagtcccttgtccgccccatatccagctgccttggctcacagagtttgagactgtgctgtattttctgtcatgcttcagagtgtatcaaatcaacacaaatataaaataaagccataaagagaaggctgatattcaccatagaaaatgttggagggaaagacaaaaacactcaacgacaacttcacaaacaacccttattatggctgtggaagacacaatagtatgtgtaatgtggtgtttgggctgtatttgctgcttgggaatctggtgcattctgagatggagggaatgccaagtgtttagacaacatgctgcttggcgcctgcaggttcctggaaaggactggggtctccagatctaggctgccagccaggagtctcaggcagagacatgcattctaccgtttaaggcctttctagacttcagcagtgagcagatacaggagccctcaagaagctctgcaaaagcctaccaccactgagatccaggacataatatgcattcctaagcaggctgctgcctttggctgagtctatctgggggccttctctctgcaggagaggatgctaacagctactgttcctgaaggactcataagaagacttctgtgcacttccagcctcccacatgaagcttctggaagggctaacccggttcatttcatctacttgctgcctatgccaatcctatcccctcttcaaagcccagtttaagtctgaccttccccatgaaatcaccaaagcctttagtcttcatgacccctcctgcctctggcggtctcttgcacttgttgcctgagattctcttaagctcttttcatctgctgccttgttagttaaatttactctgagtgtgttttatcttgtttcctcagctggattgtctgcatcttgggggaagggaaagttcttataaatcctggttctgctcttgggccaggacatgcctggggcagcaggtgtgtcttccccacctagactgaggaattgtgtctcaggggctgggctggattccgcaggagggaggccagggctgccaagagcaggagagccagagaaaagaatcaaatggccttaaatttgatttaagtttcaaattgcttgaacccaggaggcggaggttgtagtgagccaaatcgcaccattgcactccagcctgggcgacaagagtgaaactccgtttgaaacaaacaaacaaaaaaacaaacaaacaaacaaacaaaaacaagcctggcaactgctgccaagtgtctcatccaaagaaggaagggggatcgaaaccaaagaattgtgaagtcacaggatcaacagtcaggcaagtggctaaggactcaggctatgaagggtcctctgccacggttaggaggtttctttgttgttttgtggtgctctttgtggtgtagaaacaggtcatttctctacaaggattcatgcaggttggacagttccatcatggtctgctcccaagcatggggcctgtagaagtaatgacttttcttctggtcccagtccacaaagagatcgtgatcccattccccttacctgtacaatgcaggggtgagactcaatcctttcttgagtcccagtaaatgacttgagagattgtgagcagaccaatatcttctgtaaatgactggatattccagggaatactttcaaaaagcatcttggacataaaaacttttttttttcataagcagtggaggcttggggtcaaaagctagaccattcctaaaggaaagtttgatagtttcttctttgggagtgaaaaccctatgcatttaagaacagaaaggaaagcttgcataggtctgaaaatggaaaataggcctatttcctttaagaatagtaaatttcaggccagatgcactggctcatgcctgtaatcccaggactttcggaggctgaggtgggcagatcacttgagatcaggagttcaagaccatcctggccaacatggcaaaaccttctctctactaaaaaatacaaaaattagctgggtgtggtggcacgtggctgtaattccagctactcgggaagctgaggcacaagaagcagaggttgcagtaagccaagagcaggccactgcactccagccagggagacagaaggagactctgtctcaaaacaaacaaacaaacaaacaaaaaaccaaaaaagaatggtaaattccaattaacaacaggagatggaacaaatggtggacagtgactgtcatcagagaagtaaatgctatgtctgcaaaaaagaggtgagggcacagtgatgcgtagagacccctggctttaattatcccatgccttggtgttactggtcctctggagatctacttaacaggaagtagtgagctatgtccccacaaaagcatcccagaggccatttctgagcaggatggcctgtgggagtcgagtggtcagttgccatggttagcagagatttcctgctgagaagtcgcccctatgtgtgcacatggacagtgttgggtagagcaatgctccttcaactttagtgtgtttaccatcacctggggatcttgttgagctacacgttctgatttcataggcctggagtggaacccaagactgtgtttctaactagcttccaggtgctgtccatattgcggggctgtggaccacattttgagtagcgtggtgtagtggacactggaggaagaagtgtagacctgagctctagccccagctcagccctgtgtgtggccctgggcaagtcactgacactctaagactcacaattatgtcaatcatagtgataaagggaaatgaactagaaagactctccctggttctatgatgcgatgtttctgttacagtcccacagagaatttagacctctaccttgttcttccttagagtagactgttggccctagagatgtgcccagtggtcatgtaacatggagatatgcttgattaattcactgtacatgggttgtttgaccagcttctacccagtgcctataagagtagataccagactctatttttatgtcatttgaaagacaagggtagaagagacagcagttcagtgacagttgcgccatcgccattactctaatggttcagaaatagcttcccctcttcccctgtggaatgtttagattcatacttttaacctgtagcattttcctacccttcctgtgtaggaagcaggtgcattggaccaccctaaaacaatgcgtaggcctcagacttctgaactcatttctctgagatgagatgtccagtttgttcactacaacaatagttgccagacctattacggttatgtaataggtttctttttttaaacaggtcttgaaaatgtatgcattattctttaggtaataaatgaaatttaaaagactgaaaataaatcagctttgcaaagtgggggctgaagcttttctactaactgaaccatcttttcttttttattcttgttactttttaaggagatgatggcaagtgatttctttttaacccattttaagggcccagttcatcttgtacaattcttgtgcaaagtctctactgagactttggcctgatgcaaaagaagaggcccttagagaataatgctgggcatggagtgtgattcaagaagttattatcgtgtgttctctgacacagggtggctcttgctccccaagggtccaacagagaggggcccaggcatgcagaatattacatgcctgccctgtttccccatcagagaaatgttttccaacagccattgtggttgtagtaaggaaaaacatgtctttctgcctggatatatcaactgagggatgaacggtgagagaatataattgtctaaggatgacaacaggatcaatttccctttgacactgtaggccaccacctctttgtctccataaaatttcattagcacttgaatttatcagattggcttagctgttgtgcattctgctctgtgtgcaacgggcccattgttctactctactttaactggttttctgatggatgtgtttatgatacctcctgctgggtattgtgcgtgacaactggggactcgataactaaacaatatctgaacgcagaatccctctgtccagggaggggctgaggaagtcacaacagttaatctgtagtaggacccatgtcctcccatctgcaggggatgctctgttggcttgcaaagtggaaagatctgggaggctgaggtctgatgtcgtcgtcatcggcagagcgaccttgctcctcatttgtgcgcacaggcactgaatggagggagccttgaatcatctgattttgctcctcattagtatttctccactgtgttctctgaccacactttcctcctcggtgcatgcaaagctattagcaatgcacacacgcggcacatctgtggagccattattgctgctggatagctgtgtttgtgtaaaatattgaacaccctgtgaagatttataatggtttcccgccctgtcctctatccaccccctcttctctatttaaagacatattaacatctctagctctacctggaggaaaaactctttgaagtgagactgcacgaagataaaatgccttctctgaaagcgtccctctagaatgagcatggaggccttctgagaggccagggaaccacctgaggcacaggggcaggatgtctctgctggaaggcctcaggcccctctctccctgctttctgtccctactgggagtcagctctcccaagcacaggctaagcacccttgtgaccacagttatctggcccttgtgagagcttgctggtgactttcctgagactggagtcccgaggcttttaacaatgtggatgtgccttggccaaaagacatcctctgggttccttaatacttgtcttcactcttctgttttgtcagtggagatgccagtagctgtaatttagtcttgggtgggagagagccagaggtcgaggagggggtggggaaattgtcatcctaacccagcatagaggacctggtttaaagaggcttaacagaccactggtcttaccagcagatgcacctggggcttcgagagtgacttgggcttagcttcttcaaagggtgctgaaatctctcaccacccctgctcaaccctcttgctgcccccaccccaatggagaggggcccaggcatgcagaatattgtattccaacgatgctagattcatgtgcatgatatggaagggtctggagggaagaggctgctggtgcctatggccctgaggaccagctttctccttcccccatgtccccaggccaccccacccagagcatgccctcggcacgcaacaagcggcatgttccaggttgttccagggccagagagagtgacatgaggcaatgtctgtggcaagcgaaaaatgtgtgctgagccttgggaggcgccgattggctggcagtgaggtaatgcaatgcagtccaaatgtggaagcagcagtaccagcatcgagggcgtgcctcctcggcaagcctgagtctcctgccagccatctgaaggacaaggcgccgaggggtgctgcagacctcatgcaggtggctggctcacatggcagggtctgggtggtagagatcagatggcaggatctgagttgtcatgtctgttctctgtccctgaacacaccaaatgccactacaattctgatctctgttcttcaatggggatctcttagtggggagggcaaagaagcttgaaaatgagggtctggacctcagaaccacttacccaggtcatggtgagtgatggtcaatacaactactcttgaggattaggatggttttctcagtaaccgatggcttccctttaatgatataaaccttctcagggtctttcctaagcacagttctagattcatatttgggccagaagtccacactcaatctccccattccagtccatttcctatgactttgtgtcattggcaatgtccgctacgaaggatggaggaattcaagaggccactgtgggctatgctttcttctctttaataagactcctgttccaggagaaaactggcctctcaaaaaaagtcttctgaggaatagcagctaccaggaatcacagttggttccccatgaacatttcagatcaattacataaataataactacctattgtcttctagtgtcagtaccacaggagtaactccacatctttgagttaataaataaatttacttacttattcaataaatattctggactctttacggcagttctgacaatgttctaaatgtataggctatggtggtgagcagaacaaagtccttggtctcatgaagctaacattgtaaagggagatacagacaaaaagcaagagagctaagaagaaaatgaaagaggataatgaaatacagggtggctagtgattgaggcaactgtagttgggtggtcagggatgacctctgtaaagaggtaacattttagctgagacatcagtgaagccaatatggccatgagaagttctaggagaaaactccctgctggccccagaaattaattacaatatgaagctttagggaaggccacagggttgaatacctaagaagaaatatcccagtggttaaggacaacttctgctttgccactcagagagaagcagagcttgtcattgagctagtacagtcctgtgcactcgtgggagtaaggtcgcctcctttccccaggcacacagtaactctgctggattgctgactcctggcagtgtcttgtagcaaggtagactggggggtggcagatgcaaactctccctaaagaggtatcatcctcagttatttccattcacccaaaccctttctttcctccaaatcacactggctatatatctgaatgttttctttgacccagatcctattcttggcttctgtagacattgtcttgtttgatccctataaaaatctgcaagatggatgctataatttgcatttgactaaggaggaaactgaggctgtaagagataaggcaactctcccaagatggctcttttggggagacgtagaattgaggtccaaactcctaagaaagatggaactttggccatctccattgaggatgaataactcatcaaactattcctgggaaagggggtggcagaggagagagagatattgagacaggctacatatcataatatcatgggttaaaccaacagcaattttagaccccaaggggacaattcgcatagctgcagacgtttttccttgtcacactggggatgggtggggagcgctactgacatctagtgggtagagacctgggatgaggttctaaatgttctacgacgcacatgacagtgccacagcaaagaattatttggccccagatgtcaatagtgctgaggttgagaaaccttcgattaaagtcttacagtgctcactgctctctgcttcctctgtcttccttctatggctgccctcggggttacttacacactggatctctagatacaggactaaagtcataatggaaatttaagattccatttggatgctgatttttttcccaagctctcttcactatttattaaatggttagtgaagggaggtggaaagcttgatctccaggcaagtgagtcccttggacgtggggtggggagggtgaagctctggtgtggtactgcatcagcctagtgggaggtgcttgttaaccctctgtgctgtggcttccccatctgtaaaatggaggtgaaaatacctcctcctgccacctctcaggtttgctgtgagaagtcagtgatgtgtaagtgctttcataaaagtactatatacgtgtgttattactaattcttatatcatgaataaaatgaaatcatcattctgcccctgacaacaccaatttgctgaaccattagaattctgtacattacagtcttaaagagccatagagagaactgtaagggacctcaagaggtcatgcggtagaaaatggccagtgagacacttgggaatgattaaagtgaggtgggaagacacatggcatcttattcagttactcaactctcctttgttcacttccttgcatcatcattgcctttaggagtaatataataactgcattaataaagttgttatcctcctcccacccctgccagagctctgagggcacagtctaaacagaataattaattaatgaaaatgaagagaaaatagctcaagtgatggctataggagatcaaatagcaaagagaaagctgcaaaaacgttcgttgttatttgacactgagtagtgcaaagagggctgggagagtcccaggatccctgatcaacagagagagagtatcctgggggtttcctctttactttttctttttctgctctgaaaggttaggaaagatcctgagggcataatctgaccatctgatccaggccagcatactgctggagaagactgtgtcggggatgaggtggtctgagaagctggaataaatgcaggatcagctgataaggagggtgaggaaaaggtgagcttagtgtctgactttaaaaatatgtagatgagctccctaaataaaatacccctccacactgtactgatgactgaaattcctttaagagaaaatattttcgttctacaattaaagatagaatcctattttttccagggagaagtaatattgtcttaaatttatcctacattactacatgttgattacaaaaactgaagaatctattttctttgttttttttccagtttttatctccatccccatcttgcatcttacaaaggacccaatagaagcttcatggggtacaggaaagaatatagcaaggaccttggaggcctcaggcctcaatctggctctgccattcaatagtttgaccttggagagcaatcagaattctcagggccttagatcctctgcccgtgaagctgaggtattggactggatatctccaagggccctactaacaataagattatggactggggatggcttttcttctttccattttgttcaaggaagcctcctcttcgtcatttctcacctaccacccagctctgtattttcccatatttcaatgtcctttcatgaagacatataaacagtggccatgagtcaaggggatgcaagggtatctgtggttcaagaagatgcacgtgatgaccacggctagttgatccctcttggcatattgttgccatctcagaaagacaggaagggtgggttacagctgccagcaccatcaggattaaaagcaggaggactttaagactcaccctcgatgatgcagaactcaaaaggtctctgcttcacagctctgggccaccttgaagggcaagttgacaaaataaagcaaagcccagacagccttacagagtagtagattctgcattcctcattttcatggataattactgtagccttcaatttgaggaacatggcagtgatttgtgtgcagtttactcttctttcaggtgatggaaccagagccagaggcgtggatgtgactctgttgccctctagtggctagaatgcagtagcatacccagcaccccctcagacttggcttggtggtgccgctgacacgtgagcaagggttcctgggacactgactgccaagggggctcgggattctttcagcacaactcctgacctgagattctgcagagagagagagagagggagggagggaaagagcatcatccttcctatttctggaagtcagatctgtaacacagagggcctgtttcgtctagagtaaccctgtaccagctgcagcgctgggacgctcctgcctcttctgcggtcgcatgtccatgttttggggcagctaaggcacctggggtctgctctcgcagtcacacatttgctgtgtcacttctgcctcagttagatgttttctctagcaaacagatatcattatgtggttttccaattatcacttcccaaagggagctggttaatatggatgaggctttttaacatttggctttgaagacagggttatatgtagttgtagcagagggagccaatatctcggtaattggctaaggtttgcagaggagcaaggcagtctggggtatgtgccatctctgggacgcggggtctttgcagaatgtgttattgtggtgtagtctttaagtgagttctcagataaactggaaggtgggtctaggtggagattatttcaagaaggttagaactctggtctctggttacaataaaaaagctggattgctgaagatcatatgggcattgttgatgttgggctcaggcagagagttcttagtagggtcttcttaccctgacggttgccctttgtaacaggcaataatacaagaggattaatttatggagaggctgaagaggttagtggaatgagaagagatgcagcatgcagggacaaaactcagtttactatatcagcttcttttaccctttgggacaagaatccccaatttactgggcaaaacttccctccttctacttcctcttccaagagtttaactcatggaaaggaaatgaggggaaatagcacatttcatggcatcgaagagggcatctttgaaacctagcggctttccacctacagacatttagaatgcaacttatgctggcaaagctattgagggtttaaatgatatgctttatagcgtgttgcatttcttcctttgaaaatgaggagcttgaattacctttcttgcttcataatagaaatttagtcttatttctcagtctatagttaacacatagcaatctggtgccttcgagtgacaatttacctaaaagtcagcgttacatagatagttctacaaaatccaaacttacatgctttgtctgtacacttcttggtcttccaaccttcaggatcaccattgattccttttcctgtacccctccaacccctgacactgttaaactccatttcagtagtcattcacccagtcctgcagattttttgtccctacagcctaacattagttttcaaccagatcactctttttttacactattcaaaaatttctttagctttaaaagccctcatgagccaaagtgccagagatacttgtggtgttctaaagtatttgctgggacagggttaaatggatagggaaaaaaagaaataataggagggaaaagggtcccatgaaaagcttgctgcctggtggtggggaagatggagtaccaccagctatcattataggctgggccaggtgataggcagaataaagtgacttaagaaatttctggaagcacttcactgcactgcaagtcatgccactcttcctcagctcacagttggcagaagcaccactataaactgggttcagccacgtgtcccttagacacataagagagggagtgccaattgggaggacaggtgaccgaggggggcagagggacacattcatttattacccagttttgtcctggattgatgctggtcttgggtatccgacagtggaaccactctagtacctgacacacctactcttgacccagctttttcactcccaatttggttgttatacagcaccacaaatagggaaagatggctgggactttgaagagaacaggtggctcctatcagctggtgctaaaagagccccaccttatagatatgtatcttacactcatatgaccttccctactacaatactgtcataaagtcaaaaatgtgtgtctcttgtccctttgggctcccccagctccatttaataccgttcccaatgtttgtacctaattacagatttgaggagtcataaaaccacatctcccaagaggtagatctgctttattttggcttctgtgacacctgattgtcctctttcttcattcacctttaatgatttgcttccttttgttgcttatcaaggacttgtgctcctgaaggttctgtccttgactcccttgtcttcccccaacattatctttctggacaatctctaccaccttaatgttaatgagcctcaactccaaattggcagcccagatcaccctccagggctctggacatgtgtccccagctttctattagacatctctacctacttgtcccacaagaacctcaaacaacaaacatctaaacctgaatttatcctctgctccacaaaagtcacttctctatttctcattagaagtatagaaatggaagaatgaaaaacttccatccattctatcacttggtattaacctagaccttttccccttgctcaaccccatctctccttttgccttttaccacgaatctgtcaccagatcttacaattctacttctcaaatatctttccagacagactcttcctctccatgtctactttactgccctagttcagggtttcatcaccttgatctggcctttgatatctgcctccatgtgtccaggacctgcatgctaatccctgaaagaaaacctggatacagttttgcagctgaattttattttaatgaaatctgcattcttgtggataaccttccaacacactacttcagtaatatcactgactgtagcaataataataatatcagtgactataacaaaaacttttggcttaaaaaaaaatccatttgcaatgacttcactttccgaagttctcaactgatacccagagccattctttttggtcatatgccaattttgtgagtaaaatatagggtttctttatgaccatacatttcctatgatggcgagcttatgagggtggtccttcatgcaagtttctcatctttctatagcctgaaaagtactgattctttttttttttttgagatggaatctcactgtgttgcccaggctggagtgcagtggcatgatctcggctcactgcaagctccgtctcctgggttcacgccattctcctgcctcagcctcccaagtagctgggactacaggtacccgccaccacgcccggctaattttttgtatatttttagtagacacagggtttcaccatgttagccaggatggtctctatctcctgacctcgtgatccacccacctcggcctcccaaagtgctgggattacaggtgtgagccactgtgcctggccttgattctttgaaaatgaactctttttggcaccctcatcttctgccatcttggtccattttgcttatcagagtaaatacaactggtaaaaaggtttatgctatttattctccctccagtcttggttcataacatgctcagttaaatttctccctcattgagtgtctcctcaaagataaatattttaccttggaaagtctggtcatttctaaggttaggaaaatgctatcagtcactttggagttgattgcctatgtcaggttggcattcttggatgaactacaggtttaagatttgctgttctgcatgcatcactgtgaagtcatctgagatgggcgctgacctgtagctcacaaggagtttcaaggtcttctatcatcctcctttcaaacactcacagtgattaattctccagaaatcactactggtgctatcaccttcagaaaacaattttctttctgaatacatgtagggtatataggcttctctggtttggtttgcatttcacattagcctttttttttttttttttttttaaattccaaggaactctaccttcaaaagcaagcaaagcattctcctcccaggtggcccatgtactggattttggagtctgaattgttatttcctcactcctgccttcctctcttcttggctttctttctagggcacctgacgtccttccttattactgatggcagcagagactgaacccctgggagaggaaagtgaactgagtaattgttttgccttttcatgtctgatgtatcactctgggtcagtgtagctttagttgaaagagtaatgttgttacccaggagcagctgtagtgtctccagacaactccaagacctctccagtcccgcagaggtcagtttctggtctgggcataatggtcttttttccaggggttgaagcccagctagaagcaaattcctactctgatttctcaagactctgaacacccacaccggcccatgagggcagagagtggtggctggctttctaaaccagccttgtgtcttcagagtccttgatcagagataacttggggaaagctgtgtctcataaatccactttgctactgggtcagagagatgccttgagaatgaccttagctagggaagggatggaatattggtttccctttgtcccctgcccttcagttcatggcatagggttaagagagtgtcaggagcctgcaggcctgttctgtgcttagcgtggggagacatggcagcaagttggcaagctggggtcttcttattccaaattcaaccatttcttggcactttttttgtttctttttctgagaggtagtagacagtggagctaaataaaattttctcccaagaaaaaatggttagaagcagcgtgtcccctgcccaggcctgaaatctcttcattccctttccctttccccagggttcccaaaggtcttctgcattgcccacctgctgctctctttcctgccctgtttgttttgatggcattaaaaggcctgcctgcctactttacaaggaccctcatttctttacccatcatgttttgatatattttttcttgctttttcttgaggtttgcaatcaagagccctttaactgaaatcctgggctgcctgcagcagctgtggggttcccagccaactgccttgtcctctgagggataaattccctttgaccgtgccacttgtgaaaacacagagcaagtgtagagtattttacatataatttagaaagagagaggacttatcggtgggtggtaggaaaggacagaagatggattaatattttttctttatcacttggcatgttaaacttaattatatttcttgaaagacctctaaacagttataattagaaattatgataatagctgcggttgccttacacatgttcattttactgcttgcttctttgtgaatgtgggctgtgattaataaataaccaccaacatcattaggacaagacctctccttgcctgctgggacccctttgactttggatggacagtgtcaaggatcaggagcacctagactagccccatgagccatggccttcataggctagatggtcattggaaatgaagttgttggcaccgacagtcacagttatgaaaataagaatttggatctcagatttttctgctccctcttctcctgtgtattagtccgttcttatgctgctaataaagacatacccgagactgagtaatttataaaggaaagaggtttaatggactcacagttccacttggctagggaggcctcacaatcacgacggaagatgaaggaagagcaaagggatgtcttacacggaggcaggctagagagaattagagccaagtgaaagaggaaacccattataaaatcatcagatcttgtgagacttattcactaccacaagaacagtatgagggaaactgcctccataattcaattatctcctaccgggtttctctcacaacacttgggaattatgggagctacaattcaagatgagatttgggtggggacacagccaaaccatgtcatcctctcttggtcatttgttttttttttttttgatttacaagtatcgtttattcactcacttatttttgtgcagggatgacaagagagtcacaggaatatccctaaatacttacggtatcattgtaaagagaaataacccaagaagagagtgaaaaaagaacctcctaaccaagggctgcagttgagtactaactactctgtggtgagaaataggaaatttagtattaagttaaagcaaaatcctttttaacatttctgaggtctattctcatgttgattataaatgggaaaagtgagaattagcttacttctaacctagctgcctgtttggccctgcaaaggattttagagatccccttcattctgtttattttatggaagaggaatttgagtctggaggagttaagacattgactgggcaaagaggcccaaccactcatgttcagacctccctgtgagatgccatataagaatatcaagagaaaaccttttaccctctaggctgttcaaccttagaaattcataagagcccccttagtagtcaattatgaatgataacaataaagatccatgttcaaagtattgaaagcactgtttcaataactttcttacagcatgggtgtatgacagaccagagactaaatacggagtcctaattctcaagacagtctcaaaggatattcaagatcaaatttagaaaatatattgtcagaagcctgttccccagagtcacattcaaagatttttctcagagaaattttcctaaaggcatgattctaaagagatctagtacaaggcaaaggatttcgattttttttcccctactacttcctcatctccaccccacaagttgacctggagtcatctttggtccttttgagttttaagtcatcatcttccctcaggctcaagaggaagcctgctgtattttgatgagacaactcacctttgatgtcacagttttcactcttcaagaacaaggagtcattagtatcttgacatctaactgtataagttaaagcacttcctggaagctcaaagggaaacactgaactcttaacacacagattctgctggaagtaaatgactctgccctataaaaggaggagaaagaaattctatttgagtaatgccgttgaaatattaaaagaaattcagagggaaaaatatccaagtgaataatatatattggatctctggcctctaatttgacattcaggtcagatcaaaactaaccctgtgagattctggaatttaatgtcatataaaaatgctactgggcaaggaactttattacacatgatcataaaaatatatgggaggcgccatctctgggtatttttctatcaaatctttactcattttacagtctttacaaacagaagccagaagtgctatatttgaacatctacatttgttgggatttctttaaaaaaaataaaacaaaaagaagaatcacattttatacgtgttaaatggtgtagtagtaaaccatgtttaaaaaagcttcagttttcattggtgtacaaagctgctacatgtaaatattggaaccactttttaaaagaggattgctgcagtcagattttttaaaataataaaataatcacaaagttcaacatatggtgtcttcatgtgattataagtgtgcgagtgtgtatacatgtttttaattccttaggattagcagaatgacaaaatgtgtgaagaaggatagatgatggttatttcaagcagcacaagaatttgaggaggaggtggagactaagaagagagaggaaaaaaagatcaagcaggacaagggacatgggtacaagactagaagaaaagctggatttctttaaactagaaaaatcaaagacatctgttccccttatggcaataaccacatttttctagaaatttacacattaacatctaaaaatggatttgtgctaaaaatacaagctatgctcaatgcatgactcttgaatgactttcccctatgattcctctgtagtcatatggcaaggccatgccctcatctgacattttttttagtcaggaaataccaacttcagttttctttgatcatgtgatttccttggcctggaaactcttctctgtctttccccctaaccaactcttactcattcttctagactaactcagctctttaatcactgagaaaaccttccctgcctatctttgtcccttccttagttttactgaatttgcctgccctgtactctgatagcacattgtatttaaataaacacttacggtctctcccgctaggctgtgaacttcttaagtgaaaagccatgttttattgaaatctatatttctggaacctaacacagtgtcctagatgctcgataaatatgttttggactaaaatatgctgctagtttaatgctccagttcctgatgaagccagggctttctttcccaggagacagtcaactcagggggcatgtttggtttagtacctgccagcgtgttgttgacaaacaccatatactctctgttgcaaagccaaaacatgaccttttccacaaatggagtaagcgtttattggggaataaaaaagtatgatgattgtttttaagtaacgtataaacctaagtgtctcaatagaaattgtgagaaatatttatttactgcgagagaaacattttccttaagctttcattgttttaggtagtcttcgttttcctgttccccatcctcctaggttgaattccctgattctggctggcatgctcataatttctatgatcacagccccattgtctgttggagctgagggcattgtaagtttttgtaagcagcctttgataagttttagaggtgtagagaaagagctctgtctcctccctgggagaatactcctttccctacacctcagaggaccaaatcatgtctttattaatatgaagcattcattccagtggcatattttattcattacaagaggatcagtagtttgagcaatcagagatgaattctaatatatggaatcctttcccgctgagcttccatgaaagcatttgatcctttttggcctgccccctttgagctggctcctttattaatcctaaaggaccaaggtgtaagaactcaggcaggacaactgtctctttaggcaaacccaggctttgatccgcttccctgacacagtgatctcacctcctttggctcagtcctctccttcgtcattggcccagctatgagtctggaagtccccacagtgccttctttgggtcaatactattatcgtgcacctgctatttgcctggtgctgtgctagagactcaggatacagatgtgtagagggaagagtgtttattcttgtgaccttatcatggagagctttcagatgagatttattcctaccaaatttattatttgagtgaaactgaacagttccattctgataagtaagggaagaaccaggcatactatgttgctattctccacgatctgtgttaaggtttctgtggatgtgtgtgtgtgtctacttaaagaaatggcagtctatccctcttacatcctcagatattcacagagcccctcagtgacattttttggcctaggctttttaacattctagagtagaagagttgactggtaggaacatttctaagtgctcttttgcaccataaagcaagaggagtgtagctgttaggggaacttgagaagttggttagtgtgtaagtgatgtgagaaaattctaagttttccagtttaaaaatggagacaggagggaaatggccctttgttaagaaaataatgttaaggtattaagaaaacaatattaaggtataaagaaaaccagagacatgaaacagaagttggactctgagagtcttggcggagatggtggtagttttagcctgcataggtctgggataggagtcacttgctgtccactggcatcagaggacacaacggagtctttgatgtgggtctgaaatgttacaacttcccacccccacttaaggatgcttggatggagaataagagatgtcagttgtgttctgaaaaccctaacctagatataccttcagccaaaagagagacatgctaccatggttatcatccaaagccactctgtagaatatagcccaaacatcactgtgtattaaaacatttctctttactgttttcacataaatagattaatttatacagatttgtatttatttacatatttgtgtatatgctgcactaaatcctcactagtgggacattgtttaggaatcctggtacagggtgtagtaccaacaaggaaaaccttcttattaagctcagtgtcacttgatccattatatttaatgccaggaagggtatatatacagatttagaaattaccttatttctttgtcgactgagatgggtaatctactcaataaccatttaatgacaatgcacaatgttccaggatgcagaattgaatagcctagcctgggtcgctcccctctgagaagattacagtgtaatatgataattattaccatagtgctacccctggggcagaggacactcagagaaggggtatctgatttagacatggggatcactacagctgcctggaggagaggaagcttaaactgtgttgggaagtgtgagtaggacacagattggtaaggtgggggtggagaggtattccagaaaaagggctgggcatagggaggcttgtagcaatctacaatatttgggaagctatgggtgggttaatactacgggcattaagtatgctttgggagggagtgaatggggataggattcagggcacagctgggccaggtcacgaagtaaataagatcagaaagactttgaatagctcagtcaggatggagattcatcttgaaactaatagctggagaccttgattgacttgagaaggaagagaatcatgtgatcctatttacacgtggaaagatcatgctagctgtcatttggaggaggaagtagttaagggcagggtagagataggcagatatcatgagataacctccatgaaaaaaaaaagggtgaggtggcacaggtgaaagtaaacttaggaaagtaaagccaggattctaatgaaagatgttattaattaaacttactgtttaggaggatgatggagaaacccaggtcctggcaaaaacggtcacactactttaaagtttgggactaagaaggaaatgaataggatatcatgaaagtaggctctgtgattttcttagtttgtagggagatggtagaacttagtggttaagcacttgagctttgagctctgaaagatgtgagtggattcctggcctgatctcatactagctgcatgaccttggttgaccttcagcattctcatctgttgaatggggtaataataatatatgactccaggagttcttgtgagaatttaatcagaaagtacatgttaaatactttttggcacctagtaagtgttcaataaattaccactttgcttatttttataattggtaattaaaagccagcaaaagtatgcttgtagtggaaaaggcactacaggcacaagtactaatggggcttgggctgccaggaaaataccctgtgatctccttctgatacctggcacacaattttcagggatcttggaaaacgtttacctcatatgcaagtccatgcatggtaccagcaaacagggatccttgaagaagtgaattcacagctgtctttaccttctactatgtaacagaatgtgagatagagagaaggagagggaggagagagggagggagagagagagagagagaggagagagagaaagaaagtgacaaattagattatggaatggaaagttacatttgggaaggtgaagagttttgtcaagtatcttagcctttcttagcctcattttaaaatgatgttggactaagtccagctgcaaactgacagcccatgcaactagcacgtggaaatattttaaaaagctgagccaacgtttaaaaattggaaatttgtcaattgaggtagcttcttccataataagttcatttttattatttattcaaagctaaataattttattcaaaaatagatttctggattctgttgaaaaatcctaagatctggccaaccaggctcctgctcttccaagggcgtaagcattgctgccccttttgggcaaagaatcaggtttctaggtcctcaaggctcatcacttggggtgtgtgctggtctctcatgccaggtccccttctcttatttgcaaactgtctctgtttgatattaaaatttgtaatggggaaacactcactggtttctaaaaccctatgtagatttaagtagttgatgattctgtgaaaaaaccaaataccttctagagaaaacatacaggttgggcagagcccaggtattgatgtccttgatgaaactggtttttgtattctgaatgttggagattgagagatccaaagccattctctaaggttgacaccaaggtgcaggtgaaaccatggggggcaggtgtggggagaaagggaaggagttgaaggaagaaatctacaattactcggaactccacatccactcagctgctgtagaatatgagttgagaggaaatgcagaggagaatctgctgcataggaccactggaatatagattgtgttttggaaatgactgatttatcaggtggaagcagagaatgataagccagctccatgctgttctctcctttgtcatgttcccctgcccctggcccttggccttcctctcacttccctccctgacaccccaactccatgcagcatttgctccccctccacccaactcctccttgctttcctggcaggttcaccaagaaacaaccgggcctccatggcaacgtgaagacagctgaaaaatggcagctaaatgcagctgcccctcatttaatatcgactctggcactgacagaacagataatgggcaataacacaccattatgttgtgggaaaatgaaatgcttcagcagaaggctgtcatgctggggggatttatttgttactgtaccagcaccagtttctatttacttcccttccgttctttttgttccctcatttccatgccagtttctccctcctcctggtttctctcccattcctcccttctatagcttctcttttttgtacttcctttccctcctcttttttttttttccttctctctgaatcacttatggatataccagaaagcatacatatataatgcaattatttgcatgatgacttacaagttccaaagcacattcaaatacattgctttttcatttggagggtgaggcaaccctatgaagacaggtagggcctagacactgatgtttattttgcagatttttaaaggggctcagagaagttgaacccaagatcaggcaagtaagtgtcagcagctgcattgcaagtcagattttctagcccctagacaggactctttcctttctacgacatgaaaaacttcagagtcaccaatttctacccactttactagcaccctatcttcttactgaataatctgcaggtgcagagaaagtcttctaggctttgagacttcagaaggtctttagatctttacttatattgccagtcacttacagattcttccagacaagtgcctttgaattgttgataagattggtttatttttgttttcatttttactctttaaacccaagacgtctatctgctcattacctcctattgcatcattatataatcatgaaatcttggtatgcagaagggcgtggtgtgctctttgacttgaaagtgggggcattttggtggccaacagctttctgttttgcaaaagaccgtggtacattgaggtccagaggacatcactgatggacttggcatgaggaaaacccttctctaagttgttgctgtagtttaaacttgctttcttacatcctgttggttggattgtcatagcaccctcatcttctgttgaaatatcatttagtagactctaaattctggaaagatctgagatcaagtttcttagttctttgggtcttgaaaggattacaaatggagtgagaatggctattgcaaacatgttttcatttctagttatggctggtgagggaagaactaaatgtcaaaaaatatatgtgtacatctgtagaaggtacagtatgagtaatgaatatagtggttttcaatcatatgaaagaatgatttatattgataaagagatcaatgtttgtacttcccagcaaatattttttaacctgggatctctgagccccttgaaaacatgtgcaaaattttgtatggataaggcaatgcagtgcagtgtttcaacccactgatgttgaacatactgaccaggattttggctctgccacttgccagatttgtagctttagaaaaattacttacactcttcagggcttagatttttgaactagtctggtactcagttgagatttgctattctgtattgtttcttttctgtctgtaatgctttgttctcattcctgcatactgaaactcttcctgcaggtttttctctctggcagccatccccagttttagctgtggaaactcaagtaggcctctaacaaaatgttctgtggtggtgagaaagctaaggaaaaccagctgctaaaattacagcaagtctctggttgctgttgcttggtttctttccctgtatagttatttcccgtgcatggttcctcaaagtgaaatgaaccttagtgtcatatcacataatcatggaatgttagaactggcaggaaccagagatgattccatttctgtggtctgccagttcaaatccttgctgtgtagaaagcaagtccttgaccaaaggcctgccttgccaatcagcctccttgctattaatatattgtccctctgactcctttaacttgtttaattgcgctaagttcttaagtggatttactgccattccttatccagatctgaggctgtatgatataaagataactagtgtttgtttagtatttatgccattttagtagttatattttattcttaaaaagtaaaagtgactggttcaggaaataagtactctcaggattgagacatatttttacatgtttcattattttgataaattttaaaattagattttgtattaagaagactgttcagaaattatccccattatctcatttttattcattattcaaagaaatgtaagaaaataataagccctttatctagctattggaattttggaacttccgaggcaactgtgaatctcaagttagccagagaaaagggggcacagagtctttaagcaagaggagaaaactgtctcacaaccatagtttttttttttttttttttttttttcccttggaaaggaatagagctagccagaggacttagggtctagtttccataccaggtgggagggttagagacagcaagtgaaattggtggagaactttggaagttgtcaaatcttcattgagtgagaaaaataaagccgggacagaagtaccccaaggaagaccacagaaggaaatcctaacagaacatacatagctcaggagaccagaatcttttaggtcaaaagcaacaacctcaagagaacttaagaaaaccaagtgcattcttaaaccagaaaagtacactcagaaatcacggagaactcaagcaaaggactttcaggcaccaacctctcttacaagctctattatagcaccagtgaaataattgatattcatgaagatcatacaattttagactctttgggttggttgtagcttagagattatctagttcagggctgctcaaggtgtttcctgcacatcagtgccgtccaagagctgtttgttactaatccataaggatataaatatggaaactgagagtaagcatttaagcacttttgtagtaattccatgtgtgggaacacacaggtgagggagagtggactggtctcattcaagagggtgtcaaacagttcagcattttaaaacttacttggtgagtcatatgtggcatgagctggtagttcttcacagtagggcatgtattgatctgaaaggatggaaaaatctaaaaaacaaaataaaacaaaattggctgtttactaaaaagatcttgtgaagccccaatctagtgaaaaagcctacttttacatatgaaaagatagatgatttatccaagaaaatataaaaagatgatggcagaacccagaatatgggattaataacattttattaattaagcaaattatgcccaacatactctgcttcttaaaataggcaaagcatgcaacacattgtagaattaaaaaaaaaaaaagacaaacatttgagacctgtgggctcttaaaggttgaatcattcctccatggacttcacatttcaaataagattttgctatatatacacatacaactgtatcaccccacagaaaacatattttgcacttgaagtttgttgatctcttggggcattattttgtttctgggaattcttaaagaatataaggctatgctggatggcaattttctgggtcaattgtgcccaaggcactccctacagcaaattaggtaatgaaacaactcttgtgggcccttatgatgcaatttagggcactatagtggtaatagactagctgggggctcagcagctagtggaactctagggacctcaaagcatgactaagccttcttcagtgcccagttttctgccgtgggatggtgttaggcccgggaagaacagagcctaaatgcacccctctacccacttccaccgggatcttgacgaaggtagggatgctcctcgtatttccatggttagattaggctaattgtcccttacaagttgaggttttgaaacaactggaagtggatagaatcacaatggtcatattaccatgataataacaatatcttacatgtataccattgaacttttatctcattaggtcctcactatagtctcactataggccaagcagctacttttagctgctttgtaataagtaagccaaataaaggctcaaagattgaacagatttattgattttacccctcagttaaaactaagatccagggccgggcgcggtggctcacgcctataatcccagcactttgggaggccgaggtgggtggatcacgagttcaggagatcgaaaccatcctagctaacacggtgaaaccccatctctactgaaaatacaaaaaaaaaaaaaaaaattagtctgttgtggtggcgggtgcctgtagtcccagctacttgggaggctgaggcaggagaatggcgtgaacccgggaggtggagcttgcagtgagctgagatcgcaccactgcacttcagcctgggcgacagtgtgagactccatctcaaaaacaacaacaacaacaataaccaaaaaaactaagatccaggatgggtacagtggctcaggcctgtgatcccagcactttgggaggccaaagtgggaggattgcttgaggccaggagtttaggaccagcctggacaacatggtgagacacagtctctacccccaaaaaaaacaaaacaattagttggatgtgggcatagtggcatatgcctgtagtcctaactactcaggagactgaggtgggagactaaggcaggaggatcactggagaccaggagtttaaggctgaagtaagctatgattaaatcactatactccagcctgggtgacaaagcaagatcatctccaaacaaaacaaaacaaatcaacaaaaccctcagattcatccccatgtctccatctctactgtcactatccaagtccgtgccgccatcactcatcacctgcataactgcagaagcctaccaatagtctccctgactcactcagctcctccagtggattatttacatagcagccagagtgatctttttaaagtataaatcataccctgtctctctaagcttaaaaccctttaatggtttccatttttcttaggataaagtccaaacttcttggcaaggtttgcaaagcccagcaggtagcacttggccacctctgcaacttcctcttacactgctctcttgttactcttggtgcatttgccccattagccttcaaattcatcaagctcttttctgctctccctcccctcccaaaggctaactcgtactcatttgcaggtttccgtttaaaccctgcttcttcaagagcttccttaattcttcatctaaattagctccttctactttctctttcctcttattccaccctgatcttgtctccacggagtttttagcacgattcaaagttacgtccatctgtaggcttttctttgtttgagggccgtctccctcactacaatgcaagattgatgaggacaagccctatgcagctttgttcaccagtgaatattcacacatagctctctgcttcagagttctcttgctataaatatgtgataaataaaaaatgagggaatgataggcccaagagggcacagatgggcaagggtgatgtgagataatgcactctgcttctgaaataattcctaattacctttggttttgttcttaaaacacaactggagttcttagaagaaatatgcaatctggcatatagtaagggctcaataaatgtttgaatacatgaattaatatgtaatgaaagaatgaatgccatcgttacaaattagctgagttctccatgtgtttgtaatattaggatattactgtccccaagttgcattatcgacttcctggctttcagtgggcccagtgtccccacatgcctgctcaccccccactgcactaacctaaataatctctgattattttctttttctcttgctactaccaaattctgttctgagtgaggaagcagcttggttaaaaaacaaaagccctgatatgtatatatattttttttcctgaagaataccatcaggatgaaggctatgattaatacacataattgctacaaatggcagctaactgcagaaaaccacctcccagctgttggaggaaggaaattgctgacagccactccccattgggtggctaccaaaagagaggagctcacaggagcaggagagaatacacatctccatcccacgtgacccatagagatgacccatagggctctgtcttacatgtgagctttgccataaaatggtagtgttaagagtttttagggctggggtttacagccaggctttccatggctggggctggttttataggacatgctgtcctgcagaatgaacatttagaatccctgtggcccagttggtattactgcaaaacccaggttgaatcccttcaggaggagacagatgattcttggctggtcagatttcttctctcatcctttccttgttcatttgccctattctaatgggatggggaatgcacaaacaaggaagaagctctgggttgcttcttggagtctgctttgtgacctgagctcgacccttcactttcctgggcctcagtctcttcagtctataatgtgaggtgttagactagaagatcactgtttccttaattttaagcatctgtgttacaaaacatacgtacaaagtatgtgtacatatcatattaaaatgtatataaagttatatctatatctgtctatctatcatctattctctagtttctattagcttggtgcaaaagtaattgcggtttttgccattgaaagtaatggcaaaaaccgcaattacttttgcaccaactttgtatcaattatcacctatttatctttcaacgattattcatcatctatccatccacctatctatctatttatcaatcaatcattcttatgtatctccatacccccatcttctctgtctactgttttacagttagcacccgaaaagttatttgtacttgtgttagtgttaacatgtgtctggcttaactagtcccttgttcaggtgcaggaatttatcaacatataaatcagaagacaaaaaacttcaagcctaacacacttaatgcacataagcttctccaggccaccacttacagagttgtgctatacctttttttttttttttgatgtggcaaaaacaaaacaactcagcagctaaacagatgaaaagccaagctgtgggctaaggtatgtatttgatgaagctctctcttctctagatctttagtgggaagagttttgccacttgacacatatttaccccgcaaacctacactggcaatgctaaggcagtgagcacagaacacaggcctgaagtgtgctggaagttagctgaagggcaatgtcagcgcaccagctttgaaattacatgcagcgcagtcaccgtccctctggaaaactgtgcattctgtgaatgctgactctggaagtgcacacgctgagcatcagggctggaaaacagctgagagagaatgttctcccaggagaacaaaccttagcgagcttcctccatgtgttctgtacatctgcatcatctcatttcatcttcaaacaatccatgaagtaatgcagtcttctttatatggtaggaaaactgaggatcagaaaaattaactgattttattcaaggataccctgttagttgcagccactggtggtaacattttttagtgctttggtgccaaaaaagaaaaaaagaaatttttgtgctccaaataaaagaggacttctgtagaaattaaaataaggcattattagaactttaggaattttgcttctttctttgtcctctgattattcctgtgactttatgtatgaccccttaatgcaatggctgtgttctaccagttgatttggacatgtacatagttgaccttcaaacccattactgttgcatccgagactatccccttgaggagttccatcagggagggaggagcatcgtctagaagtcagaagtctttgcctgctgttagtattctccacagagctcctcctctccctcagttgagggtcacaggatgttagagaaatcaaaagccactggacatcagggaaagattgaggagcctgttacctgtcaccttttcatttagacggccttgcttctaaaattatattctgaattttccatttattcttgctgctatagactgaatgtttttccccctcccacacccactgttcatatgttgaagccctaatccccaatgtgatggtatttgaggtaggtagggaggtaattaggtttagatgaggacatggggatagagcccccttatgggataagaaaatgattataagaagagtgctcgatatggttaagctttgtgtcccacccgaatctcatcttgaattgagattcccataatccccataatccccatgtgtcaagggagagaccaggtggaggtaattgaatcatgggggttgctccctcatactgctcttgtgatagtgagtgagttctaatgagatctgatggttttataaggggctcttgccctctttgcttggcatttctccttcctggcgccttgcaaagagggtgccttgcttcctctttgccttccaccatgattgtaaatttcctgaggtttcccaagccatgctgaaatgtgagtcaattaaacctctttcctttataaattacccagcctcaggtagttctttacagcagtagaaaaatggactaatataatgcccttagaacaagaggaagagacaagagtcttccctttttctcggccatgtgaggacacaggaagaagatggccatctacaaatcagaaagagggcactcaccaggcaccgaatctgccagcactttgatcttggacttcctagcctccagaactgtgcaaaataaatgttggctgcttaagtcacccagtctatggtattttgttacagcagcccaaactggctaagatactgtcttgtaggtgaaacagggctaggagttattttacaggcataaagttacctgtttttacactcttgagaatcaattagtgggttggtatactaatggtagggtctaaaaaaagaagaaaaacaccaaatgcatttgaagcgattccaactttgggacactttttattatttcagacaaatgcagatagaatgtttactgaggtgtctccctggccctttatgtaatatttggatagcgcaatccttagctgcatgcagataatgtgttaggcagctagaaaaataacctgcttgtactgtttctgatttattccccctcctccctcacgtctttgttcacagtaaacacatcactgcagagtagctagcaaatgaatgcctttttatcagaggtacatgcccagttggtggctacgaccacatagaacagcagatatggccaaagggggaatcactgacaaaacaggcagaccctcacccagagtggatggtgtttcttggcatctgagaatcagaatatagaggaagatgaaagcactgtcgtgtttacggtgctggaaattatattgaaactcaagtaaaataatgatgctgctgctgctgatgatgatttgttgagtgtttactataggctctgatctggcatgctttccatgtataatttcatttatactttactacaacctcaggtgagagctacagttattatattattatacctattttataggtgaggaaaccgagacatagagagtttaaataacttgcccagtgtcacataggttaagaaccaggatcaagataagagctttcctcaactacccaggaaggaccaaacaagttaagagtctccagaatttgagaggaggaattatgattctggaagttccaatctttctctccagcttcagaaggatcaaccaatattttaaaggaatgtttaatccttgtggtatgagctgttggggtaagaaagaatatgggctggggtgaagattgaatatgagccaagttcagtctcattacaggactaggaagacagagaaataccaagatctagagcattgagggatattttgatgaagctctgttggctcttgcatggtccacatgaatgcaaagcattcattttttttctagatgagaggcacaaagaaataagacagcatttttcttttttcagtaaaatccctttagttttgactgcactaattctgtattttcctaatttagtcatgttaagctaaaatttacctttataccatgtaggttgagaggaggatttataaaacaaaaagagaaagtggtcagcctattctatcggatcaaatcagtaaattactaccaatcttcactacttcaggacaattattttattcaaataacaaatacactaattacaaatgaatgtccatttttaaatcacttgcaagagtcccacacacatttaacagagtggttttcttttctttaccttatgttcttggagataataaatcaacatttccctcagaaagcatttgttaattttttattcaatcataccaatcttttgcccaattaggaggcattagtgtaattttttcccattaaattgtacataagtactgtcgtccttgtttgaataattaactttcacctagatgccctatgtgtttcggttgatgtatttgctcacttgcatctgcggtttgctgtagctttgaaactactgacactttcaagcaagatggactaatgtctctgaaatgaagctggacatttggatttgtgacagtgagcttgacacttattaccttactaataggtagtaagcatataccaaaatgatttacatagagggtattagtacctattagtaccttactacctattagtaaggtaatatgtgtcaaagatttacatagagggtatatgcttactacctgttagtgctaagacattggttctgtcagatgaggattttctgattggcaactaaggaagttatgttcataatttaaagtgaaggggtgggatgggatagagctggatcaatgccccatggtactacagagtgagtgataacttggagaatattgtccccctgctccccacccagctgccagtttgactagcctttcaaatagcattcacttgtcctcaattctcacccaagacaaaacacccatgacttggaacaataaagcaaacatatttccaaaatggccatggcagaacagtgaaaaggtactttggtatatctcatgccacatttcacagatcttctgttctgtgatggtttatggaagtgaagtactttattatgtaaaattcatcctgttttttgtttgtttgtttgtttgttttgttttgtgatactacagatccatttcactatagccaaaggacatgcgtttggggtctggggatccatcagaggattcttctctcttcttctggtcccacaaagcaatcgtgagctttagaaaggaatcctaggaaaagtgaatagtcttccactgacatctgctctttcttatagcttacaatgaatactgcctcttaaagtgtcttcttaaagtggcacaaagagagcacctctgtgagtgcagggtgattgggcacgcagtaggagaagcactcagggttagcaagtgattttcctgacacaaaaccatttgttggcaagatctgtgggagaaacattctggattttgtatttcttgacctttccgtgctttcatttggtaaactttgcaaagcagaagctttatcttaaaagttgttgtggttttgtattaagctcttttgaagtaactgatatgacttattttgctttaagacttaaagtgcaatttttaataagctggtaccatttattaattacttactaatgatcccagcacagtgctttctgtatattatgtctcttcgtctctacaaaaaaccccaggacttataaattattatttttctctaatttgcggatggctaaactgaagcttaaagagattaagtaatttgctgaaaatcacatgacttctaaggaaggttgagattctttctgactccaaagcctgagcattatttcatcactgccttcctttatacattatgtatgttaattcaatgttttcctccctctcaggctacagaactcagatttcatgagagtttagagttctagtctccagagtttttcagtaacccttctctcttttcagtagaaagggagagttgttttaaaaatggataactacttaagaaaggcctttgacaatctctaacgtgtgaaaaattctttttggccactggcttctgatgactcaaattgtcagttgacttgtttgctaacatgttttagcttccatcactcccttccacagatggcatgaagaattggccatagtagataaccatgctacagtagatgccattcatttattgccattcatttatagcaaatagccattctatagcagatgccattcatttattttattttatttttattttttgagacagagcctcactcagttgcccaggctggagtgcagtggcgtgatctcggcttactgcaacctccgcctcccaggttcaagctattctcctgcctcagcctcccaagtagctggtatttataggcacacaccaccacgcctggctaatttttgtatgtttagtagagacggggtttcaccatgttggtcaggctggtctaaaactcctgacctcaggtgatccgcccaccttggcctcccaaaatgttgggattacagtcatgcgtgagccatggcacccgggctgatgccattcatttagagtagtcattctttcatagtagacagccattctgtagtagataccattttctatagtagcactaccccttaccatccgactagaagaagaataagtaagtgattagaaataaggctcctggttatagggtttgttacccaatgaacatgatgacttgattagcgtgccctttcagcccaatgtaggattttctatggactatgattgagagcagacacctacagatttgtttgctttacatatatagctgaatagtcaaaatgctatatccacctcaaatggagtcaggataagcattatgaaaagtcagaattggcagttgctaggtgatgtaatttgagggacttcatggagcataccctccaaaaaactcttactgatgcctgaaatttcacagttatgtcttgattacattggattgagcaacagcccctcctttaaaaaatgcaaattcttctcacacagggaggtagctattatgcccctgacacactgggtgcttattaagcactcgaagcagaacagaggatgtggatggatgaggagatggaaaaagttgtgcagtgaacagtttccctgagagctggcatggcaagaggggggcggtatgcccactgcacaggggcggggccaggtgctggatcctgcacagtgggaacatgctcccctctgccatcttttgttgggaagaggctcacacagcctttccagaagagaattgcaggaccaagcaaggtgaactgggaaagagaaggatctggaagtctaggatggcaagatagattggagagcaatacacagacaacctggggaagagacctcgcctgggtctgaggtgatggggtgggagccctggctctgcatctggctagctttgtaacccagtcccacgtctactgaccccttgacttcctgttcctttgtgtgtgtgtgtgtgtgtgtgtttgtttgtttgtttgtttgtttgttttgagaaggagtctcgctgtgtcacccaggctggagtgcagtggtgcgatcttggttcactgcaacctccgcctcccaggttcaagcgattctcttgcctcagcctcctgagtagctgggactacaggcgtgtgccaccatgcccggctaatttttgtatttttagtagagacggggtttcaccttattggtcaggctggtcttgaactcctgacctcaagatccacccgccttggcctcccaaagtgttgggattacaggcgtgagccaccgcacctggtccctgttccttatctttaaaatgagggcatttgactagggacatctccaagtttccttctagttatgaagaatacatttttttaaaattgtactggaatcttatgagaaacacgagggattattctttttgcttttaagatttatccatgatagagtataagataagccatgggacttgcttctctcccaactcaccatacccaaaagatattaatcttggtaagatcccacaaccaacactatgcttttgcaagagcatccaaagttgtgattttgggttttgttttgatttcttttgttggttttttaatttagcttgtgactaatagaaaaccagaaatactaatctcttacatcaaaggaaggttactggcaacctccttgtactctccagggaggcatggttctcttggacttagcctgggttgtctgcatctgggaaggacttggacaggaaagagctaggcataggagctgaaagggaaccttcttatcttcagactgggaggacacaggttatatcctccatcagaggtgtagaagaaatgatgctcaacaatcagtcacatcctcagaacttccccaggcttgcatccctggaaagctgaagtagtctttggggcttcagagaaggcatcaattgatggatctcagtccatgtgtgtgtgaggctcaaggttacctggcaaggcagtacagggcagtagtaaagagtgagtaaaggatttggggtcagcaaaacctggttttgatcctcgatgctacctctttcaatggacaggttaccaagcctcaactcccatgtctgtagaagagactgtcacaacacttgtctctgagttgtgacggctccacacaatagtccaggcaaggaggtaagcctggtgctcagcattgaccagccatctagaattggtcattgccattattattaaacagtgcagccctatggccagtgaaaaacaacttttaaggcagcaaggcacttgcagcatccaatctggggaaccactcagaaccccggaaaggtactccagcaacacctgacccttctcagattcacttccctttacatagcttgttacgtggtgagctttaactacagtgcgcagctctcatctcttcaagggtgggaggattgcactgcaaatatgtctaaaaaggcacctgtgtcaatatagtttgtgtcatattcaacagggagagcaaaatgaaatgcatctttcacagatctgtagaaaacaatcatcatgggtgcttcctaaactccatccagagagttaaaggcatcaatcgttattattttttcccttcaaaatacatataaagaatttaaaaatacatataatttttgacttcaggaatgtatgtttgtttacaagtaattttattgcaaaatatcaagaatgttctgacctctatgtgaatggatgtacatatatctccccaaagtggtctatgtcaatgtcagataaaaagtcattcatgtatttcagatgagatggaagaggaaagcaatttgccaagtagtgatgacataaaggaatgtgcttatagggtcttcagagggctatccctgcctggagggtttttgagggtaggtaggaggccaggtggttggctcctctgttattgaaaaaaggagattgtctttcagagagcactgaggcctagagcactcttatcacttggaatgcccgtcagggctcacagagagtggagaagcattttatatatcacaagccattgcatgccataacttctccttcttttcttgtcctctttattttcccctaccagcatggctctcagatttattaacagccctttcatgccttctacagccatcaggaagagaaataaagaggtctgggagaatccaatcttctttagcttgtcctttttcactctcttagcttttttgtttgtttgtttctctttccctcccttcctccctccctcccttctctctctctctctctctctctctctctctctctctctcatttttattagactgctctgcatcaggctagagtttctttttcaatttccctcttctttcactgtttttaattgtttcagtgcctttgtttttccctagacttgagcacagtgggaaaggtcagctgtcagaagaggggctgtacacagctgataaggccttcaggagactggattggagtcatttaggcagcattctctccctgaagtcatagaggctacactgttgcagtggaaagaaaaaaagagctcaatgagtagaaaaggcaacttacatgaaatgagcagcttggctatgtgagcactaagcagtgcattacttacccagagcccttttccagaggcaggtgctgcccagtgccagctccagtgactctgggacgttgatggaaatgtgaatctggatgaggcacacatgcaggaggcttggagtaaggactcaactgggaattaggaatctaacatcctggaaatcaaagttgtcccctgttaatatatctgcttcatggttattttacaactaatgaacttatataaaaatcagaaagcctaggttctggtcttgggtatattgctaattactttgggaaagcatgaaactatactagccttgtaaaaagaagtagaaaatgtgtggtttttaaagcacttttcatagataatatctagaattcatcttcctgatatcatttgcaaagtagaagtgaggagcataccccttcttggacatggctatgaaaaccagttaattcctttttatgtaagtaccttgaggtaaacccaaagtcaaagcccttggaactcatccaaatagcctatgcaaaaattcatgatggagtgctgcagagcttttaaagaaatggtggtcatcttctggaatgggaaaaagaatagttgatatggataataccatagcattgcagagttctttttttttttttttttaagagaccaaatcttacgctgtcactcaggctggagtgcagtagtgtgatcatgactcactgcagcctcgaactcctgggctcaaacaacactcctgcctcagcctcccaagtagctgggactatagacacatgccaccgtgcccagataatctttttattttttgtagagatagggtctctttgttgcccaggctggtctggaactcctggcttcaagtgatccttctgagtcaccaggatttcaggcataagccaatatggctcagcaaattcttcatgttttcaaaacaatttttttatacttcacaataacctgatttaaggatacttcctaccataatgtacctgaaaaatatgacatgctaaaatgtgacagaactcctgttttcactgtcaacctggcacatgacaagtgttctcaataaaggtttgctgaatgaatgaataaaattattgagtgagtgggtaacttaaagccttcaagtaacacacagttaactatgtttatttggctctccctggccaaccccagtaatggttgggtacaaagaggaattggggtagataatgttggccataaaggatatgtaatctggttatattggtagttctgctgtcttgccatagaaaagggagccaaagggttttaactagagctctgtcaccttgggagaaccctcgggaaagaaccactgtccaggctagcagccacagaagccctagaagatcacacagtgaattgcttagcttctgctctcactgcagtgccttttacccaaaacaaactcttgttttggtaggagaaacaagaaggttggagttatacccaattctagcttcattctaaattcccttgtcaattattattctaattggatgaccctggacccctaaatctcagctcccctccttgaaaactgtcaataataatacctaaataggttgttgtgaagattctatgaaacattaatacaaagccagagctaaagccctgatacacaataagcttcaaaaatggtagctggcatcatcactatcatcacccccatttcaagggctctgggagtttcctggtatgaaacagtgataatgatgcttactgtttaaggttatagaattgaggagactatttgtaaagggcctcttgcgatgacaggcacgtaatagagaaaaaataagtattggctcctttctctctcctttcttctatgatgtcttcttacttttctactttagccgaggtagtggtacatcattactctttcataaagtgacacaatgtcattgaggaatgctcaaaaggccccagcagatggatgctcatagctggttgaagcagagttaggagggtagcatggaggggaaggaggaatgagcagcactcgggaatgcaagacagatcttttctgccaaacctggatgcactggaggctgccatcctaaagcttttgtgaagtttctgcctgtttctggagttatccatgtaatccttgagagaacacttctgtttgcacaaatcattccatacaacgtaattagctacttataatacagaggacacttgtgatcccaaattcaaacaattgcaaaagcaaaagcagtttattcatggtggtgtacaatgataattgataatgagctagatgactgtgaggtgctatggaatctcaaagactcttctgaattctcaaagggagttcaccttattcataggatgactttaggttagcagaaaataatgactttaaaaagtattataccataacaatgaatacattacttatattgttcatgtaattactagttcttcaaaaaccaaaatgccaaatttacaatgattagaaattaatagctaacaaaaacatcacactaactcgatgccctttatttgccaatgattctagctaatggagagtttttacttgatgtgctttattttttaccttctgacatctgatccatgtagaatgaccagccttcctggttttctaggaaccagctattttagcactaaaagtcctagtgaacttctcatttctaggcaaattgggatggctggttattctacttgaagcacctggtggacctcttttcaggacagcaccatgtttagactaacatctgactgacaactcaaaacgaaaagaatctctggttccagattatttataacttttggatcttgttgatgaagaaaatttttatgaaaaaagaaaatagagttgactacttttctatttatttaaataataacattaacaaattttgtctatccttgccatcattttataagacaggaaattacaaaaccaaaaaagtagaaaggagtagaatgtaaattttacaagggttccagagtgatgtgtttatcactatgttcccagtgcctagcagtgtgtggtgtggcatagatcctacataaatatttgttgaataaatgcacagtgcataaatttagcttttactacaaatgtactacactcttcttatttttctttctttctttcttttttttttttttttgttgtttttgagacggagtctcattctgtcacccaggctggagtgcagtggcgcgatcttggctcacggcaagctccgcctcctgggttcacgccattctcctgcctcatcttccagagtagctgggactgcaggtgcctgccacaacacccagctactttttctgtatttttagtagagacggggtttcaccgtgttagccaggatggtctcgatctcctgacctcgtggtccgcccacctcggcctcccaaagtgctgggattacagacgtgagccgctgcacccggccatttttctaaatgtattatagattgatgaaaactttcccttagaccattgcttggggatcaatagttgaaatctaagtctgtggactgtagagttttttgatagtaagtttttattgtaaattattttaatggcattctgttgtttatcctagtctcatgttcattatagttggtgtggtcaacctcccatgagataatcattcagataagaccaagtttccgggcctgtaaatcagagaatcaggttcatttaacatcctcttagatctcaacttctatcagtagcaagatacatctttgcagatacctacatggagatttcactacatctggcagggatgagccaccggtcctcattttcttaattcctggacaaggtttttgtgtattctaaccaagtattcttgcttttctttgttctgattcattcatctacaaagtgtggtcagaaaccttgaccaactgctgatatatacaaatatcacaacttctctaagtctgggatctcctaccacagttgagatatccaaatcattcacagttttgtcataactcgtggattaaaaaaatcattgataaatcatatccggtatttctgaagaggtttagaattttggtttcatggatagcataggaaatgtaaattatccatcacaaatgtctttacaagttacaaaactaaaccaatttgagtgttcatttcagagaggcttaatactctcagttttgttgtttcttttaatcacaaatcaactaaccatttccctttctgcagctaccttgcacaatccctgagcatatttctgaccttagccctctggtgtcatagctctgattctagctgtttggctttggatggggttgttggggtgttgcagcatctgtaaatggttaaaggagcattagactcaatgtatcaggctcatgcctgtaatcccagcactttggaggctgaggcggcaggatcaggaggatcaggaggatcaggtcaggagatcaagaccatcctggctaatttggtgaaaccccgtctctgctaaaaaaaaaaaatacaaaaaattagccgggcgtggtggcggctgcctgtagtcccaccttctcaggcggctgaggcaggagaatggtgtgaacccaggaggcggagcttgcagtgagccgagatcgcgccactgcactccagcctgggcgacagagcgagactccgtctcaaaaaaaaaaaaaaaaaaagtggatttccttatttatgctctcataattaagataattttagcatttatatcgtgtagtgaatatacacaattcccatgatttttttcctattgttttatgatccgtatttatatcccaaagtatatggttaatacctctaagtttttgctgaaaatctagccttgttgagcagatacaggttcctttagcagctggtgaagggtgcttatactttaaaaaatcagataatgtatgtgaaagtggtttggaatatgtgacatgctatgcaaacgtgtatttttttttttaaagaaatgaatagctcgtctcccacaggcatattattgacaggggtctttgcaaaagatacacaaacctaaataggaagcagcatgatctaatggaaagcatatagtctttggaggttaacattggcttgtattttggatctgctttcaactggaaatattagaaggatttagtcccttctgagccttagttttatcatttgaaaaatgggctagtaaaactttatttcacagggcttttgtgagggataaataagaaatatacaaagtatcctaataaaaagttctcatttcagatgaaatatgagcatgtagatatgctatctctattaataattcatttgttctgtgttgttttgaactcttgtaactttaaatcactaaaacaggttaattcttgtcaaatgctatttacatcgtgtttgtttcattgaagcataatacaggttcaataaatgttaatttcctgttctttgtatgctatagcaaaaataaaaaatcttctgatgcttaaaaagactggtaatagtcggctgggcgtagtggctcacgcatgtaatcccagcactttgggaggccgagacgggcagatcatgaggtcaggagattgagaccatcctggctaacacggtgaaaccccatctctactaaaaatataaaaaaataaaaaattaaaaaaaaaattagcctggtgtggtggcgggtgcctgtagtcctagctactcgggaggctgaggcaggagaatggcatgaacccgggaggcagagcttgcagtgagccaagatcgcgccactgcactcagcctgggctacagagcgagactctgtcaaaaaaaaaaaaaaaaagagactggtaatagcctgagatgaagaaatgacaaaaatgaaataaatactttcttctagttttatgcaccatattagtactataattgaatatgcaatcactaaagattttcttctttatttaggtttcttgaatcaggtcaccgatttttaagtctgcatccattttagagaactctccctccccactccccttcaacatatcccatcctctttcacctatccattcagattctttcatttaattatttcagaccctgggaattagcagtcccttcttgaaagcattggaatggggcagttttaatttttattagtatcagctttctcctcctcactgccatatttacttctttgggaggaaaaggaagtgcatatgtagctataaaagaagacatagcccaggtttctaggatttgcacctccgcattggcaaattttcccagtctgtgtctccaaacagggttttaatcacctgggctcttgtccttggcattgaaagctttaagagtactgcagaaatggtaaattaaccacatttaacaaaatagaaagttttcattgtgtcataaaaagccctattgatcttgttcaggcattgactccaggtccttttaacaagccactctgtctagacttgcaggctagagcccacagtgctaacaaaggaggagctgggctgccctccctccccctgcaggggaaggctaagaggatgggcacagattcaggcttctcaatggggattttcttaaagaactagcatgattttattctgctgtggaaaggaaaagcattaggagacttgtggcagatgtacctgtcacttactccagactccagccttgtttgactctctgtgtctgctgtggaactaccccatcataacagattaacgtgtcttccatatccctcagcttccagcaacatttcctcctgttgcccttaggaaggtaggctgaactctgatgccaacgcacggagcagtgggtctccagaaagagcgtggaaagcaacgatggggcaggaggaggaattggcaactttagaatcactgtgaccaactcaacttcatttcaattcaattccacaggtctttacttaacaaattctgggtaaacaggagattttgaaaaggcaagaaaaattgctgctcacagcgtatggttaaaaagttgacatccataaatcaaataaccaaagaatcattcaagatttattgggcggttagacgttttattggcagcagagatttaacttttcaaaaaatgatgaagtatttcaaacataaaacatgtagaacctatagtagaggatattgcaaacattgctttacccatcactcagattgaacaaatcttaatgttttgccatttttgctttatatctttttgtaaagacttagtcatgttcgaataccttcctggttccatttattctcttcctcctccaaagtaaccactacctgaagttgatggggagattttctgtatacatatttcttattcttgttacatacaaatagagctgtagtatcaaataattagtgatcactatatagctatgtgtatgtatgtgtatatatatataaattagtgggggtcaattttatcagcccctcatcatttatattcattattctctatatattctgggctgaaggaaggacatgttaagtaaaattctttaataccttatacttccctgttcatcacccaagcaaaacttggtaccacctctagatcccactttcctgttttaggatcagaaagcatttggctcctaaaatatctgtaggaagtttcacataatatctgattgtcttgttttctctagatacttaaaggtggggagttttaccaaaaatataatctaattgcagatttattaaggcaggaagtagattacattgtcttctaagatttcttctgatactatggtgataattgttacagagaattctttacttgttttcatcttgggctaaagagatatttgatagaaataaacattttaaagttcatatggtaaaaaattcatacttattgctttgaaatatctaaatatctgtatgagttttcccaaattctgtaaaccttcatgacttctatattattttctaaacatgtatgtgtgaatatagtgagtatctaattttggtagcaattagtgttgatatgtgtgctactgtatataaaaaacatttcagatgctctactttgggctctagattcattgtggatatttttcattattattaattttgtttgtatgaaaattatacaaaaatatacagtgttactagggacacagacctctcctctccagctctgtgtccctcctaacatttttgtccttatgaagtccacagaatgtagtgtgacagcatggcatttgctattccagtataatcgccttagttattgagtacttttgatgattctttttggtcttggccaagggtgaaaggatatgtaagtttgtgagtatgtatatattgtacaattttttttgttcaaaaacttcaaaattctatgtgaaacttatttataggaagtcaattctggttaagttctccaccatcctaattacttatatactctgtgtaacttcaggaaatgtatttttaggaaacactgtaggctagagctggctttgacattattgatatattttcttgtcattgaactcatgtggctccagatgtgcctattatccctccagtcacagtgaaagcaacccaaggaccagtttgatatcctgaatttctcctgatacttttattttggtgcctatttcaatatttgttgagcgctgaggtgacaaccataacatttccctctgatttctgaactgattgtgtaatagacataagagtcaaatcataattgtgtcaaggatccaaatatcagttctattgctggtagagttagagcatgtggcttttactgcagtaaaattgggcttctttataatttttcctttgaattaaactcagctactcagcaacagttagaagagccagaaaactgcaggccttcttccataagggcagagtttactgtggtaaggattactgcatgggactgcctaaaggagaactcacaagccttgtagaaagaaatagagtaaaaggcaggtcacctgggaatagtgactatctaattacgaaatgtagaactagggtatcagacccttactacagcaccaagcagatgaatcactgcaggagaatgaataaaggagacatggtcaaagtgttactccaaaatgatctcttctggggaatggggaggaaatgttctcgtggagtcacgggggcaggaaaatggattcccctctgtaagacggagtgcactatttgtgttcaatgcttgtttgattgactgacccataattaaaatgagaaacgaatactgaaagaagcataattacagttttgcttatatggatctggtggttgacggaaagtaaaatatacagtacattacataaattattgtaagtgggaagacaggcatgtgcagtacaattggcccaggttgtgtatttctttttttattttttatttttttagcaatatccgtcctatcttagaaatgtctcctggatccctatattacataaattattataagtgggaagacaggcagtacaattgtgtgcagtacaattggcaaacaattggctcatgttctgtgtttttttttattttttattttttagcaatatccatcctatcttaggaatgtctcctggctccctcttcacctctctagccatttgtccacccactggacccctggtacaatacaagtataattgtgccactcattagctgaatttcttctctgctaattccccatccccagtgctcaagaatgtagagaaggccccagtctgcatcttgagcctatacatgtgtccattgctctagccaccttgcacttttcaccttctcctaaatactctgtgctcttctaatgaccacaccaatggatatgctgtttcttctaattagcatttcattcctccctttgtaggtaaactattcataactcaagacacattttaagtatgacctcctgtatggaaacttctcttatgcccagggtcagttattccctcttctgtgtgcctatatcacctaccaaacccttactacactggtaattatttgcttgtgcataccttctcaacaacaatgatagctaacacttctatggctgggaactgggccaagaactttattgtattcctgcctcacagcaactctatgaaatatgtactatggttattcccattttgtagattagggaaagaagggttagagaagttaagtaataagctagagttccatagatttagataagtttcagagctggctgccaaacccgcatctgtctgattgaaagcttttctcatcacagttcataatgtaagtccactgttcaaccaggcagagtgccctgttaacatgaatccgttgtcagggcctggcacatagcaggcattcaaaattttttagctttacaatttcttttttttgtaaaatgtcagctaatgatttatacttacaaggttgccatgtgacttaagtgcattcagcactgaacacattacctggtgcatagtaggcacctgtgaatctttactttttaagtgaataaacaaaaatgtaacttttattgtaatgcagttgacagcaattcagtctttaggataccattagctttctagtgatttcagtgaagcgtggttttccaggccattcttctgtggacggaggcagcttccctcaccaggatgctggctgtttattttccaagtgacaagttgatttactattttccttctcatcactttcaagaagcatctgcaggctagtgagtgacccaggcagtgtggaaaagtctatttatttctctgctgcatctttcctacggagagtctgaggataagggttggaaatggcctcaggaggtcagatttcctgtgtattttcttttgtagtgcaggattgctcagggcgacacaatttcccgtctgctggtacactctgcttttaaaatacctgtgtgatgggatgtgtcaggtaaagaattttgttgtttgtccttgggggatggctctgcagcttgatctctcttaatgctttctttggccctaaaatacattgtaagggaaatgagacagggagagccaagagtgcagttcacttgtgcaatcttttgccttttaacacaatcattctgttcctccctaaattctagcaggaaatgtcattaagtgtacaatagaattcactccactaaaagaatttctactttcccctcacttttgcaaatatgatcatctcacagctcagcagataacttggatgtctgctcacagcttcctaagaggctcttagaggtaggtgttcctgttcagtatattggattcttagcaggttggatagtaaggaaacagacttgtagaggaacgaactcatacttgccttgttcttttgccagcaaaatactcaaattgctgttttagctcaatatacctttcagcactgagggtatatgcagcccctccatcccccaggaatgagtagaactgtgcaatcgtggacttattccctagacgtttctttctgcagttgtgtactcttttgccttggagccattacttcttttgtcattactgaggcttctttgcctggaaagcactggccagaattgggtgatctgtgagttcacgacttgagaacctccaacctctgattgcagttgcactggtggagaaggcacaatatagcccctgctgggtttgtcttcacagagagtaaatgagttcacaggctggccacaagaccacaggccatctctttgcctagcaggcaaggcaatagtagcccacgtgtttttgtgcctcattagtttccaggtgggccaggccaggatgggcagccaggttatctttgcatgaatacagactaaagtactgcactgtgctgctgtacgagaccaatttgaaggacaaaggctgcatgctacaatgagaacaatttcgctgtgtctctgaggctcatcatcaggaagctggctcccactcctttctggagctcagcaggtgttcttcacaggaccactggctacagccacttcagaggggtcagcattttaacgggctcttctaagtatctaaaaattccatttctaaggctctctgttggaggtaaagagtgttatcttctcagattggcttttttcagcttgttgttgagaatttggaaagaaagtcaacctactcccctacttgcctgctttgtttcctgctgcctaccagggctcttgtctaccattgtcagtagttttacctttcaacaggttgaacctcatgcagctgcagaatatcagatatagggtgctaggcatctgctttgggaatctgagttcctggcaaagtagtggtatggtgtagtaggaaaagcaatggaatgaaaatcatagcgttacagttttggaaatggcactccgtagtaccttgtatgacccctgtaaactctatgtgtctctatttcctcacattggtgtaatcatagtaaaatgacctcacagaacattgagaggatacaaataatgattaagaaggcatttggaaatccatgacacgtccagatgcatgtaaatacctgcttgcaaatggccctagaatccttctttatcaatgtctgacatgttttcattttcagtcctttcttgactaattctttgtctttttctgccaaattttgcctttggtctttggctttccaatgattgcatttggatcttaagtatccacactttggtttcctcctgtgttctctggcttgctgtgcctctgcctctcttaggttgttctgctaggaacttctgcttacattcttgcccagtgaagtgtaaacctcactatatccaggaactatatcaacatctaggctgaaccagttccaggcaacccctgaaaaagtagttcaaatgtatttctaaaagattatgcaatctcttaaaaatacaggttgaatccttctatccttctcagtaaaattatgcaatggttccccataacttatagaagttcaaattttttgcccttaaagcccagtttgggtttttaagacaccaagccattaggaatggcaggcctaattaaacagttgcatgcattttccccacacttcttagattgcatagtaataaaatataacactgagtattttaatctgctttggaatttctcagagaaatagagtgattattatataaattataagttgggtgtcttttagggggaaagaagtgaagaacagaattaagtaaatgcttattaatactaagtatatatcagtattgaattaatcagccatttgaaagatcagtacttcatatatcttatacaaactgatttaaaatcttgagttatacatatctagattgcatctagtgtttaatcaattggacacttacaaataatggataaatgatttgttgtcatacagagttgagctttgcttttcatgcagtgagaataatacttttcatttttacacttatgcagttgattgtaaactttgggatgatataatttaaatggatctaaacagtccattagctatgtcagtgcctcctctcttgccaagctatagttttatgctaagctgttgtgtactgtattacataatcccctgcattcattttctccacctatttagcttgaataaatacaaggtgactgcattgtctcttcaacctacttctcagtaaaaacaccaagtataaaaaacagatttttgggtgctattttgttttttctaatggaggattcaaaggattgaataaggttagaaatgcatgtttgtcactatttggttttgccccttttagttacccttactgtcaacttagtatggttttcaaggtgataagagagtggttgagtctcagctactggaaggaaattaagatagattggaggtcttagaagaaaaatcatgtcagttgtgcaagtggacaaaacaatgatttcttcaaggtcctcatttttttctccttctcctttctagcccttgatttgctcttttaaagactgggttattgggaggcagagcttgcagtgagtcgaggtcgtgccactgcactccagcctgggggacagagcgagactctgtctcaagaaaaaaagaaaaggactgggttatgcattgctagtgcctcttaccccataacatgtaggggaaaattattccatcacttgaaaatgatatacatttgcttatgtaggatacgattcagagagaagctttcagttgtctattgtttgttgaccaatggaggagatatcccaacatggtaatgctgatcttggtagcctcctctgactcagggaagaggtaaactgagaaaattcttcactggatgaaaagatggggaaggttgtgaatggttacagcaatttctgttaaatatttgcaaaggaaggcacttggccacataaaatcttcttcggtatagttgcatggagattagcataaatatgcatgtgatttgcataggccttttcttcctcacgttggttttagttcttatttatttatggtgatattctcttctctacactgatgccattttttcccctgtggcctcccacataaaagaagtgtttttgctttaaatacagatctaagggctgaaagggaaacatttcttttggtgaatgagtgattcatgtaaggtgagaggaattggtttctggctcaatttattcaaagtttgggatggtttgtcagtcaatgcacagttccatggaatcatctgtggcctttgacaagacaagtaggagcatctggaatatccagagtgatgggcaaagggaagataatgaatatttagactaagaaaagaccagacatgccccaagcccagagtaccacaaactaactgtgatgtctcaggcaactcacttatttctagtcatcaatttcttccttaataaaataagggcattaaatcaggccatctctaaaatcccttatagctctaaaatttattattttgacagactccttgctctaattatataaaaaatattaagcaccatgtagcacattaaataatatctggtgccttgctgttctgtcaaacttttcccctttgaagggtactggatgattaatttaagcttctctttataggcactactttccttgctcatttttctcagttcagtgggcacacaaggtataacttaaatgtttatagaagacacccattaatataccacttgcggtgccaaggacatgcacagtagttggctttgtggacatccatgtctgtagaaaaagagcttagttgtgataacgccatttgatttgtcaccttctactctagatcagggtcacctccaggtctcctgagcagggccttgtccaattgcattttaacaaagacgattcttcagaaatgaggggagagatcatgacaatagacagaacatttggggagtggatagaactacttcaaacacgcagacagtgttgaatttctgctttattatttttggggggctatttctgctaaaatccagtatgagttatgggctaactacttatacatgtgcaagctaccctgtgagcatttataggtgaacaggtctcttttgcttataccaatgtgtgtgcaagcagacatatgcaggtagatacatatgactgggctgctctggaacacacaagagaaacttgatctcttctttaactccctggagtatgaagctgaggctgatgttttaatgatgtcataatgctaagattaatttaacaatatgtagtgggtagaagtcttttcacattataaaatatctcctttttacagctcttactttatgatgaaaaaatattcattttgcctaagaaatttacctggggctgtaatggttaacacagatctgagttgaagtggacttggctttggttaattagcctggagtgtagttccggcagggaaaatataattctctcaaccttattttgtagcctccaatctttagagggaaactgtatacctcaactattgttgccattttcttttagtaatgaggtgcttttgatagcttttgaccaactctggtatgaagtagaccattctaagtaaggctatctggcaagaagacaaatggaaggtcataacactgtgtgtcaaaattatagatcgaatcaacaaataattaaataaaatatatttcaccctcttaccttgacaaatatacctttaaaactagttggaaagccaggctcaaatttagagtttttggattccttggagttctgcattgggaaatagcagcacaaggggaaccagccaacccctagtcctcaacccatggtctactcccttctcttcccacctttggctttgtcctatatcatgaagggtctggtatgaatgcatgtggttgccccagcctaatggagaagccttatccacatctctgcaaatagtctcccacggctactcctcagaccttgcaatatgtatggtttgcctttagaaagatggatcaagggctgggtgcagtggctcacgcctgtaatcctaacactttgggaggccaaggcaggcagatcacaaagtcaagagattgagaccatcctggccaacatggtgaaaccctgtctctactaaaaatacaaaagttagtcgggcgtgttgtcacacacctgtagtcccagctacttgggaggctgaggcaggagaatcgcttgaacccgggaggcggaggttgcagtgagccgagatcacaccactgcactccagcctggtgacagagcaagactcagaaaaaaaaaaaaaaaaaaggaaataaaaagaagaagaagaaaaaagaaagatggatccagggaagaggcctgcacaagccctgaaaaacaggcttaaggctttttgggtgggcaattacagggtcccagtctatgaaatattgtcttgaaagagtatatgggctccagtagaatgcgatcttggccccatggaactctagttctgtggggaaggatagttctgtggggaagaagagaatgccgtcctggccctgtggaactctagttctgtggccataggatagtccaaccagggtcttcaaaacaggataccctagagcagagagtcttgagtttaacagtggtattgctgtcttatcaaaacatatcaaattaattctcttcccctctccttacctgctgtatcacctgctcaggtccaacctcctacttaacaactcagccatgttccagggggcttaggactgtattatagaaaccaaagttagctgagttattgacagatgaaaatcccagccagatctttcggggtaatttatttttagttattggtcaataaaagctacctggagctagagagtcctttgtcagaacagttaattatccattctaaaccagctcttctacaagcatttaaaagcaattcctgaagcaaaagcaactcgagcctcacttgatcattttgcatgaaacctccctttaggtttttcttgagaaaattcgaaggaaaggcagcaatctcttttgcaccatcttgttttgtcttctaccctcgtgtggacacgtcgtttctctgcagtcacccctgctgctagtttccctggtgtttcgatataggacttgcagaagaattgaagggagtgctgtgttggtatcagcacaagaacggggcagtgcccctgcggtgtgttctctttggtatttgcataggtctgactcttgccagacaagtgctgattgctttcctcttttcttttcctatagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtaatggctgaggggagagaattcctggaaggctcatcttaggtggctgggtagtaaatttgtgaagcaggtgatgggtgtgaggtggagaggggtggagattcagggatggagatgttaacgtctaactttctcccagtctttgcaatttcacgtggaaaattattaaaatatgtttctccacatacttcaattctctctctgtgcttgttatttaagaaaaaaaaaaacaactcagttgtatagataataaaagttgtaagtactttcattccttttattctgctttcctttgatcattttcttaattacatttgaatcttatcgtattattgttaaattcaattagggactgcattttgtttctgcagcttcgtagattttcctcattctttgaatatatgtttttctttttaattaagttagccattgccacgatgccataattttaattccttccagaaaaagtcttccttttcctcttttaatttactaccctttcccaactatttttttcttttatgttaacctctagctttggaattaattagccgggatctttctgaattcctctgtttctctgttcttgatgcggtggtcctactctattgcccctgtctctccctccgagactcttcagttgactgggaggcctggaaagtggaaggacccaaataaaaaagtcaactttggagcagcctttcctggttctgtccgtgcttgggaactcccatcgcttgccgattctaagcaggcacctccgtcaggtgacaacattctcagaaagccttagccaagtgaagttgttttcaatttcatgactaataataatgataacaataataatacctcatcagctcacatcagtaaaagaaaaccgtttcctataaaaatcaaagtctgtgctgagaccgccttttccaggttgccattttcacttggtttttctatttgcgaatctgttgttaaacccagttggatggcatccaggctttattaaccagaaaacactatactttctgaagtgcttatcaaaaagtgcttaccaaattttcttctgccacatgattgatttaatgtcttctaatgtcaatgtgaaagcgtaagaaatgataggtgtctgcctacgttttctgtttgataaaagtgtaactccttacgaatactaaacaaatggtataggctggcacacatttgaaacacatttccacacttaggtatgtcaaggaagccatcctgttgggagattacatttatctcaggtaaaaatgccaaatgacacaagacttagagtccccaagcatcttgacattcatgaatctgatatttttgaatcattgttctatgtttttcctccaaggccaaagaaccctattgctaatatcttctttcgtcattcctcatccatacttacccaggagagaacgtctcaactgtcaagagaacccaaatcaaatatccatttgctaacacataagggcttgttacatgagagctgcagagactagacctaaaagtgaaatacaaccttttgctagttttgattggcaggtacaaaataacacgctttaggcattaatcagtggaggagagacttttcatgtacttcagagcacaatcaggtcatgattctcaccaatttgtttctctacctctctcccaccacccttccttaccattctggaatgattccaattctcctgtgaaaggctcacttttgtttctactaaaaacacttttctaaaatagtatcaggcacacttaagtcctttaaatggagagaggataaaccaaactgtaattcaaatattgtttgtgctgttttaatcagagcagctagaggaaaactaccctggatgtttttcccgcccctgcccttcatgttctaaggcccaactctgctctgtgcccttgggcaagccatttgacctttctccaccacagtctccatttgcaaaatggtggttacaatcttccgcagccatgtgtggtggctaaatatgcaaagcaccttatgttccagaaggattatgagctcatccatggtctaggtatagacgtgctgtgacgtgcacatgatctacaggctgagctttctgtttcaaaggtgactgcatctgtctggcaccaaggatgcagctaagtgcaattctctgttctagacagggatacagaggccctacagtattgggggtatttcttggcagagggagtattaatcttctgtgagaaagtgaacctaaaattgaacctcattgaaattctgactaaattttgcatccaaatgcaatttattgaaagaggaaaatctctgaaaagcaaagttgattttgcaaatgcaattattttaatgtgaataatataagattattattttgtccattaaaataatatttataacatctatttgagttccctgggatacatttgaatggtgggatcttcctgtctatttcaattaaactataaagagctccataaatatttgacaacaaacttatagcagccttattcatatttttggtaagattgaatggcttttatgacaaaaattcattgagtaaagtttacctggggtttcccggagtacttattaccaaatggagcagaagtctcctcatttcttccttcatgatcatctattcatggttttgcctttaagccaggtcaggaccaaggccaggtattttattgtggcttacaattaaaggaaggaatgtggactacctgtatctattgcaaactataactgggattagggaccaaggtagtgaggaatttgtgtgtttgtatgtggtagtggggtggtaattggtccttgacattgcctgagtccaaggtcatggccataactttcattgctttacctctatgtgttaacttttgttaaatcacaaacacaaaactgaggttaccagtcttccagtcttccagagggtttttctaatcatgtttaacctgccagtcttccctgctatccatacaataaattacataaaagcttgaaaagcattgttcaagaggaattgggggagagagattccaaagcattctggccaagtaaacaaattaatgaccttattgagtaataaagaagattctaattttttttgatacattctattaattctaaactgaaggaaaactgtttctctctggttgcacacatccacaaaaatgaaataggctgtagatgtttaattatctatggaaacctagagtacactacataaggcagactttctatgctaggtttgatctgtaaatgctttaagttttttcctttttgggaggatttcatgatcatttatccacattgtagtcatagtcagatgtgaaaaaagtaaaccccaaaatatttgtatttcagttctttgtatctgtttttctacatgtggaatggtacctgttggggggtctttccttttggaagaggtggaatgggtttgtgttagagggtgggaagggagtgggcggtgtccattcagaaagcccttaggaagtaagtatggtgctaattctaacgggtgaggtgtggtctgagagagatttggaagaagcagggagctgcaatggcatgtagactgcagctccttttctggctgtgccccaggtggcatggttttccatagagtcctggtctcattgtcttccccccactctctttttctgtgtcgggtgccttttttttgagaaactaacacaagatcattcatgcaatgtgtcattttactaaccgactaatgtactaacaccctaacgactcatctttgtttttagtttttttaattaacaatcgttctgttcacaatttttaatttcctttcttcccccttctccgcaaagcactcaggcatcggacacgctatggtaaacaaactacattgtctggtagatatcattcttattgtctctttttttgggtttgccgtgtgttgccccccttttcctctccaacccccccttttatcctctttagactcatttcttcttttaagattttgttacattaaatgcaagcctttctttttcttaaaaaaaaaatggaaggggatgcacttgtcctaaaaatgatatttggttgaattttgtggggaaggtttccttttctctagttttcaattttttcccccaaaaaatgctttttttttttttttttaaatctctatttggctaaatttgttttcttttgttttcttattttacaacttccaagttacatactagggacaacagagatttatagtgagaacttccttctttctgtgccttcctctccctctcactcttcctcttttctttttttctcctttcccactccttagtcccttttctctttcccttttatatggccacggctgccacaggtgatctggggaggaaagtactccacttcctagactctttcttacccttcttttactttactcccctaccgtggccaaaaggatatccaccaattatgttctccatacaaactctgcatggcatgttcctgtctcgtgaattttcctacctgcatcagaatttgtttcctcattttcctcctcattactaacaacctaccaatcatcaacccaatttcagtttcttctcttttatttttccccactcttcattctcctttcatctttcatatatttgggggttgggtttggactttttcttttcttttcttttcttttatttagtaagggaggtggcaggcagagaaaagactaccttttagttttgaatgcttttttttcacttccatcttgttcttcggtttgttcaatgcatgtaagtgtgaagtggattttgattctttccctaatttctccccaccctttcccagttttgtttttcttctgccttctctcttggttccagataatttctgcatgggtgtatcggtgtatggtgtgtgcatgctttgaggccccatcgtttctctctgccctctgctcctttcatggatgttgggtaaaagggtgctatttcttttctgtgggcattattatttttattgttttggttattattcctcatcattcattttattgttgttcttagagttgcctttttggtttgggtcatttcttctcttggaggtggtgatgggagccaagggagggtagggattggtgtcctggggcagtccatggcatgtatcatccatgaccatatcagaatcaagacccttctccttccctccctgaatgcatgtttgtcagcgtggtgtgagccaaaaaatattaataacaataaagataaaagaaaagaaaaaagaaaagaaaagaaaaaaggaaaaataaaaccatcaacaaccaaagaccaacccctaacaaatttcatcatcaaatgtcttctttgctgtttttcactaccaccatgaataacaatcatgtaagaaataaacaatcattttagcaatgaactgagacaagtgatatcgtctgaggatggttccattttctagcctgactgtgtaaagattgcaatgggtagaacaaggtgcccagcttggaaattctaacaaagtcatccatgagtctgcagggaaatactgaaggcttgagacccagggaggcagaccagaaaatggaacttggctgcacataccaaaatcaaatcaaattagaaagtatatctcatgaaaatcttaatgaaagtgatgccacaagtaggggaagccactgggttatgataggatcgtaaggtcattgttgggattttttttgtccctatgtccctccaccaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggtaaagttcacccaattctatttaatgcaccatgtgattgtttcatttataaacaaatgacatgtctaaatcaatgactggatctgtcctcaaatctatgagatgatagattgcagcagaaacaaccttgaacttggaagtaggtgtcctacgttttcattcccgcttaagctggttgcatgacttggggtttgtcactttagtactgtattagtctgtttgcatgctgctgataaagacatacccaagactgggtaatttataaagaaaagaggtttaattgatttacagttccacatatctggggaggtctcacaatcatggcagaaggcaaggaggagcaagtcacatcttacatggtggcagggaagaaaaacttgtgcagaggaactcctctttaataaaaccatcagatcttatgagacttattcactatcatgagaacagcatgggaaagacctgaccccatgatttaattacctcccactggcttcctcccactggctccctcccacgacatgtgggaattgtgggagctacaattcaagatgaaatttgggtggggacacagccaaaccatgtcaagtaccctgtagttctatttcctcatctaacaaatggaagctcttatcccacagatggctgtgtttataaattaaatgcagtcacacaggtgaaaggccattgaaatcacaaggaactagatgagtgcaaagtttgattttgtgattttgacctggcaaataggaaagctctagctaaaagtggctcaatctgttgttgtgtaccctgtctaaaatataacatatgtattattttaccttcactaagcctggtgttcccaagggtctcatagttgagacggaagaaaattcttataatgtgacattaaggctcagaagactggttttttcctttgcttcttcttcttccctgagagctagtagctgtgaaaaaacagtgggactttgccactacttgtttattaccattgtagctgatgtattgagacctctttctgagagcaaaggagcttcagccaagtgtaagttcaacctctaaggtcaattgttgaggcaaaaagaatcagactaaatttggtagagctctttcagaacactgtggcatcaaagcagtgcactgcacattttaagctaagcttcattgccgaagatatctataccatctccctggggatgttacttgagaagcaaacagtgttccttcttgtagataacaatcccttgtgacatcttatgagtctcctcttggggcatatgttttattcttactatggttatttgaaatttgttgaacatcatttgtatatgagatggcactgtccatgcattcattcatgccactgccctgtgagccttgtccaggcaggaattgtgtctgttaggcatggcacatagtagatgcataataaggatttgtttgtctatttatctgataatcattgagtaccttttttgtgctgtaactaaatttggtggctctttttaagccatgatctccatgctccaaggctttgccttgtaggaagggagatgagatcagtgagtgaataagtatagcataggagtacatgtgttcagtggcacatactaaatgctctaattgagtagaggaaacataaattttaggtggaagtcagttttagagaaggagtgacatttgaggcagtccttgttgtaataaatcatgtgcgaattgagaggaaggggtagaaaagagagacataataaaggagagaaaatccaattgtagctttgtattgttctcagcctgtaggacaaaataagaggagcacccaaagagtgctattatctctctgcaggatgttacctaggcttctgctggcttcagagatttcatcgtcatttctgatggaattatggtaggcatagagcccttcctcactgggatttactcctatttggatagaataaaggtatagactatgcactgtctagtgaaccctgaaagactcttaaacactgttaaatcacactacattggaattgcactctcatcagaaaaagactgcaacattcttgttaccaaggacatggctcaggaatgaatgaggcattggttgctgtggagtgctcattcagttttgtagtgcaacagtcctgagcatggagtctctccaggacaggatttaggtcttgcctttaggattaattttctcctacacacaattatattgagctacctctccattatatacttagagacaatggagcaatttcccaaccatgaatcttctatctattaatcaggaaggatgccctgaaaattttgaaacaagtctcataaaaacacaaaggtgtctctgatgactttatccatgtggaaacaaaagaaaataaaatacacacacacacacacacacacacacacacacatttttgctgcccagatagagagcagaaagcttcaaaagtctgtcagaatcattctgaatagcttaaaaggtaaaggcagttctgaaaaacagtgtcaataatagaaataactataatcagtgatgtcaatatatccttatcttagctagcagcacaaatatgcatttaaattcagaccaagttagaaaaaggaaagttcaaaacactaacggaaatgataggcaaagctagaacttgataaactcctgccccgtctgttttccctgtacagcgtgatagtctttctaagggactcggaagtcttcttatttgtctgagtactttgaacagatcactttgagtctaacgtagtgctggcatattatttctttgcatttaataattacacttcacttttctgtgggcaggtctatggagatacttctcttgttcttggtatttgtttttgataaatcagtaaacagcaaaggctatgttaggattcagctacctgataaaccccactcacccacttaaaccatagaacagtctttaattatttcacaatctcttcttccccttccttttcctcttgctgccttaaaaaaatcttctcttgccatttgtggctttaagttgtcctaaatgaaacaaggtgattttatgtgtaattttcttcaaattagggacatggcaaagggcctatgcaatttctgctccagatcatcaatatttctttgtgtgtggcacaaaataggttttgtctttgggactgtagttacttcacacctaaaagctaagttctggctccgtgattgtgccaaagggactggatattacttgtgtgcgtacttcctaacttcataccagtgtaaaagccacaacaaagcgtccacattgtcgtcaaactatgatggttctctacacaccttagttatcaatatgcagtttgtgtccacttaactatcatgaagtcagcatcttgttccttttcatgttttcacattttagtgtgtctgtctcatgtttgttcttgttgtatccccagctcctagaatggttcttggcacttagtggctctcagtcaatatttgctgagtgaaatcacatgattgtacattaataaatatctttcctaaatgaatgcttttaggtactattgaccacttgactttcctgggatgactaaagaacatcttgacatggcagtggttgaatctttcaagaatcttctctgcctccccctgagctatcagatatgagaaaaagattatattaaaagcctcagcaaggctaagaggaatgattggaagttcctctatgaaaaatgggttagaaaaggctatgagggagacatcatagtataatgaaaagaatactgggcttcagatcagaaaatctgcttaagaatgctagctttatcactggctatataataagaccactgatcttactccagtctcagttttctaacccataacaaggagataataaaacttctgttgcattcttaagaaaaaaatgaaatgatgtacataaaagtgaaatcatacagcattgcaaaatacaatgtttttgcttataataattattaaggattatatattgcattgtataaaatagtttacaaatagaaatgtaagtgtaagtgaatatccattaacacatggaatctctatatttctcatattagcaaatcattgtcaggaaaaaaaaccccatcattctgaggtttgccctacataaattctatcataatgcaaaaatagggataactcatcccacctgccctcaatgatgactttgttttttgcctttggtcatttatttgacactatgttttcctttattaaaatgtgaattccatgagaacagaggtcctatttgcttacaaatatttccccagcacctagagtggaccctgacattaaaaaaaatgcactcaataagtatgtctggaataaataaataaatgaatatgataacctcatggagctctgaaatctggtggagtttagatgagcaatgtgtaagtccagacagctattaaaaagtatcataggctgagtggcttataaacaacagaaatttatttgtcactgttctggaggctggaagtctaagaacagtgtgccagcctggtcaggttctggtgagggccctcttctgggttgcaaattgctgttttcttattgtgttctcacatggaaaaaagaggataagagttctctagggtcccttttataagggcaccaatcccactcatgagggaccttcatgacctgaccttcatgacctcccagaggccccacctcctaaaactgtcacattgtgggttagaatttccataaatgaactttggagaacacaaacattcagtgcatagcaaacaatatatcccccaaacctataatatgccaaggactgtgctaaaatacaaatatgagtcaaacatgtttcctgctttagaggaactcacattagtggggagaggcagacacacgcataaatgcaataaatagcagttaatgcacaacatgaggcattcttagttacaatgtggctgctgaggagaaggacctaatacatcctggggttcagggagcatcccaaggtgaggtgcttgaagccaagtagaagtgagcatggaagcatggggaaagaggtgctccaggatgaggggcagggtgagcaaaggcatggaggtagagcatgttctggtgtctgggtgaagaacttacaaacagcttgctaatttcaaggcccaaattataagactgggagctttggactggtagctgcggttaggtagggaccatttcatagaggcctttatttcatgctatacccttggactttgttctctaggtaacgggggagccattgaaggaccttatgcagcagaacatggtcagattggcatcttacccatcaggccttcattctttgaggagtaatgttaattcatctaccactttcccctgatgtatgtttttgtcctaggaagttgaagatcagggatagaaatggtggtccctcggccgagtgcggtggcttacgcctgtaatcccagaactttgggaggccaaggtgggcggatcacgaggtcgggagattgataccgtcctggctgacacggtgaaaccccatctctactaaaaatacaaaatcaaaattagctgggcgtggtggcgggcacctgtagtcccagctacttgagaggctgaggcaggagaacggtgtgaacccgggaggggcagcttgcagtgagccgagatcgcaccactgcactccagcctgggcgacagagtgagactccgtctcaaaaaaaaaaaaaaaaaaaaaaaaaaaaagaaaaggtggtcccctgagcttcggcattagattggcgcctgcctctctgaattttaacattactgcagacaactgcttccttctgactcccatttcagtttccaaaaaccctccctgagaggacatgcatttctcttttcctctgtccttggcattactgagctgttcaatgacaaatgaaatacaggaaggccaagccaagactgagttacatgagtagggtccccatcaggctactcaagcccatcacagtttcctcccacgtgttggaccttctgtgtagtttgatttggttatttccacaccatcctcttttctcctcaatctgacactcctccattttcccaagtggagaagcgaaagtgccactgagacctctgggacagactggactctctcatctctcttttctcatggcatctctaatggggaggaaggaaaagcaggagaattgggagaatagaacacatatttaaaggaaaaaggattggatagaacatcattgtgcacattacattccacatccctttgtgattattagccatttaaaaccgaatggagttttgcagccagagatagtctctgaacagatgattaatggcttaatctgtaataactttacattttatagaaccctgataggcgtccacatctggtgagccaagctatttaaggctgtgttaattctgttaattgctatacgtttatttgaattgctggcacctgcgggctttgggataatgtgtttgttgttgctttttttcttctttaaaaaaaatactcattttattttaccctgtcttgcttgctgtctcttgttgctatctctcatgctatcacttaatttcttctctggattttcttttgggttgtcctctttcttccttactcattttcctccctcttccccatctccgttccgtttttctctaattcgtttgtttcccaagctgttgttttggtagccttcctgatttctcaggtggtgataatgtctctgtccataagcaggtgaatttaggtcatagctttgggcctaaatattcctttttcctgtcatgaagactactgtgcagcgtagggctagtaaaacccaagtgaggcttttagaatcaacatgagacatgagaagagggtgggcttcagcagcacaagcccagggtttgagtcttgcctagactcattccttgctagttgcatggcttttagcaagccgcatgactgttctgagcctcggtttcttcatctataaagacagagactaatactgatttcatgtatttttatgtagggagcaaatgggattagacaaatggaggtgttttataaaatacaaaacactatacaaaggttaatgaagttgttatttatgttattaattgaaacaaaatcaattagttcaggccaaagaaccacttactgctcttcaccatttctgcaattaaaaacctgcagaagttaggagagtccaatgtagtttaattaaaaaggcctgatactgggttcagttctaatgttaattagaaaattatacaacttctctggatatccttgtcttgatctgtaaaatgaggatagtaatccctgctaatccaaatgcacactactgtagagaccttcttgtaaatgtagcatagaacacacattattgctttgggtagcaaggtaaacatcttgctgtacatctttattccattaaggaagatgtacggaaaagcactctgtgggtttggagataagagcgtcttgacagaatgggagaaccaacacaaaaggtgaccagaagaaataagagttgagcaaggtggaaagaagtgaagatgcaaatcagaggaaatggaggaacgtggcagaagaagaaaacaaaaagcaattacggcatctcaggagctaactattggcttgtcatgggctgagtgatgtcctctgcaaattcatatgttgaagttctaacctttagtttgtgactgtttttgaagatagggctttttaagaagtaattgagatcaaatgaggtcatatggataggccctcaaacaatatgattggtgtcgttataagaaggagtgataaggacatggatatacaaaggaaagaccatgtgaagacagagggagaagatagccatctacaagctaagaacagaggcttcagaagaaaccaaccttgctgaaaccttgaacttggacttctagcctcctggagtgtgagaaaataagtttcggtaaagtcaaccagtctgtggtattttgttatggcagctctagtaaattatagagcttttttatgggttgaccataaaaaaaagatggccatttttggctgggcatggtagttcacgcccataattttagcactttaggaggctgaggtgggaggattgcttgagtccaggagttggagaccagcctggtaaacttaaggagactgtgtgtgtacaaaaaacataaaaaaatttagctgggcatggtggcacacgcctgtggtcccaggtattttggagggaggtgggaggatcacttggacccgggaggttgaggctgcagtgagccaagatggtgccactgcactctagtctgggcaacagagcgagactctgtctcagaaaacaaaactgccattttttgtgtgtgaggacaaaaaaaaaaaaaaaaaagtcaaatattggcaatgtcgggtgattcaatttcagaaagaaatgtttgtaaagaggataaattgaatcttctggaaaagagatgactttctggattacaaggaattgaagtgggcaggaaagagagagagaaagaaagagagaaattggcaatgtcagtcgattagagattcccattcccctggctgtggttgttttctttataggtggactcctaatgcagtttggacccataacatacagaggcacagaggaagaaggagcgaaaccctcagctactggggacagggatacatttgaggcttatttcagtaggaaccaggtgtgaacatttagccaagcgtggctgtaaaaaagtggtatgggcctaaggaagagtgaggagcactgaggtctcaaagatctttggtgtttcggtgctgtgacagacagagagtagttcttcagttagtgccacaataaaattactaaagaaggatttgctgcttacagttgatgggttgttgatgaagaagtagatttatatatatatatatatatatatttggcaactgggtattcattctgccttcatctgatacatgtttcttgatttttattcccctcattctcaatccaatgattcagtggcacctgctccactcccagctccgttagtgagcatgtgatccctaaatcaattagagactcctaattagagactcctattcacctggtcatggtttctttcttcataggtgagctcctaaaccaatttggatccataacatacaggctcagaagttttgtctatatgttgtagggaaacagctctctcctgctttgggctagaacttggagtggtgttaaactaagcttctggccactatcttgccaccatagtgaccaaaaaggaagccaggatagagaaaatcagagccaaaagatgggaagaaactaggccttagtgacatttttgaaggccctggtttaaacagttttcaaattagactaccccttaatttccacttatggttgaataatgtacctctgttgcctaaacctgttgtggctctattttctatcatttgcagcaggaagccctaggtgatgtagcagaattcctcatgttcctattttactcctgttttttgctaacaaaaagataggtccttggacagggaaagacagacaaaagtaggaaatgtaatactggaggatcttagaaatcagataatttgctctgtattaattcaaatttcctgcctcagatgaatgctatcccaggatacagagagaatttgtaaatacaatttttgaaacctagttggtggtttttgaggaacgctagtgaataaagaaggttcctaaagactagacaattgaaaaatgtagataatgcaaacaatgaacttatgagttgaactgaaatctggataacattttggagtgcaatattaacagaatgtatgagcccatagcagagaaaagagtgatcaatataactgccatcactaattaagagcactaagaaaaagctatatcatatcaaccaaattcacatactcattcagtagtattaccgatgattcagaaaagtactatggacctcatctagctaaatagcagcaaagtttttgaagacacattttgtgatattctcattaataagatgagcaatagggtttagatgcaagagctatcaagctattaaaataccaatgggccctgattaagtggatttttttggcctatatgaaagtttttgtaagatggcacaaagctctgtcttatattaaggacttgaagagacataagagaacatggcttgttaactttgtggatggcagggacagaaaatggtagaaattgtgcatctgtgttatctgaggttgaattaatagaggtctgacctgtgcaacaaaggaggtaacagttctgcagtataatttattggttaagaaagcaggctctggagttagagtttctggctgcaaagcctaactctactcccagtagctgtatgatgctggataacatacctaaccttctgttacttattaaatgggaacaataattatacctacttgatagggctgttgtattgagatcatgcatgtaaaatagctgacatgtagaaaatgttcagcaaatgttatttattttttttctgagacagtttttttttttttttctgagacagtgtcttgctctgtcgtccaggctggagtgcagtggtgcaatctcggctcactgcaccctccaccaattctcatgcctcagtctccgaagtagctgggattacaggcatgtgccaccacacccagctaatttttgtatttttagtagagaaggggtttcaccatgttggccaggctcatctcaaactccttcaagcgatccatccacctcggcctcccaaagtgctgggattacaggcataagccactgcgccaggcccagaataagcttttaacatgacaactaattgacagattagaatatctttagagctgagctgtaaaaaaaaaaatacccaaaaaactaaggcattcaagatcctaacaacgttaagaaggcttaactaatagaaccagggtcatttaacctgagaaagtgaagatgcctgtgcccaaggtttgagagtcgtcttcatacatgaaggactgtcctatggaagtggaagaaaatgtggcccatatatccttaagaagagaaactaagtctagtgagtggaagctgggtacttaacataaggaagaactttcagtaagagctgtccaaaactgccttcaaagtaatgagttctccaacactcaaggcatccaagtagagactgggcaaccattttgctgaggttatcgaggggattctggaatcatatgagtggttttgattttatagatagatctatagatagattgattttatatgatagatctatagttctacgatgaatgacctatctgcaaagaaagaataaggctaactgattagctcaggttcatcatgtggaagactttcctcattaatctccaaatcagttggctttacatgtcccacaaacatttattgggttgcccttgtggtaagagttgaggttcccagccactatcatcacctattactcacttacaagaatttatctttactcagtcctttacttgatcatctcgaaaaccgttacaaccacagcaattataatcatagcagcaacaataaagactagcaattattgaacacttaatgtgaacacatgtgaaatgtgtgtctacatggtgctatgtacttcagacttattccctacttatttcctaatttagttctcacaaaaaagcttatgagctggattctatgatcattactaacttgaatttaaagagagcgagtgtctttcccacttacatcattctaagtgttggagttgagatgtaaatactgtcaacatcctgattttgctgccctttctaccaattcagtcataagagttagtgacgaagaaaaggaagctcctctggaaaaggttggtgattctgtgtttaaacttactgtaaggaattgtctctcactaccgcttagagtctctacttcataggaaaggtcatttaatcaggcaaaaatgttctgttgggagactagatacaattacctatttctttcaccttgccattgattgttctgagaggaaggcagtttttgcttgatttcccactttgggcaaattgatattgctcaacctgctaacggaggaatgattttcattatggtacctgagagggaagatgctgctcttagtataaatgccaagcagtgcaatagtttcgtcttgagatgggcagcacattgtttctttttgttccagcctaatattttccatgaagttggagctatttgcctttaatgccttcaaaacacccaaataaggagcagctactatttagacttattatgaattttcagtctgattttgggaatcacttacttagctttgcatttttttttcttttttgctcgtcaagataaattcagtggaactcattgctttctaaaaatgtcacttatttacagcaaatgtaatctaccacaacattcctactgagacaaaatctcttgtgtctttgaaagcctcaaaggagattaaaaaaacactagtccttgtacacatatacctacagggataaagcaatcattgagctaattaattagcttatgttttcaaaaattgttttgcaaatgcagaaacgactattccattagtgttgcggtgcttttgtaaccttgtgttctgttcctcatgtggagagtgtgccacaaatagttcctgcatagatttcaagagagatacaaggacacatttttcacttctcaaatcagtgaagatgcagcttagggcagcaacactgcacaccaattatcaaccaataaaattctcctccttccctctcccttagcttttccctcaccacccaatatcagcagatgttctatctcatactttgtagggaaaatagaaattgttcaggtaatgcttgctaagcttctctctctccaccttaagacttaccttcaaagattctcattgctaccttcttcccctcatcttacagaatgaactttcccctcctctcttgcctcttttgagatttagcccctttaaagattccctctcttaatcttcgatctcccattctcctctgctccatcccttcagctagagacatactcaaaatcacttctttgatactgtctcctgctcaatttacacctaagctcattccccactttcaatgaaaaagttcttgggagaatggtacatatttctgatgtcccctacttcatggttactctttaaccctctacatttgcatgtcagactctgaactctaggatccttagcactttagtggaattgttttcttgttttaccctgcttaagttagaagtactttattatatgctcctatagctctcagttcaaaacttcaatgcattgcaattgttattatagtcctcatcacattgcactttaacatgcactgtgttcatatgtttcctcaatagactgagcttctaagagacaagaacaaagatttatgtagattgcatattccctctgaagttaaacataggtcctgacacatgaatagatgggaaatattcttcaataaattaataagtatttgtgaacatcagtgatagaattattgttccaaagttccaatttctgcttatattcattttgtcaacagcatgccactcatttacttattcatgaatgcagtaaatattcatggaatgcctactctgtcataaaatctgttcaaagagtgggagtgtgtggtgaatgacagcatgtataaagtctatgaccctatggaattcacattacggttgaaggagactaagaataaatgcaaaacagataattcagatactttcagataatgataagtggcatgaaggaaatgaaagagaataatgggtgtattagtccattctcacactgctaataaagatatacctgagactgggtaatttataaaggaaacaggtttcattgactcacaattcagcatggctgaggaggcctcaggaaacttaccatcgtggtggaaggggaagcaaacatgtccttcttaacatggcagcagcaaggagaagtgccaagcaaaggagggaaaaagccccttataaaaccatcagatcttgtgagaacttacttagtatcatgagaacagcataagggtaaccaccgtcatgattcaattacctcccaccgggttcctctcatgacacgtggggattatgggaactacaattcaaggtgagacttgggtggggacacagccaaactgaatcaatgagatagtgagttggtctccaggagcctgagtggtcagggcaggactctttgaggatgcaataattgagacctgagatgaaagtagcactcagttacacacacaaaaccttggggagaggccattccaatccaaggaagctactaggacaaaaaggacctaaagcaaggaaagcttggcacattcaagaaaagtccaggaggcgatggtggccatggctcagtgagagaggtggtgagaggaaagaaatatctagggctggatatgttgcttttctgaaaagatccaggctaggcaatgtcaatttatcaagcttatctctgcctcagagtcttcattttccttttatcccatatctaggttgattttctctttttctttatcctcgaaagtgaggtgtccctctatctttgtaagctcacatgttactgtgctcagtcagcatctccttctctccctttcaacttccgaattactcagttattctcattctttcttgcagtatatatctatatattttttcttttaaaaattgtggtaaaaaaacacatatcccaaaatctactcccttaacacaattttaagggcatgctacagtatttttgactatattcacacggttgtacacagatctctagaacttttctcttgcacctttgatatttgcctatttgtttcttcttctcagagttaaaaacaagtgttagtctatcctttcataaaacccctctcttgacctgcactttattaagctcaggaagataaaaaatgcctctttccaggagacggtagggaaaaagccaaaacaaaatggttataaggtttgaaaaaggaaagataagaaaagcagcattggatgacccataacttctagaagccagggtgggtgcagtgtgctaaatgtgagaagaatggggcgtggttatgtagaattcaataggtttagaacagctcatactgtcattacctattcactcgagttagaaacctcaaagtgagatgtgatctttctttctcattccccttcttcctttttgccctcatttaatcaaacacaaaattcccttggcaatgccctgtatatttctgactcatctctgtcctctgcttcctggtcctttcactactgcctctccctctgcccccatagtacttcgcctatcatggtgtcatgatgagtctttccacctctgttctctctgctttctttccatgctgcattctgccccgttttgctctttgtgccattctttggaaacatccagtgcccagcaaagcatgtcttcttcagcctcccactcaaggccttctgcagtttgtcttcaacttgggtgccacctcctcatagttcctccctaaatttaaccagagtagtcttttcctattactctaaatgtatgttttaagttctttcttctataacttgtttatttggttcttctagccaagaatttctccctttctcttttctgtctgatgcttaccctttcttctagaacctagctcatggtcacctgcttgactgatcactgggttaacagtggtcttttctcacttctgaattccaagcacacttaatataatatagggtgtttcagctcagatttaggaggtagacttccaggttgaaatttttgtttttctacttactacctatgtgccttggacaagttagttagtgtctctgaaactcagtttatttatctataaaactggtatcttaatagcacttacctcagagatttcttatgaggatcaaatgagatgatgcaataaagcctttagctgaatctgtttcgtagtgagtactcaagaaatactagctattttgtcattcagttggtccttacaataccccatagccatttgttagcttttctggcttgcatacaatccctttgaaaacagagtttttgtagttacagcaatgctgtatataatatcaaattattaaagacagtggaaaagaatttatatcccccaaatgaatgtcttgactgactgtaagaaagttgctgtttctccttattacattttgaccacaattgaaatgtggtcaaaggagaccatctgccaaaggagaataattacttcttcacagacataggaaaaaaaactcactcatggataaatatgtgtgcatatgtgaaatatgaatgcagtgatttcacatttttaaaattcctggcaatcaaatgagattgtgatagattatcttttttttttctgagatgaagttttgctcttgttgcccaggctggagagcaatggtgtgatatcagctcactgcaacctctgcctcccaggttcaggtgattctcctgcctctgcctcccgagtagctgggattacaagcgcccgccaccacgcccagctaatttttttgtatatttggtagagacgggatttcaccctgttgaccaggcaggtcttgaacttctgacctcaggtgatgcacccacctcggtctcccaaagtgttgggattacaggcgtgagccaccgcgcctgaccaaattatctttcttagagtaacttttcttcatagatattaatgtaacagttcttatggatgatgtttaaaatgcttaaggaagcaaaacttagctgtaaaattgggtattgcttgatgatcaccagtgtcccattgaggtctaaaatgcttatgaagtttaaattgctttgcagtgtgttatgatctttcaattatctttaaatgattgatttaatgagcttctattattatattttaggtatggtgtttggaatgcaaagtgaactggacagtttctttcctggaagatcttatagttcaggggttgacagcattttctataaagggccaggttagtggcttctcaagtggagacaagtttgaccccaagaaatatttgacaatatctggagactcttttagttgttgaaactagggtggaggagtggttggaggggagtaaagggatattgaagggaagatgctgctggtgtgggcagaggccaagattgttggtgcactgtaggcctacaatgcacaggacagcccttcggtgacaaggaattatccagtcctgggtctcaacagtgccgaagctgagactctctggaccagacagtaagtagttttggtttaatgagccatatggtctctatcacgactatcaaactgtcattgagcatgcgagcagtcatagatactgtataaacaaataagtgtgtctgtgttctagtaaaactttatttagaagagcaggaagtgaattgaattggccccagagggttagtttgctgactcttgctatagttaaatggcaggcaaaacttgataattataatgcaacatattaaactctatctatctatctgtctgtctgtctgtctgtctgtctgtctatctatctacctacctacctagatctatctgtctacctagatagatagatcagtcaaagttttcacaggtttacaatgaagccccagataagagcacttagcctgatctgagatattagagatggtctcctgaaagagaaagaacatgaacaaaagttaaaaaaaaattttaagagtgaggagttagacaaaaacagtaattccatagagagagaatagcgtcagtaaagtcacaaaaatgcaaaatagcatgataagcatagagaactaataataagctaaaggaagtagaagtggcggtaatggtagtagtagtagtagtagtaatagtattgttcccggaaagggatcctgatccagaccccaatagagagttcttggaccaagaaaaaattcagggtgagtccataaagtgaaagcaaatttttaagagagtaaaggaatgggaataaaagaatggctactccgtaggcagagcagccctgacggctgctggttggctattttatggttgtttcttgatgatatgctaaacaagaggtatatatttattaaatacctgctaaagaccaggctctgtgctaccgtgctacacaggtagtttgattattacaggtctgaggcctgtttgtccggatgattttagttcacacccatagtgacacacgggtctcttcttgcttcattgctttttccctttttctgggaaagggaagaaagggagggcgattcctggaactgaggattcctctcctttttagaccatatagggtgtcttttaacatgctaataactataattagtgtataatgagcagtgaggatgaccagaggtcacttttgtcaccatcttggttttggtgggttttggctggcgggatttttttaaattttatgtatttatttattttttattatactgtaagttctggtttacatgtgcagaacgtacagttttgttacttgggtatacgcatatcctggtggtttgctgcacccatcaacccgtcacctacattaggtatttctcctaatgttatccctcccctagccccccaccccctgacaggccccagtgtgtgatgttcctctccctgtgtccatgtgttctcattgttcaactccctcttatgagtgagaacatgcggtgtctggttttctgattttgtgatagtttggtgagaatgatggtttccagcttcagccatgtccctgcaaaggacatgaactcatccttttttatggccgcatagtattccatggtgtatatgtgccataatttcttaatccagtctatcactgatggacatctgcgttggttccaagtccttgctattgtgaatagtgccgcaataaacatacgtgtgcatgtgtctttatcgtagaatgatttatagtcctttgggtatattggccggcttctttaccacattctgttttatcagcaaggtctttgtgacctgtatcttgtgccaacctcctttctcatcctgtgacttagaatgcctaacctgggaatgcagcccagtaggtctcagccttgttttacccagcccctattcaatatggagtttctgtagttcaaatgcctctgacagcaatagcagttaacttttattgagtgtttaccatgtgtcaggaactctaagtattttacgtgtgctaacacatttcataaacatagagctcagtgttgctggagtaatgtaaaataaggtttaagatgtgtgcatgcaccagggctagggccttatttttaggtggatataactgggtatgagaagaccaacaaggaggtaatgagtaagatttattaactgattggatgttccaggtaagggcaggaagaagccagaagtttctggtttggcaacattaattgaatgtaggtatgctggaggagaggcaggcctaatggggaaagtgctgtttttgatgggttgagtgggaagtacctgtgttaactgcagaacaaggtcaagtcaaatagctggagttgtaactgtaattagaatataagcaatagagttaaattaattgaaattgatgagatcagttaagaaaccacatcaaaaggaagaacaatgtattttaaagaagacttctaagagtaactaatatttaaaagaaggcttaaaagggaaaattagtgaggtaggagaagaactagagaaaacgttgtcatcgaagctaagaaagtaggaagtttccaggtatatggcatagtcagcagaggtcagtgccaaagagaggaccaatacgttgagaactgaaagtgccctcatagctgagaatttagacattgtaggtaatcattttgttttgcttttgaatgacagtgataatcattttcaaattcagagagaaaaaaaggcagtggaagtggaaaagctaaagatataagaaaactaaatgttgaaacaatatcccagtgaataatttcaaacttttaaaaatgtatttattaaataaagtacatataagaaatgttgctattgggtactatgctcagtatctgggtgatgggatcaattgtaccccaaacatcagcatcacacaatatatcaacctgcacatggaccctctgaaactaaaagttaaaagtataaaaataagtaaataaagtcaaacatgtgaaaaaaagaaatatttcataggctttttttcagttgctctaaatttttaaaaatacgtttatgcattttcctataatttgtgttttgcatttatattctccttttctctaattgattagctctatcattagatttaactgatacttagagtttgattggctcaccatctatttatcataatacattgaaaagtcacagttgaaaactataaaacctcaaggatgtatttatgtgtttagcaaatggaacacaaacctcatagatttgtaactttgagacaccaaagaatattgggagacacttatcaattcagttgagttcaattcagtttaaggcatttgttgaatgctatgcatttttaacagtgatatgacaggatttttctttcctttcaaagcagcttgccatcttatctgtctgtatgtttattgcataaagaatttacagcagataaagatgtagttggtgcaaaaaatatacagaacttgaaagatctaatcataaagaaatataacaaaatgctatatcatatagcagagtcagtgatacaaagcaatttgtactaaagactttgggagggagagaccaacatgaactagaatattgtgagcatctccatctaatgtttctgcctaaatgctgttcttctctagacagaactcaaccaaattactcttaacagaagaacaaatgcaagtgatgaagaaccaagggacaagcaaaggcatcaatatattgtttgctatttgaggaccaactgtatttatttatctttgtatctccagggccaggcactatggctaccatgtattaagtacatgcagtcagtgctgaattgattacttctggtcattagattagcacagctgagctgaggtagcttggaccatgtgctatgtggatgcttccctattaatgatgctaatgacaaagagaatcaggtccaagagacagtgagttgggagtacgccacctatagaggactaggagagaaaatatttttgaaagagaagactaaatgctagatgcactattaatgggaattggtcacgcccacaggactcttccctctagcataacataccgatatataaaaacatgcttgctgtgtgaccgaatgagccaatcctggcttaacatagacaaacaaaaaagaagttgccaatgccttcttcagttcagtatctcatgaaagaaatgcaaggtgaagagaaagcttaaatgaaaaaaataaagtgaaatctgtaagcctggttctcatttctaagggtttattatactggagatttcatgaaaatagtattgagaatgactactctgtgatttttgctagcttttagtccctataggcagaaaagcatttctaaaagagatttgaaaattgtggactctgataacactgctagttgtcatgtttttctctaatgaacagcttatcagtaaatgtgctcagtggttaattaccacattagagtttattggcatcaaatgtagtagaatgccgattatccttatgcaaatttggatttactgcaggttaaatcctgtgacctgaaatctaagtcacctgtcataaattaataggtccaggtactaggcctgctgggattggcagtgacaaaagaccccatgagttgggggaatgaatcaaacctgcatgggcaagattcattctttggaatgtctcacaaagcctggtgcagccaattgtgctgcagaggctgtgtggtgtttttgtgttgttttgattttgtttcattttacagggcagccaggcagtccaagcaatggttcaagccactattgatgccagcggtgtcatccatgaggtggcactggcacttggaggttataggagtcaggtggagctatatatggttccaaaacacatgtcaagtttggggtgtgggtacgaaaataaagacagattcccagatgtctccgtcagttcaggctgccctaacagaataccatagactgggtggcttaaacaacaaacatttatttctcatggttctggaggctggaaagccgaagatcaaggcctgcttcttggtctgcagatggccttctttttgtatcctcacatggtggaaagcagagatcatctctcttgtttctcttctcctaagggcgctaatcccactcatgagggctcctactcatgatctaattagaaccaaaggtcccacctccaaataccatcatgttggagatcagggcttccgtatatgaatttggggaaaatgtgaacattcagtccatggcaccttccgtaggaagtcttgtcatggcccaatctaagcaaactaaagttcacagttatctcaggttttttgaggggagtggaacgtaagacagcatatccaagaccatcatccaaaaacctatgcctatagtgggcccatgtgacagagcagatatggctgccacccagtggccacatggcagcccatagctcatgagtgctctctgggtttgcagaccgaactgcctatcagaaactgggacagaagcagctattatgcctcctgtccctgtcaggactgggtcaggaatgagggcattagggcttttgtgtgtctctcagattaaactctgctcacttgaggttaaaacaaggcagaagctggcctgagataatcaaagcctctttcaaatctatttgcttataaaggcaaggtgtttttggtgtctacaaacttctaacacatttgtaggcactgattattctgcaaataatgggggacctttctgaagccctggatccctggccaatgcaccctactccaagcacattgaaatttttaacaaaatttttaataaaattgagagatccttggcatctcaagaacaggaaaatcattacttcttcaaatgaatcattggtgctcataagggaaaagtctttcatgcctagggcatgtatccagataattttggtggggaataacatttcttaccacattgtgagtgtttatgtggctggggcaaaagaagttgtggtttcggtgctgatccattagcagtgagtgtggtaggtgaaagttccttaattgttccccagagtaaaaacatcccagtatttatagactattaggggagagggggttggagaggcaggtgacttttcagccctacactgatgacttttatgtcttccaggtcacattaaaatgttttgcttgaattagaataaaagtagtcctttttgtccactctaaattcagtgtcttggttgaaagtatccacagaaaacattcctcagtcttcataatttcccatttacaatagagaagcaaggctctctgtacttaagaatagtacaagctattttagatgtcagatgtagtctaagaatgattgagtcaacaaaggagcatgaagacagtgatgagttctccacacagcaggtgctcagtgtagggtgataaagaactagaatggcagctaagtaggtggcaccagactctgaagaagcacttagtcattgtctagaatgtgccagaccaagtgcagttttaaagctctctctggtctccttgtcctgtgaacagacataaggcctaaataagaggcagaattgggaggctttttctttgcacctcaccttccttaccacctggccttctaggcattggagacagaagagaatctcccacatgcaaatcagcccccaggtcatcttatagcaacaaaagcctgggcaagaattaataaagaaatgagtggaatctaaaagtctctaaacataaagaaatacctgtaagatgtctcttctgagagcccattatatagaaaggagtcaaaggaagaagagaagccaagtgcatggatccaggagagtaactggtccagtgcatttctgtttaccatacctttattcctctaaattttttcagcagttctggagtagctccattagatccttgatgagttaattttgccctagatcaatttcaaagcttaaggatacagtgagaagagaaggtttgaaataccttagggaaattacaggatcaaataaattttattattatgccagctcagacagattggtagtgttgggaaagattctagtgtcacaggaaacaactatcctgaagtttctatggcgtcttctgggccatattttaaaatttgactattcaggcatacctcattttattgctctttaccttcttgcacttttgagttattgaattttcttttttcaaatggaagttttgccgccaccttgcatcaagcattttccaacagcgtgtgctgacttcatgtctctgtgttgcattttggtaattcttgaaacttattattatatttgtcaatggtaatctatgattagttatcttcgatgttactattgtaattgttttggggtgccatcacccatgcccatgtagaatgttcatagataaatgttgcatgggttctgactgttccaccaaccagctgttcctccagccttctccctcccttcaggtttccctattctctttgatacaataatattgacattaggccaattaatagccctactgtggcctccaagtgctcaagtagaaagaaagagttgcacatttctcgctttaaatcaaaagctaaaaattaataagtttagtgagaaaggcatatctaaagttaagataggctgaaagctaggccttttaggcctagctgtaaaggcctaaaagttagccaagctgtaaaggcaaaagaaaagttcttgaaggaaattaaaagtgggcacatgaatgataagaaagtaaaacagatattgctgatatgcagaaagttttactgctctaggtggaagatcaaaccagccacacatttccttaatccagagcctaatccagagcaatgccctaatgcttgagttttatgaaggctgagagaggtgaggaagctgcagaagaaaggtttgaaattagtaaaggttagttcaaaaaagccatctccataacataatagtgcaaattgaagcagcaagtgctgatatagaacctgcagcaagttatccagaagatctaggtaagatcattgatgaagatggctacactaaccaacatattttcaatgtagataaaaagccttctattggataagaaaccatctaggactttcatagctggagagggaaagtcagtgcctggctttagaggacaggctaaactctcttttttgaatctaatatagctggtgactttaagttgaaaccaatgctcatttgccattctgaaaatcctagggccctaagaattatgctgaatctactctgcctgtactctgtaagttgaacaacaaagtctggatgagagcccatctgtttacagcatggtttactgaatatttcaagccaatttttgagacctactactcagaaaacaaagtattttatgtaaaaatattactgttcatcgacaatgcacttagttaccaaagagctttgataaaaatgttcactaagattaatatttttatgcctgctaacacaacatcattctgcagctcaaggagtaatttagacttttaagccttattatttaagaaatacagtttgtaaggctatagcttccatagatagtgatttctctgatggatcacaaagccttttagaaaggattcaccattctagatgccattatgaacatttgtgattaatgaggaaaggtcaaaatatcaacattaacaggaatttggaagaagttgattccagctctcatggatgactttgaggtttggaagaagttgatcacaaccctcatggatgactttgaggagttcaagacttcagtggaggaagtaactgcagatgtggtgaaaataggaaaaaaaaaaaccctggaaggagagcttaggatatgactaaattgatgcaatctcatgataaaacttgtatggatgaggagttgcttcttatggatttgcaataaaagagcagtttcttgagatggaatccactcttggtaaagatgctgtggacaatgttgaaacgacaacaaaggacttagaatattacataacttaattggtaaaggaatgataaggtttgagaagattgactccaattttgtaagaagttcagctgaaggtaaaatgctgtcaaacagcattacatgctacaaagaaatcttttgtgaaaggaagagtcaatcaatgtggcaaacttcgttgttgttttattttaggaaattgcacagccaccccaacattcagtaaccactagcctgatcagtggttatcaaaactgaggcagaccctacaccagcaaaaagattacatctcactgaaggctgtcaacttagatgactgttagcattttttttaacaataaagtgattttaattaaggtttgtacattgtgtttttagacataatgctattacacacttaataggctacagtatagtgtaaacataatttttgtatgcaccaggaaatgaaaaaacatttgtgtaactcactttattgtgatagtctctttattgcagtggtctgtcactgaacccacaatattaatatttttgagatatatctgtatgtgtttatgtccttaagcaatatatattacactttgagtgttcaaaatttatataaatggtatcatactgtgcatatctgtacagcttactttttaaacataatgttttgtctatgttgataagatttatctatgttgatttcattcattcatattaactgttacttcatgctccatacttttttttttttttgtagagacagggtttcactgtgttgcccaggctagtcttgaactcccgggctcaagcaattgactcagcttccctaagtgattggagctaaaattatctcccaccacacccagctactccagtatattttcatccacagttgtgccagagtttatctagtacatatacctagaagtgcagtttcctgctaggtcataagctggatgtttataactttactaggtattgccaaattgctttccaaagtgatgtacaaattcacactcccaccagcagaatataaatattccagtttccttgcatccttgacagtttttggtattgccaataaatcaaataatgtagtataaaccaactcaatatagtgtaagccagatttaccctgtaaaacatatgcctaaagttcccattttaaggtccttgtttctactgagaatccagaggcctcaaaggtgcatatattgcacattacctccctcatttcctattctactaagccccagtgagtggccttccctgcaggtgtcagcttggagctggtctcttctttattagcaccaagttgctgtcttttaaatttagaactgttgtagttcttctagtcctgcagaatttcattactctggcctcaattgctcacatgtaccatctttcaaaaatgtcaggatagatgagaagatcacagggccatactctccttcagacgataaagcaaaacacaaccaaaccctcaaagcagatatgattactgcagcaacaggaaataaaggcacaaaaattgttataaatgattgttttcatagaaaaaaagtattaccaaaatacattcattttttacccactgtaggcttccctctttggaggcattgattagtagatacgaaatccttatcttctctctagagtttgaaatgtataattaacaatggagtctgccagatcaacaattctcatcacagaatgtcctgtgttttagtctttgtggaccatatggttgatctaccttatcattgttattagtgtggacccttttttgtgttagtctttttcttacattttctacaatagttaaacaaaatatttatttttgttgttatatgattttaaaaaccttatattattcagcttagcctgaaagcccaactgtgcaacagaaaatggctcttctcttaattaattaatttcaatttgatgaattaactttaataacatgctaatgtatagaaagctactaaatttttcagaataagtgtattgaaatttctcttccaagagtgatgccagctttgcttcctttatttgtgagtgggaagtgaggtttaatgctacaatggccttctagaaaccctgaagcagtagtttgacaaggatggaaacgttgagatcattgaattattgagcttgaataaacttctgagcattcattgattaatttatcaaataaccatgtattaaacacttccatatgtcaggcactgtgctaagtgttggagataaaatgatgatcagggagaagatatccttctcctggttcaaatccgttgtctagttttcatcagcttttgagtcaatataatgtttaaggacatgagattctacagccaaatagaaggatttctattgctctttggttttgacatttaacttgaaaagtaacactaataatgactaatctataatctaagattatataagtatatgtataattacatataattacatattttatattgtgtatatatgcatatacatggatggaactggaggccattatccttaccaaaccaacacaggaacagaaaaccaaatactgcatattcttatttataagtgggagctaaatgatgagaacacatggacacatagaaggaaacacacactggggcctgtaggaagacagagggtgggaagagggagaggatcatcaaaaataactaatgagtgctaggcttaatacttggtgatgaaataatctgtacaacaaatccccatgacacaagtttacctacgtaacaaacctgcacttgtacccctgaagttaaaagttaaataaagaaaagaagcaccttttctatttattactgaaaaaatacatattgtaaaccttaaaaaataagagacgacaggttcttgagcagaaactgtgattcagaattttggattggctgcacttgaaatactaacataaagactggttttgccagtggaatctgagtttggaatttgactcctttttttcctgctactcccttccccagcttgtacatgaatgcagtcttctagctcatttaaattagttctttaacttatagcaactgaaagtagagtggtttgattttatcaactggaacaaacaactcaacagtttttgtagtttttgtctgttgctgtccctctccttttcagatgtcattaagtgactttcctgggcttaagagtctaccctgaggacctcaatactctggtttctgcccaagttgtctggtctacctcctgaactagcatgtctacaatctgaggaaatgcaccctaaattgataccctgatattttcagtgggctatggattggcaggaagagaccataaacacacactttatttaatttctgagttaattatccagggataaaagtattatcagaaacatggtggctacacaggaaagcaacagatgtagtattcactaaaacagcttcatttggtacccagagtccttcatagcagcaagcagctgatagagacactccatttgggggttgagtccttccaaatctttctggaaagctcaattctttctatgacacagtcttatgtgcttggggcttatgtcacattctaaaataattgacattgacaatcgatgcatgcccatttaaaggattgtttttgaacactggaatctgtcagttcttaatgcaaatgtagcatagcaaggccacatcttcttctggagcgggagttagaatccacgtgcagatgttctggacaaatggctttgcttccagatttgcaaaatgttcttgaaaacccttatccctataggcacagataccataagagaaaaaatagaaataagtaggaatcgggattgggatttgcttgaatctttacagcaagaccctctccatattttcagttttcaaaatcagtgaaatacttcagatcagtggtttgtaaattgctctgtggagacctcagattctttgataatgccagaggaggaaacataagtatttttcgtttgttaggacctcaatcattcctggataatgaattttcagaggggaatggacttggtttattttatagactgtttgagcctaaaggaaaatgactacacctcccaaagcagatgactaattttcagaaattgttttttggaaaagtgggtctcctttttaatttcccattcgcaccccatgtatgttctcttatcagtgaaggagatgagaagccactctggggaaaagacacgtagaagatcaagaaagctcttttcctcattgcgtgattgatactcggttttgttttttttgttgttgttgctgttgttttatgggagtcttgctctgttgtcaggctggagtccagtggcacaacctcggcccactgcaacctctgcctcccgggttcaagcaattctcctgcctcagcctctccagtagcagcgattacaggcgagcgccaccatgcccggctaatttttgtatttttagtagagatgcggtttcaccatgttggccaggatgatctcgatctcttgaccttgtgatccacctgcctcggcctcccaaagtgctgggattacaggcgtgagccaccacacctggccgattgatacttttttgttggttcattccagtgctgaaaattgggctggatttgccaaaacaaatctgaaactggctttctatgcctgtggattctgttcctattgtctgtccattcactgttctgtttagttcatggattaagactgtcagcatcacgaagtatcagcagtaggatgtttggtgcagggaagatgtgagcacctgcatatcttccctgcaccaaacatctgatactttttttttttgaggaaataaaagccccaaggaaccaagtacgacactttgacagtcattgggctttttgagcctgggccttgttaaggcagctgcctgtaccgttgtggaatcacttcagctactgtctagtcctcagtgctacagcctcagggcattgattttagctaataatagtggtcaacattaattgagcatttactatatgctaaacagtgtcctaagtgcttacttgtaggaactaattcagtcctcgcagtaactctaggagacagatactacactgtcattgtggatgggatggggtttgggtggggaattggggtggggcttgttggggaaagaatctaaagcacaaagatagctttcccaaggccatgctgctgatttgggtttggaactgggattaaaatccacattctcatgggttccaagcccatggttatagtcagtcattatgttccacttcctcactagctcttcatcaagtattatcagaaagcaaggaattatttttcagactagcagaaatttactagtgacttagtaatatgtcagaatgtcatggtagaaaatcattccagagctttgctgtttagtacagtagccacaatccacatctggctgctgagcacttgaaatgtgcctggtctgaattgaggtgtgttttacgtttaaaatcacactgtatattgaagacttaataccaaaaaaagtgaaagatcttagaaaaagtttcttatgttgattatatgttgaaatgataaaattttggatatattaggttaagtaaaatgtattattaaaactaacatcactggcttctttttacttttaaaaaatgtagccactagaaaatttataattacatatgccacttattttatattgctattggacattattctagagaattaaaaatgtgcaaattatccacagccatttcctcatacctgtgacactcagtcattcatccgaattagcttgtggtcagtttgaggcagtttgtctaacgtttgagttacgagatcagagcaagaggtgctggtccattttagacgtgctttatttagtttgtagaaaaacacactgaaccatcctattccgctacagagtgccccagcttcacaaagcagaatatggaagggtagactagtgaaaataagtaaatacagataaataggttatgacatgtagttgagattcagataagtggagcaagattccgcagattgcactgtattagtgacagtgagtgtattctaagagaggagaggatctttatgtgtggtaaaagtagctggggaccaagttgttgagaattttgtatgtcaggaaaaggaatgcatttggagtgacaaacttttgtcactttccaaagactccttttagaattctttattgatcaatagaatattttgtcgtgacttacttcataatttatgatatgttaaaatttccaaattttctgtttattttatgttagttacatcttagattgatgattccctggtggaatttggaaagacatcttaatcacaccagcagtatttatgtaaaccatttttaaggatggtttacttcttagttaactctaaaggaaggataatgtcatctattgaataaagattctcacttttctacttggagatcatattgtcttcttaaatctttgtcccttaggctttgataatggactacatctcatctgggggcctctcttctctgactgtattaaccatacttatcttggagttgaaagaccttggaaggaagccaggatctaacagtcagggtctatggatctttggcaagtattacaggcaggccctggatgtgtggagtaacagaggcctctaacgagggggcacaatagggttggcttatgtggacattacattctgaaattggcacatgaggttaaaaaatgcttataatcaaatttggcctggataaggcttttaaactactcctaaattagacgcttgaaagctccaaagccaggatttagcattgttgattttgctttgtatttcttctgagacacccctttccaggagacacggaagtcaggtctacttggaatgaggaaaagggttatgtggtaaatagaaaattctcagtccaggcacaatggctcacacctgtaatcccagcattttgggaggctgaggcaggagggtcactcaaggtcaggagttcaagaccagctgggcaacatagtgagtccccatttctacaaaattagctgggcatggtggaatacacctgtagtcccagctacttaggaggctgaggcaggagggtccattgagcccacaagttcgaggctgcagtgacccatgattgtatcactatacttcagtttgggagacagagcaagaccttgtctcaaaaacaacaacaaaatatcctactccctctcattttttccccaagagtattgaaagctgaatttgtgtaagttatacataaatatcatgcaacttcattgtactgcttattttcctaataagttaattgacttgtattatgctttacatattttgggcttgttacttgtttgtgcctaatgtatgaaaggcagctagaacctatctttctaaactgaagagctctaaatctggttagggaaatagacaagtaaatcaagggttataatgcaaattaagaagtactttaacaaggcctttcctcagtgctttaggaccacagaggaggagccattaaagtgatctgggcatgagtaaaggctgtatgtgacatcctagcctaagctaccatcatttctcattgcattggtgcaacaactttctaaatgctttctctgtttctgtttttgcccctggatctccctctctcccaagtctatagctccctagcagctgcagtattcctcttaaaaatgtaagaggcacatatgctcctatctactcaaaaccctccagtggctttccatcttgctcagaatcagagctcaagttctaaaaggcctataagaccttgtacaatctggcccttgctgcctctctatcctcatctccaatgtgcacctcctcattcaccctgatgcagccacaccaatctccttgatgttctttgaacatgctgttcacatgactgctcaagacttttgtccttactgtagtctgtctgcttggaattgtcattactcaaatgtctgtatggcttgttctctcatgtttccaaagctctgaagaaatgtcacttttttttttttttttttttgagatggagcttcactcttgttgcccaggatggagtgcaatggcatgatctcagcccaccacaacctccacctcctgggttcaagcgattctcctgccttagcctcttgagtagctgggattacaggcatgcaccaccatgtcagctaatgtttttctttcttttttttttttttttgtatttagtaaagcctgggtttcacagtgttaggctgatctcgaactcctgacctcaggtgatccacccacctcggcctcccaaagtgctgggattacaggcgtgtgccaccgcacccggccatgtcacagttttataggcctttcctgactaccctgtacaaataaaaacaagaataagcctccaccctatcctagcactccttcttccgtttagcttgtccatcaccatctaacatgccgtaaattcacttctttatttgccccatccccttagattttaaagttcatgaaagtaaaactgcatctgtgtcatctactttggaacagttcctggcacttagtattttaattcaatacatgtttgttgaatgaataacttacttttctctctggcatggcttccacatttatttgcctaatgagtggatcgataaatgaatgatgactatattctcttggcactagcagaatctgttatttcccaatgtaccatttctctgaaataactttacagttctttattggaacaaaagactttatcaggacttgtcaggagctcttggattctgccaagacagcatctcactcacagatggaaattgccattaattgtctgctttgatggtggagcacaacattggaaaagaagacgcctcctggaaagcaggttttgccattggtgagagagaataagagtgaattgggctggccacagcctccctcatattgagaaacccaattggtaatactcagctagcatacagattagtaatgtgtgagtgtctgcatgtgtgtgcatgcttccgtgtttatatattaccagtgtatgtgcgtacctttgtatatatgagtaaaaatatatatgaagtaaaaaatcaaaatctaataactcaaaatccaaagacttgaacaccccaagggaacactgaagtctcagcagaacccttgatgcttgggaaagtagaaatatagggaaggtttgcataattccctgtgttcacttctagctcactgaatgtgactttctgctgagcctaagcatacagcaatgaataacaacaatagtaacaacatgaggggtccctgctttcatagagcttgcattctagtaagtggggcaaaaagcaagcaaagaaatctaagttatatatggtggtataaatgctatgaggagaggaaataaagcacaatgagggagaagatgatggagtgcattttagaaatgggaattgatagaatctgggatttgcttgacaaaaagttgaaggagaagcagatgcaaagacctgagattcaggtgcttgttgaattcaagggacatgaaaaagaacaaattagggaaggtcaagttatataaagcctttaagccatggtaagaagtttggattttattctggttacaatgaaaaagccatcaagcgctatttagcaagggagtgactggtctgaattaggaaaacccccctggctgttctatggagggtggagtatggtgtgtgctagaagagacagaagatacatagatggctgttactgcaacccagggaggaaacatagcaatgtggattagagtagaagtgatgggaattgtaagtagatgagtgtgggatatattttggaggtagagtcaacaggatttattgatgaattgtacattgagtatgcgaggtgagtaactgaggataactttattagtcaagataagctaggctgtgttgtggcaacaaactgttccaaaatctcagaggcttaacacaaaagaggtttatttctcagtaatttgtatatccctgtgttttggctggtggctttgctttgtttattattgttcttactctaggacatgggatggcagggtaaccactaactggaacattgctggttgacattgaaaagggataaataaaatttaaagggtttcaccctgggagtgattaagcatttggcctcgacatgacacataacacttctgctcaaactaattggccagaagtaatcatatggctccatcctgcacaaggggccgataaatacaatcctgtcttgtgccaggagacaaaggactagagcctactcagacagcaacaccaatgactctatagtatcttcctggtttgaataactgttaatggcattatccaagtgcagatatttgaaaggaatgagctggggggatgtgaaatccatatttcttttttagccttttttagtttaaaagcctattgagtggagatgtcaagaagacacttggagatatgattcttaagatcggagaaaatctaggggtagagaaataaatttgagcatccacaacatgaatatgacacttaaagtatcaggacttataggtacctgttgagaaccctcaagttctatctttggattcctataaagaaggaattcctatagagaaggaatccaaagacagaacatgagggctctcaacaggtagagatcttacagagagaaaaccaacaaaggaaataaaaagagagaggttctcatggtagatagaaacacaagagagtattgaatcttaaaaggcctcaagaagtaagtattgcaagaaaaagggaatgctgagaggtcaaggaaaatgagatttaattattggatctggcaagctattgaccattttactggtttggtataaagaagaggctaatttaaagggggctgagaagagaatggtaagtgtggaattgatgaaaatggtcatagacaacttttggaagagttttgctgtaatcatagcagtaaagtggggtcagtagtgaaaagggacatggtgtcaagaagataggtggtcaggaaagggagcaggtttgtgggccagatgatggttttgtcttttgaaatatgctgacctgataaaaaggtattcaaatgaaaagcattcagatattagttggagatataagtcagacatagagaaaaaccagtgccagcataaacatggaggagccctcttcatagagaaaagagaacagggaacacagatgggctctgataggaaaagtatagagaaaaaagattgagcgctcacattaataaaatcaggagaaaaaagcagattatgtcctagaaatcaaggaaagaaagtttaaatacctttgcaagaggtttttcttcactttctatgttcctggaaatatgtagtctatattctgtactctctggccaaatttgaaggggatagtactgtagctgattaaatatataatctaagaactgtggaataaagataggattaaaggttttttaaatctcaaatcagtggggttgatgctctttgtgtttctgttctttttgttattgttttctcttgttattttgaaatttctctaaaaactacttaaaagtatagttagtgccatactcatcgttgtatttttcttcttttttacctcctcctcctccttcatcaccatcttcactaatgattatcactagcaaaataatcatcaccatcagacttcattaaattaactattttggtattttaataattcagagctatttttcataatttggttagaactactgaggggcattcattttagtataatagaacatttttatagcacttcttgttatttgagtacttattaaatgcttactttaaacatgggcataatttctgccctaagtccttttcagttaaatttcctaggaaagatacaagagttccaggatggaaaagaagtgctcagagggaatacaagagattaagaccacaaatatatggtatcactagaataatttggcagaggtttatttctatttaggttagttggctataataaacatatgtagataaatagtataggaatatagtacagggtaaaatggtgactcaatatcttaatatcaaatgaaaaatgggctgcttcctccttctaggctggaataatgtactattattgacaccccttctctggagtataatttggcttagttctggtggtctgttgagtggcttggtctcactctctttctctctctctctctctctcaacctctctcccctctcccccttcctcctctttctctctgcccttccttctggctgtccatccttctctccctcctccgctcctccccactatctctcacttctccaactcagttctttctatcagtgtcttgacatctaactagttaccctagagacctcaaagcaattattctttccttaaacattctttcaaaacccagtcgttccttaggcatattgacttgaatcatgtctatctttgccattgctaccttcttagttctaatattcatcattattttctgggttacctccatggcatcctaacttgtgcctgcctcttttgttttattccactccaatgatccctcctattcacatgcctctcctccaaccttctcccatcttagttattgtgcttaagaaaattatggatcatagaccaagtataggatagcagtgtgaggaagtagattgaaggagggagacataggagttggagttagaactagttcggaagttagattgtacttgtcaatgagagacttaatccagattccatctctctaggacagaatagaccatttctatctacatggagtatcccttacatgatatccatatttctctcttaacatcattgtacacatatgtttacatgtgtaacacttctactaaattgtaagctccttaaggtcagagaccatgtcctaacattcagtaagctctccatggttgtttgttgagtaaacaaataaaatatggtcttaaatagaaccagtgtcagaaggaatagggtggagaaaatgaatataaaaaagattggatatggaattaaatggacttagtaaaatattaattctgggacaatgaagagagaaggttcagatatatctacacaaatttgagcttaggtgaccattaacagaaataaggaagttgggaggaggaaccgatgagtttgcttttaggcaggttgattttaaagttctgtagagaattttaattttaggtggatgaattgttccagcagacaattcagatttgaagcctgaagctttggagggagttttggtctagaagtaaagatgtgttagtgagtgaaattaccaagacaccgcagtgaaaacaggaaagagagccttcatcagatgcgtgggggaagcctctttttaagaaatttggaaaaggagctgacagaaaatgagtctgaaaatgagaggcagaaatgagtcatcaaagagttacttggaaagtgtacagtcaggaaacccaggaaaagaggatgttgaggaaggagtgagagaaatgccagctattgcacagatattgcatattatgagaatggaggcctatataaatttgagtagtagaacatcagtaatattattttagaattatttgctcttgggttaaatatgttttctcttaggaagcaactaagttaaaacacgatatttagagtgctgcagagacaaggttgtaaaaattctctcctatatcatcggtggttgaataaaattcctttattggtttttcttggaactgtaccctctagccaaacagcccagtggaatccagtgatagaagccaaagaaataaaagctaagtgtctcaatttatcctgttgtcactttcagctttctctgctcattattagataccaagataagcaatagatttaggttttttgatggaattctagtggatgccttggctctctttgtcctggatctagggacactctagtcagattctcaaattttttcttttttcttttttgcacattcatggcttgaataagggtaagagagcccgggatagatgctaacaatctttcagattgttatctgaaatagatatcttgagatatgctgttagtattttcttcaaggcatgccatgttgttagcattttcttcaaggcagcccatgattaggccagaggaggaggatgccgctattcacttctaacctccatccttgaattatggtaaatacagaagatgcttgctggtcagaagagagttgactcattatgtcaggtagtaaaccaaaaattttctccctttatgatgaaagaaaacgcagataaaagcatgaccaataaacaagccataagaatggggaaaacagtgatgacacggggttagtgctatagaagttcccagaaaggtgtttgaaaactctgggcctataaatttaattatgtactattatttactaatattatatactaatatttactttgtttggaggtagaaacgctttactatccacttgtctttagtgtgaacactttcttaggaagcattaatgaaacacctaatactacctgcttccatggcagtccaaaattaagctctaaagattgaggagtcagaggtaaaggtcggtaggtttttctgtggtcttgacttcttctcaagatatctatttgatttccagtaataggaagtggctcccaattacatctattcccagggtccctccctattctcttgtcatcttgatttcagtttggcctgattagatggtactaagttttctatatggtaatttatattacaagaaaaattggtaaatggtgggatactgcttcaaatctgcagcaatataggtaggtgtctttggtgaggttttgtttgcaattataggattccctagatggggactctttcatgaaaaatcataacagcaagtggttgaataaaggttatttctagactgttttctccagactaattagagtagtacaagggccaaccatacagcctcatagtttcaagggtgctttgggagtcagatggacttgagtttaaatcttgcctctgccacataaaagctttgtgagcttggacaagtcatttacttctctcagcctcagttttctcatctgtaaaatgagataattatggcatcttatagaattgttgcgataatttcagatagtctaaatataaagcatttggcaggccaggcgcagtggctcacgcctgtaatcccagcactttgggaggccgaggtgggtggatcatgtgaggtcatgagttcaagacgagcctggccaacatagtgaaatcccgtctctactaataatacaaatattagctgagtgtgtggtggcacacgtctgcagtcccagctactcaggaggctgaggcaggagaattccttgaactcaggaggtgggggttgcagtgagccgagatcatgccactgcattccagcccaggcaacagagcgagactccatctcaaaaacaaaacaaaacaaaacaaacaaacaaaaataaagaaataaagcatttggcacagttcttggcacttagtatctagccttcattattagtcttagatggaaaactggatgcctcaatagacctggccaggacagcattcccacagtctccatcaagtcagcaagctttatcagctttatctctgatatttctttctagacagttcctctcctttttcatcattaccactactgctgtagacctgggcactaccttctcttagttggattttttggtaatacttatacacggttgccatgtagttctcataaaacttgttttgttttgttttgttttttcccccactgctcaaatacctgctctagatccctggtcctcagctttgtacttaagactatgatttggtatgagccagttttatcaatttaatcatctattttttattttcttcacgcatttctccccaaacacacatatcatccccaagccaataataattcctttcaaagtactttttgtacttttggtcttatgtatgtcatgttgcaatagcttttcaagttgattttcgtgtgtgtgtgtgtgtgtgtgtgtgtgtgtgtgtgtgtgtgtgtgtgtgtgtgtgttctcttgctttcttttagttcattccctatgtgaccaccagattaatcttttatataataccaacctgacctcgtcactcttctgaaccagagcgatttcctagtgcctttaggatcaagttaaaacttctacatcagctggatgcaggaggtcttctggggcatttttcagcctcaactcaactgtcactcccactatactgtgcaattcaactatattgattgctcttgagactacacatatgccaagatttctcactctcatttcttgccatccgtgctatttcttttaccttcctatttcaaaacctggctaatgccactcatttatcaggtctcaccttagtactccatcctttcaaaggcatttctgattgccccttccctctgcccacagcttgaattaagagctcatccctgatttcatggtagtttggaaatatctttttagaaacctttatcatgcaaattgctcattttgattttctgactgtctcctcttctaaaagaaggcttacttgcagtattttttaatctttgtatttccatagagcatgacactcaataaatatatgagtgtgtgaaaaactgaataaatgtgtgtatgtctgtttcttttaatagagtaagttattttagggaagggccaatgactcttttctgcttgtaggctccacgtttcctagcatggtcctttgtatataatagttgatcaataagtagtgtctgaataatgatatacatgtctatcttccccagatcattctaagtttttcagcaaaaagattgtgtcataagaattagatagcctccagcacaacgaattacaaatacttcatactctaatgcacatgtttaatttttgcttggagttgaacttaagttatggtgccttatgagagagtcaggcagcttctctgtactacataagcatgtactcgatgaagcttggggtcaaaaacctggaaactaagtttagttggaaatttaaatgctggagactggatgcatcctaggagtggattactagtattgatactcctagacaattttctattcttatttggttctttctccataaacctgaccagtccatgtatagcaagcctcaaaggatgcaagccttgttctggtgttttttattgcaagtcaaagtctatcaggagctgaggaatgagcagcagtgggagggtgtattaatttcctgtggttgctgtaacaaattatcacaaatttggtagcttaaaaatagtaattttattttctcataattctggaggtcataagtcagtttcactgggctaaaataaaggtgttaacagggctgcatgtcctcttaaatgtcaaggagagaatctgttgcttgactcttcccatttctgatagctgcccatattccttggcttgtggcccttaatctctatctccatattcacatcatctctctgtctgtatgtgtgatcttcctttgccttcatcttataaggattcaagtgcttgcatttagggtccacctggagaatacaggatagtctcacctcaagatccctaacttaatcacatctgtaaagactcctttccaaataaaataatatttacagtttccatggattaggatatatctttggggaacattattcagcctactacagagatacctttctctttttgtagattcaaagtgcttgatcttctaagaacattgtttgcttacagacatatttcaggagtaaatgacttccaaactgatggtccgttgaaaaaaagcctggggctgctgtcaggaaaggtctaatttaggtcagcctaatgccactgaacagatgtatatggcaacattcccaactcccattaggaaaataagccattaattaatacttattgaggagctgataagtaactggaagagctggtctgagttctggacaaggaatcagtgacaatcagtttccactgtctggctgttgtgggtagattgtggtccatctctgtaggataaagtgtgcacagttggcttggcactcactcttctgtgtccagcagtagctcttgccatctgtcttatcaagagaataaaaatgggtctaagttgtcactgggagattactgagtatcagtggacactatgagctcgagtgggcaaccccatgcaaggttagagcagggacttcaccaatgtttgaattagggaacttcagtacctaaaattgggatgcagatgtttcttgacttcttcatgtcttttccacctctttcatataatctaagggggatatggaccttggaggagtcttcctcaaggctttggcaggtgctcctaaacatgcttcatccatgcctacttgagtgtaatctgctatcttaagccacaggcaggagagatcaatttttctagtaacttcttttataatccagctagctgaagaagtgtgatcaaagaatcttaaaagtgtgatcttgaagaatcttagtttctcttctgttgtagagagaggatagtaatagttgctaagcctataggctctgaagccagacttatctctatttccatgctggctccactacttaatagctgtgtgagcttaggtagataataaaatctcagattcccagttttctcaattgtaaaatgaggataatagtaaccaatatatgcaaggtgccaggagatattctaagcatgttacatgtatttaaccttcttattctcacatcaaccctatgaggtaaatgtactattgttatcctacttcaaagatgggaaaactgaggtacagagagattaagtaacctgtctagatcacacagtaacaagtcgcagaacaagaatttcaactcagagtatatgcttcaactcagaatatacttcaactcagcatatttgctgttaactatattttatgctgcttcttgtgcctcagattgtgaggatcaaatagggtggccatctattccaggtcaccttggaaagttctgggtaatatctcctgtccaggtgaattattaatagtgcctccttcttttattctcaaaggtattgtcacatcttggtttgaatatatttcacatttggattaaatagtctttacatgtgaaacactaagaacaatgaccaacccataggaagctctctgttaatattagctatcactgtttctactactgccatcaccaccactgtcaccatcacccacattcatcccaagtctgggacccttagggttaggggattaacccaagttctgcaaaggcatgtcatgggagccactgttcccagttcccacacccgtagcagacattgctcgttgatcacagtacaacagtcttccttacttagtgtcatagacaaccattcgtgatagatcacgtttgagatgtgaaattaaaattatttatcacacctagttttatttaatctcagaatacaaaatcccagcgtatggagaatctgaatttagtctgagcttgtggttttatatgaaaacttatttgattcctagaagtgataatgaatttgggacctctttagacatcctatgtcccttttctccaatatttctttctacctatttctctattatttctacctcttcttttatataaatataaaagaaatttaattcatcagtttcctattctctgcctataattttatatgttataataaaagactattgaaatactaccaaagtggacacaatataaataaggcaacggagtgagtcatcataggaattacagttggcacccaagatcaaaggcttagaaaatctatctttaaatgtgatttgtgtaactggtagtgaaattcatttcaggttgattttgcatggcataagggacatctagtggtgatctaggtctctgcagatttactaaaggtaatgcaaactcataggtaaaagtattagggcctatataccatcaccttgaaagggagtcccaagaaaggaggggaccttttgttgcatgactacttttaagctagcaaagtgtaaagaaaccttttttggaaaaaaattaattcgagtaccagcatttctgtctatattattgtcagtttgcacccaactcttatttgctgcctcctgtaccaggttggaaatcattctgttatcagctacctgccaacctgacatattcttcctatcactttccccacctcttttgctgattgcagaggggctctttggagcactttgaaaagccacctgattaaagccttcattaggctagaagcagaagtgcttcacaggccaggcaagaaatactttgtaattgcttctgacgggcagatctcctttggcggttgttgagccatcaggaagccgtacagcactggtccacgtgtattttgtataaattagtgggcttgacattacaagaggttgcccctatacgcagtcatcttcttagccccagagttctggaacttacccattagcctgcacctctttatagaacccgtcttacgcatggttctgaactaactgcttctgtcacctggattgcttacaatacctgcttgcctcatgtgctactattgtttccaaccaactatgctagacttcttaaaggttctatttcattgaatgcttttacagtattttctatgactcttttgtctttgagcctctcagattagctttttctacaaaagctgtttggcatgcctattgtcatctattttctttcagagtagctgctaacagccagaagctgctagttatggccaaaggcctcattgttggagagtcgttcttgttctttgactctaggtagagaggatgaaggctctgagatactgtctcaaaacattcatgtgttttctatgacaagtcaaagctacattgtcatattagaggtgtccagtagccccttagcgtgcctcagagtgggaggtagtgttggcaccgaactttgtcagccagtctcttagaggatcttactggagtttgtgattgagcttttacttcttctgttagtgttctgctgagacatatacactaatgatagctgccactctggggtgcagaactttccatatagattgccttaaaaataaaagcaaattttctatgcatacatgccggggaaaactctactaaatattcagtggttccaagaaatgccttttaaccatttgtaatactttagctttctaccttttcatctcattacttattttcaggcagaatagatatagaggcttctttctgcattatagtcttcacagacttaaaggcatcaggaagtagcccttgtgattttccttgctcttcttcttcccatttttccacctcctcctgtaagcacgtactttgtgtcaggcattgagagatacagagagaaaaggcataggtttctccccttgagaggctcctggtctactggaagaaacagacaattccagcacaatgtgatagatacaatgatagcagttagaacatgaagccatgggggcggagaggaagaaatcagctgtgggtgggaatggagtgggtagaaatattgaagaaggtttctaaaaagaggtgatgcctaaactgtgcttcaagtggcgaatagtagttatccaggtagagaatccaggcaagatttatccctggaatgataaattggaggacctgctgaacttttgtcaaggctggtaacaatgaagtgaggactagatcaggaagaggtttttatataatgcttcaaagtttgcatttaattctgaagttgataaagaaccatcgaacaattttaagcagagaatgacatgttattcccagacatgttaatagtgagacgattagagtcatttctagtcctcggaataaaaataacagtagtttcctagtggttcagcaaggtatgttttaaatttcgtcatctttttaatcaaactgcttaaggcttcctttctactctaatagttacctttttcccctaattgcataatgtatatatttttagagcttttcataatcaggtaccacctattcacctcatcttaattcctctgctttgtgacatgtaacttttactctactggagttggtgccctcatcaaatattctaaaacagaaggaaatgtaggcattctctgggtaggtttgtttagtgcctaagaaaatgcaggaaatgagagtgtgtatttattgagcttctactatgtgccacacactttgctaaatacagggaatgcattggttatcacatcagaaacacacaacccatgtgtttatgacgcttagtttagaggatcgaaacagtgccatccctagcaaccagagggcacagaagtacagtttcaatcaagtttatggtcataggtccttgtacattaattgacatgacaaatatatctcactccaattttgatatgaaaaaatattccccccttaattgtccttcaactttctctgtgcatgttgttggcagcaattgtgtctcatggtctatcctccatggtctagagctaaagatacagtggttatttagtacatttacatgggattttgtttctaatattctaatatagctaatcaattcatattaacttggcttttgcgttagaggataagaaaagtggagaataggttcatctcaatttctggctctcagtgactggtagttaacctcctggagcactaccttgagaggattctgaggcttcatctgggttgagtggaagtagaatagaaatatgtctattgatgatgaatgccatctgctgggaaaggagggtagaggcacatatttgccaacatggctctaagaaatgggagagctgctatccagttgtgtctgaaaagattaactggcagctagaaacttttaaaactacccattgactagttctatctcggagaactacaccccctacttgccagttcatgtcttatgtctctgcctgggtctgtctatgtcaagttcttatttgttaacttagtagaagcttagtggactctgtgaaaatgataaagcttgaaagagcaagcctgtgatagactgtgatagactgagcctttatagtatccttaatgctctagaaacttgattgactggaaactttttctttttctttctttctttctttttttttgagatggagtctcactctgtcacccaggctggaatgcagtggcacaatctctgccacctgggttcaagcgattctcctgcttcagcctcccgagtagctgggattacaggcatccaccaccatgcctggctaatttttgtacttttagtagggacggggtttcaccatcttggccagcctggtcttgaactcctgaccttgttatccacctgcctcggcctcccaaagtgttgggattacaggcgtgagccactgcgcccggcctggaaattttttctataagatacacaaatacattgcagcctgttcctgatcagccatttaagtggaataaaagtcctaagaaagttcttcttgagaagaataaaattgagacctccactctgaacaggcatggagcattcaataaggcaaagggtcagaaatcttgcttaacttcttactgttcacatctgtaactgggcataaacctataggatcattttcctttcacaaagaatccatcaaataaatacttgttaaagcctacgcttaacttgagcaccggtagtaatgactcgcattatcagcggggcttttgggcttgcactcatggctctgtgattcatgagggcagaaaaactgactggcttacagctgtctctctttttctggctggcctgcctgcatgcctagataactgaatggcttttttcagaatgaggtatggtctaaggattttgctacttcaacgtcagtttcctggatcttttcttctactccagcttgccatatgtcccttttatattttcttggccactctcttacaaatagggccatagatcagagatggtggccccatctggtgaaatctagctttcagatacgctttgtttgacccatagagtgttggatcacatagaatttttaaaaattaattaactgtcaacattgtactattgatttcaactttatctggagtctttttaacttttattttgagctctagaacttggacattttctggctcctgccttgcaagtctgaacctcagttccagttttctatttttggtgcttagtgtttttgtctttggcagatcctgaccactgttaacaaaatataaagcatgaaaatggtggcatccatgcgatgcagcagttgggactatgagccccaggttggatgtcagctgtatctcagcaggtggagttagtttactgacccctgttagcaagaccagagatgcagatgtgactctggtcatgccagatattaggtttttcagactttgggatctaagaggaccatctgctgccacatttgtgcttggacttcactgttagagtttgatcaatggcatcctgtgatgaaaaatgatgttcatgaatatgaatctaaatctgagcaagtgtttggtgtgtgtgcatctcataaatgtcacattaggcaattaagtatatacaatttataaataagtatatgtaatttataaatacatatatgaagttcataaataaataatatataacttataaataaatatataaagttatgattttatagtttattaaatccagagtttttcttttgttatagccctgcctcttaggcttgacaattggcttagaagttatcctcaagagagaatctttctttttcttttcttattttttttgagatggagtctcagtctgtcacccaggctggagtgtagtggtgcgatatcagctcactgcaacctccacctccggagttcaagtgattctcccactgcaggatcccgagtagctgggattacaggcataccgcaccatacctgctaatttctgtatttttagtagagatggggtttcaccatgttggccatgctggtcttgaactcctggcctcaagtgatccacctgacttggcctcccaaagttctgggattacaggcgaaagcccctttgcccagcctgaatctttccttcttaatgactccatgctatactgtctgttgatttattctggcttttctcagtaaataacaaaattaatagtgatcgccatcacttattgagtgcttatcaagggtcagaaactatgtgaagtacttttatatgtgggaccatcatctcctttatttcttacagtcctatgtggtaagatattatctacattctacagtataagaacataggctgagacaagttaaatatcgtgcccaatgtaacacagttggtaaggtgtccaaaccctggttagggtgtctccaaaggccataatcatgaccatggcactaaactgctacttcaatctaacatctaatttaataaagatatgaacatttgttaagcacctatatagttaggagcaatttcagatgttaaaaggtgtaattcatatttcttgctcataaggtgttcgaaatctattgaaaagacaagacttgtgctgtacaaagataacaaagttgagagagttttaagtgatgagtgagtggagtggacagtttagcggagggagaaatcacagcaggcccaagtcatcagctgcctgagggagagaagggaagtggggcagagacagtgggatgtgtgattccgtggagaccccagaagcaagattctttcacaacacttcttagtcattcttttaccctgagtaggaacgttatgcaataataagattagcccagaagttttatctagaagctgtatcatcctggaagctgaagagaataagttcatttcattattatctattgtcaaaggattaaatttggaagggagataagtatatatttatttttttgcttgttgtgagtaaatgactttgcagttaggtatacagttgaaaagctttattgagatttgtagtcaactctgctccactcatggtaccccaatactggcttctccaccattccatttctccaacttcagaaaatgtccacagcgtccttactttccaacattctccactgatgtggagtggatcattggtgctcaggcctcaagtcacaaacctgtgagtgacatggtcttatccgctgacctggtgttttttattgaagttgtcctctatgcagatagtttaaaaacaagagaaaagaaagaccaggtggtaaacctcctattccttgtcaggagaaatagtgccaagaagccatctgggcactccagggcacatgcccacatcccctcattctttctagttcccttgctggagtgcatagggatggggcatttacaacagaacacgtggaaacacattctcagaaagttgagaacagagtggcctgggataagatggcagagggagagaagaaaatacttctctgagtggggactgtctctaattcttagtttattctcatgcacctgccttctaactcaaataccttggaagaatttgaagtaataagtgcatcatgtagggttagaatactctctctttttccaatcaagtgggttgggcaagagggcagacagcttcctcattggtaggtaataaaaggattctgatttatcagattgtgggatcaccaagtaccagagtagccagggaaattctcaaatggatttgaaaatcctagggaaggagcaccatttagagaggctggagagaagagaaaggcactgcagcctaggaaacccagtgaacaagaatgcagaagcaataacacctgggttcatacagaaacctttgaggtgacccctaagcggggaggtatagacatccattagaaatggattgtgcaggaggggaagggctttgcacatcaagatggacttgggtgtggtttttgtgcgtgactaaggggtttctgctttgtgtgtaggcatggggtacaggagggcctagaaattgccctctctggagcatatccttaccccagtgcagtcagagagataagggctcaagttctgtttatgcatttaatagcctacatgatcttgggcaagtatgtatccctgctgaactccatgtctgtaaaatggggctaatgctacctatttcatttgcttattgtgtatgatataaaacagtgtttgcaaagtacctggcacatggtaggctcttttcttatattgttccggctctcagcttgctttactcctggtattgctcctgtgtgtctctgtattaaagatcatggaggaatataagtatatttttttcctgagagactttgtcttaactttgagattctgtcctcagctgttttactgtctggtctcctaagcatgagtcacgtgtccaaacagcagtctttacaagcccatgggtgggatagtaagaccagcttgtcactgtttgtgactctgcttctgtacctcccagtctgtgtgacatcttcccccatggggagccgtttctactttgtctttaattgctcctcaccgaggcgacttgtcagccaaggctgctttctgtcatttgatgccacatctcttcctatttcagccagccatttggggacattcatttagttgacagtctgattttacagagaacattgtaccagacaataatttgccttgtaagggggtccagcagggtttcctgcctccatgctgacccagggtgccagtacacttctgcgtggctgtggctgtggttctgcacagagcaggtggggaaggtgaagatattaacaatggagagtcccagttgagcatcactgggctacaagtcccttgccctcctgtccttttcctcttggtagataaaccttcacagaacctcaattcaggaccctatccatttccaacagaaccccaacaccatgggagatgaagatataggattatttcttcctaggtttgtgtgccggtttagaattgtctgtgtcctactatgtctaacatcccacttgatcttgacaacagccctgtgagctgggaaagagggacagtttgtggaacagatatcgaggctcttacctttggaataaataaaatgggactcagaagggttattcagctgtcagtgagagtggtgttggctttttattcacaacagtgaaaactccatataaatagacaggtaatttcagggccatggagtagatagagcactcaccctcaaagagcctttgagagaagtctggttatctctgtctggccagtttctggcccttgcttctcttacctatgtcttcagaaatcttcattccggctattcaccttctctcccagtctcagttaggtacccttctcacagaagagttcctcttcactgctcttgtatcttgttaaaaggcttttttttccctcctttttattctgtccccagcctgctgtagcaatgcctgatctctctttctatttattgttccatggagccaaacctccttctgtccctttgggatgacctattgttatacattaataattaacctttactaggaactctagtcacaggcatttaacccaaatgcagaaaaagccaaagtttgtttatgacaaagagttctcacatgctaaggtataatagtgaaggttagaaaggagaagctgacactcattaaacttttatgatttcttttctggtttactcacttgagtgattgcctgaggatcctgcaatatttccctttgcacatggtcagcccagtttagctaaaatgaaaaattcagcttttgaattgtgaagttgagcatgcatgactttccatgtaatgttaaagataagcctcacaggtgctgctagtggggcctggttctgagcatatggaccctggggcccaaatgcctaggttcaagtcctgctctgccacttatcagctgtgtgcctgtgggccggttccctaactgctctctgtgtctgtttctgcatctgtaaaataaggcaatgattacaggtatctcaaatgggtgttgtctgtatctaatgggatggagaggtgttaaatccttaccatggtgcctggtggtaggtgcttaataagtgttagtatcattattttcaatgttattgactatggttaggtccacggtcaaggttacataatagtgagtcattttcaatgcttcgccatagttatatatcactcttgtaatatccattagaatgcaaacagctttgcttgattctctcctggtgatgagagatgggaactaattctacatttaaatattggggattatatgatatgtgctggagtgacccatccaattaactttgtctcacagatatggacagatgaggcttattttagaaattagccattgttgttttggagatgataatgcaaccttttcagggctgtggaaatagcgaaatgagattaacaataaccctccaaatagctgcgacttttgtgcccttatgatattgcattcctaagtgcttcacatgttttaaatcattttattattacaaaataaatagtttgtttattcctatgttcccaatttcaggagaggaaacagactcagaaaatttactttgccaaagtcacatagcttgtaagtagtaaatgtggaattcaaacctaaatctgggtcctgacttagaatttgaataaggtaatataaagaaaataggaaaatagttgggacgctcaatactcagatccttgtctatttcccttccattgttttctgcttattaagtttttatggatacgacattgctcagagatcagagcgccaaaaaccattccagggtactgtatcaaatttcagttcaaataagagtaaaacttttttgaaattctaatttcatggagaaagattaatttctgcttttagatggattatacctggtttagaaagtcataacagatttttttcccataggttattggggttcaggtggtgtttggttacatgaataagttcttaagtggttatttgtgcgattttggtgcactcatcacccaagcagtatacactgcaccctatttgtagtcttttattcctcaccctcatcacacccttcccctcaagtccccaaagtccatgtatcattcttatgcctttgcgtcttcatagcttagctcccacatatcagtgagaacatacaatgttcggttttccattcctgagttacttcacttagaataatagtttccagtcttatccaggtcactgcaaatgccattaattcattcctttttatggctgagtagtattcatatatatatatcacattttcttgatccacttgttgattgatgaacgtttgggttggttccacaattttgcaattggaaattgtgctgctatacacatgcctgtgcaagtatctttttcttataatgacttcttttcctctgggtagatacccagtagtgggattgctggatcaaatggtagttctacttttagttctttaagggatctccacactgttttccatagtggctgttagacagtcataacagatttttttaactgccatcctcacgttctccacctacctacccactctgcaggacagtggccatggctttgcagaagtgtacactaaccttgggtagggcatggaggcagaaagctctgctggacccccttgcaaggtgaattagtatctggttcagtattctttgtaaaatcagactctcaactaaatcaatgtccttgactgactggctgaaatagggcttcagggtgtctcattctaccactgtacagagggcacatgcaatgtgcaaaaaataaaaacaaaaacagacctctgtccccaccagcttttaacacttactcttttctttcaagtaatatatccacatggttgaaaaaaagtctaacactgtaagagggcacagtgaaaagtaagtcaccctcccactccagaatattaatcccgcaaatatactccccaatgacaattttatagttccaaagagactttatgcttactggagcatatatacatataatgcccccacgcccccacacttttacacaatgataacataatgcaccctctatcctgttccttgacaatttcacttaacaatgtgacctggagagcttccacatcaaaaccaaaagcaataccttgtttgcaaggcctgcctaatattccattataacgctgtgccatctgctattgatggtcatttaggttgtttctggtattttactaagggtgcttcagtaaatcactttgtatgaagtatgtgaatccatgcaactcgatctctcttgatttttatttgcaagcttatgttgtataactttctgacaacacaagaaattggccaggagacaaaagaaattctgtagaaatatagaggcttttttggagcttgtgtgcacatcagatgtttcttcagatacctttttggttcctgtgtctcattgtttctcatgttgttttgggctatgtcctgaagcctctttttgggtcatttttccaggtgcccagtgagtgatggatggatactgtttgcaagattgattcacatggcacttttgtttggcttttgacaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtaggaagaggcaggatgtgtgactgagactagacgaaagctgtagcttctcagtttgttttttggctttatgtttcttaattttcacccttgcatgcttgttgattcttttgctactctctttaatggctgttgtaaaattatgtttctgaaaagatacctgtctcatagatggctcacattctccgcttatctctcttgtcactcactgcgcaattgtctcagtgatagctctacgatcctggagctaaggatggttttacaagtagcatttccactgctaccagagcaactctcatgtcactggtgtgatccgcccccattgccccattctttgcttctctttttcctcatcaccatggaaaccgattgtgacatcacagatgctgcattatgtgattattttgtaggataaacttcactgtgcaagaatttatgcaacaatacacccttcagtaattggcaagagtcatgttgcatggagaaattatgacaagaaaggaaaaggcaaattgatttttcctgaagatacattcaatttaaagccttcctttggtgtaaaagcctatatttcactctttgttcagacctcactaactctctcttcctcttcataaccttttacattttgtttaaatggctttgtttctgcagctgcagatcaaacaagctagccccaggcagtacatagctactatggaatagtaacaaagtgggggtgggggtggggcaaaatagtcaggggtttttgaatgcctggacagtctgcctagctttctatggaccatgtggcaatgaaggtcacattctgtgctatcagaaagggcattttcccaagagcagtaattagagcatttgccatttcagactcatttcctgattctccatttaggtaggatgtactcaagaagggtcttggcttcatgtgccatatttatagagattcactttcctgatgaacattaaaaagtctctatttggatattttctttctaggtacatttggccagtaagagagagcaataagttccccaaaaggctgaaactgggagtgactgagctttggtgggttggcttttctgcataattccaaagctaggctgacggcagagatagcaatattgcccttaggaagagctggatgggttctttgcagagggcagatgggtggcagattgcagccctggctattttattgcccagtaggaatctttactggttgtctgaaatctgatcagaaccaagagccttcaaattaaatgtgctcgttaagcaagaatgaatagtgtctacccttttacacagaaaaacacccaaaaaattaatttctttggaggctaaatcccgccacaccccccatacttcttcttcttcttttctttctccttctctgcttttcagtaaaatgacagcaagagcagagtcagaaagctgttccagaattataaagaaaacactgctgttggtttttaagagcatgtgtttgggatctctgaggttaggtcacggtggacgggttttgtgtctgactaacctagaccttggcacagcataaaagttaccttacccgtgtctcaggcaggctaaaacacacaaaattgccatttgttcatttctgtctgttcctaatacaaatttttctttcaaacaattttgaacaaaggggaacagtttttgttgtttaaaccaccagtggacccaacttcaacaaatatgtttgaatttcagaagtcttaaatttcatacctgggagctaaagcactggctaattcttttctcttttttttttttttttttttttttgagacagagtttctctcttgctgcccaggctggagtgcaatggcgcagtctcggctcactgcaaactctaccttccaggttcaagtgattctcctgccttacctcccaagtagctgggattacaggcaccctccaccaagcccagctaatttttgtctatttagtagagacagggtttcaccatgttggccaggccaatctcgaactcctgacctcagatgatcaacccatctcggcctcccaaagtgctgggattacaggagtaagccactgtgccaggcctggccagttttttgaactactgatgaatttgatcaaagcctattaaaaacttactgagtaaacaaacaattgtcccatgaaagcagtataatctaaaattttaatacagtctgttaaactttcattttttcatgagaatgttttctggtaacttgttttagattataaatctatactaaaggatagttataaaaacaagtgtatctaaatgtggtgcctccttccctgataatcttgaagaataatataacaaacagtgatctagaaaaacttttatgatcactcctcacttgggcaagtcagtcttagaacttgttaagtgcattcaaaactgttatggtcacacattcagagaacagattttcctcaggttgtatttaaggctctaaaatttaaattgattctagtattgtctttacttggcaatagatgtctccccattttagttggtgatcagattagccctgtggacctgtgaggggtaaagaaagaaaactatgcaacagagaaaatagtaagagatagagacctcaacttcctcctttgtaagatagagaaaataataactcctacctcccaatattgttttgaggatcaagtccaaaaatgcacataaaatagttaaaatggtagccaggacattattgttgttatataagtgtttgaaagattgaaaaacaaaaggcaaagcatatttctctaggagtaaacttctaggagggagtagtgaagcagattgttaaattccccttaatatcctttctatgcttctactcttgtgttgactttgcactttatttattgtttttaactttagttaattaattaattaaatttcttgagagctagtctcactctgccacccagcttggagtgcagtggcacgatctcagctctctgcaatccccacctcccgggtccaaggaattctcctgcctcaacctctcgagtagctgggattacaggtgcctgccaccacacctggctaatttttgtatttttagtaaagatggggtttcaccatgttggccaggttggtcttgaactcctgacctcaagtgatctgcccgcctcagcctcccaaagtgctgggattacaggcgtgagccaccacacccagccgactttgtactttaaagtgtatgtttcattcttgatcacgtctgatcttcgcagcccttcaggttatatacccttcataactgaagaaactgagaatcagacagaggtgaaggctgactgatggatggcatgacccatttatcttgataccaataaagcacatcaagaataataaatacctattttaaaatttctgacaggaagtttagatatcacctagtccatttccttaattttccagttcgggaaattgagccataaagtggttcagggattggcctagggtcataaagacatttaggactagaatccctgctctcaaggtcccaggttagcttgtggggtttcatcttctacaatctcatttgatgctgtccaaactccaaccccttcctgggtctgcttagctctctgacttgatctcctgctcaccccctcttgccttctctattctagccacacatctgcctacctcagggcctttgtaggtgccatcccctctgcctggcatgctctctctcctggactttgcatggctgaatccttctcaacattctggtttcagcttcacttttacctgcctagagagaccttcagtgactctacattttaaagtagaatgcatgagtaactagcacaccacccattttactctcttcatagcaactgcccttagctaatttatttcatttattgggttacttattgtattagtctgttctcatgctgctaataaagacaaacccaagactggataatttataaaggaaagatgtttaattgactcactattcagcatggctggggaggcctcaggacacttacaatcatggtggaaggagaagcaaacacgtccttcttcatatggcagcaggagagagagaagtgcagtgccagccagagaaatgccagatacttataaaaccatcagatcttgtgagaactcactcactatcatgagaacaacatggaggtaatgtccccataattcaattcacttcccaccaggtctgtcccacaacatgcagggattatgggaatggcaattcaagataagatttgggtgggaacacagccaaaccatatcatttattttttgtccctctgttctggaacatctgctcaatgagaggagagacatgcctatcaagttcatctcagtgcctagaactataccagagacagaataggtcttccatacacatttattaaatgattaaataaggaataatgtttcagttaaaatgtgtcacagggaatgctcaaaatattcactggcagggctggtagtgaatgcccaatctagagagtaccagtgcatggagagagagacagaagaggaagttccatcttttgggggttggtgagcccttgaagaaaactcaggcaaacatatggaggcctcattctgtctcagtcactcttaaaagcactttgcatatattcactcatttaatcacaccaacctatgaggtggggacagttattttcccattttacaaatgaggaaactgaggcacaggaaggtgaagtcacttcttcacggttatacagctcatacatattagagctggaatttaaatacaggcaggaactgtgctgctctcaacctgtatggtctcagccaagagggttaagtagagaaaagatacactagatgttaggtcactgagatttttctgggtcttcctaagggccagcttgacttagctggcagagattggaaccaaacggcctacattgtcttttccattgtcttgtaacatctaattctcttgcttacattgttctctcctggccagccaatggctgggctcagcactcacctgttaggtttcttacatttggttaagcaactggcagactcacctgagatctgtcttcccaccccaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaaggggtgagtcggcctagaggatggcaagtgagggcctgagtggggctgatgtgttacagttggatccctgggcagcccaagccttcgcacctacctgcactttctttcttccaagagtttttgggtttactgatttccagattgcaccctttctagttctgaatgcttgggtttgtttggctaagactgagttgcagaaagggaagctttataataaatattactgtgattatgatactttttgattaaatattttctatttagagagggtaaataattctcttttgggactccagggggcctagccaactggctgttttattcattcatttgacttgtgattctttagtgctttctacaagctaactcctgggttaggctttagaaatacaatgttgaacaagacaggtacatcgctgtttttatggagcttgctgcctagtggaatatttagccattaaataactgattacaaacatggtgagttttataagaggcagagtgatgtattagttaagaacataaactctggggccagactgggtgagaaatctggccctcatgcagtgatgggaatttcatcatggtagtcaatatctttgaaacttgacttcctcatttgtaaaatagaaatcaggtacctacctcacaagatactgatgatgattaaatgagttaataggttctcgagcatttaatgttagtgattattatagtcataattattctcatcaacatcattaaagagaaggtatagagaagcttgggaggcccttggaaggagacctaacataccatacaggttcactgtatagtgagcaaccctgacagttgaggacctgaacaaagtccagaatggactggatgctttgttcccttctgaaaaatgtccagaatagaattggggaactgttggggtggggaggaggggcatgagaggggaccaaagagatgagggctgaccctgtagactgggccagaatgctgggaggattcccttttcgttcaccacttcagtatctgacatttgcacccgatttacagtttaagtaaagggcatagataaaggcaagaagagggacaacatcaacacaaggagattccagtcaagctatttgcagattgcagcttggtctatttttttatatgccaagcacacagaatcaagctgaatatccgcaggctgtcaacttctatattcaatgaaaggataatttgcatcaggatcaagtttttgctaagggtatagctctagggctttgagaatgctgtacctgtatagttcttgccctcaagaagattatcatttatttagctgaggagttgagacatctatataataagctgtaataagatgatgtaagacagtagcatgttagtggacagaaaagaaggacatggagattcagagacagaagaacgttttgaggagagacctgcagggtctcatctctacagaccagtggccagtggcctatcagaagataggtgatgtggatggatcctgggccaggtctagaacaagggctgaatgaccagttttcaaggcctgtttttttgtaaggccaactgtggggccaactgtgttactagctaaggtatatttcaagagaactacaaaccctttttacagtcagatcagaaatagaatacaggacatgaggacaaaggaagaaaagagagctttcttggagcatatggaattaaaattaaaattcactgaattttcaagtcagcaaccaccagaacaggagctatgataaggaaatactcatctgggacaggaataggccacaaggggctggtcagtctgtcaggtgcctgggctctttccaagtatgtttgtagggtaacctaccctggtgctggttggggaagatagaaaggtcatttttgtctctgagatgcgtgagacagttttggtgtttgccaaagtgttgcagatcttctgttgtctatgaagacagtataaaggtcatctcagacatctcacttcttcttgggtctcctcttaactcaagcaagggccttgtgattgtcagaggcaggacacagtgactgtagccagctgtacaaggtgtctctgagctcacccatttcaagggtgaatcaacgggagttggtccaaaacttgccaagaacagtgaaagtcactgcaccttttacattgtcacttctgactagtcattaaaaggcagctgattggggatatatgagggacaattattcttggtgcagtgcagccaagagtcatccattctggccaaatgagaagaagcttagcaaatttaagatatttgatctatacatcgctcaaatcccagacggttcaactgattgttttgttcccctactaattgttttttgcccctggattgttcctgacaccatgttcagaatgaatcagtggagtgtaaaaattataggactcttctctgctagcaaagaaaagttgagattcccaatgacattgtttttctttatggaaactgattccttagtggagactcttttgagtatcttttgttcatttttcctgcaggaagttgacatatattgaagccctagtgtgttccaggcactatgtttgaggttggaaatgcaacaaacaaaaaatccaaaacagaaacaccaacttgacacggcctttacttgtgaacaaggggtgtatagtcctcccaggaagcaaaggaaaatgtgagaaatgtttaacatgtggttaatgttatggcagatgtctatagggaaacagtaggacaaacaggcaagaatggccacttctatatggaaggagtgatggcccagagaaggggatccaagctttcttggattttagatttcctatttctaactttaggcatccactctaggcacttctgaagaagaatgaagaaaatgtattgggtattctctctatacaggaatggaatacttttcggattaaggagccctgccccattcaccataacaacatcaacacaatcactcagtttgccattctctctctaatttttattatgtagaagcattctagaatcaagtctaagtctagaatggatcatttgtactaaatgtgttaagcctaagacaattcttaaggctgtgtgtcccagtagctcaaactgtgttctctactggaacttccttgggggtgagtccattggtataactgggcccacacatgaatgggagtgttagaaagaagcacttgtgtatatacactgaagaaagcatagatggaatgctgaaaactggagttttcatggcccaggtcagacactagacactacatcaaaatagaccaatgacccaagcaaagtcagcaacagataaatctaagagacaattcctggatcaaagtcatcagccaagtataagagagtcagagaataaggcctgggaagtagaaagtgtgtatatgatactaagattaatttgcatgtgtatgtttctcttacagtaaaattggataactcctgcttctaccctcataagagtgcttcttctgcctgtgaagatgagctactctaaatcttgatgtctaaaaataggcttgattgatattgtatttagatttttttcagcataatctgttgctattctaagatgtagctgtctctacctatcccaactgtttagctctaattatttttgttggctattcatagtgatgtgagagacgtctccatgacctaaacagcaaaggcctgttttaactacttaattctaatcagataggttgaaattctttagtatcatagaataccacctaccatccagtgaagtcctgttggacagaggaaacagtctagctggtctttagcctgctctggagttagtcctacttaaggagctatgatcacttgacctgggacaacatcttatctttgctggtatagccaaactgtctagttcaattggtgagcatcaagttccagcaaggcaaagccaagggtttgatttatttgtacatcatggagcttaaattttagaccattgctgaatctatgctcttccctgaatggctttttctaaacatatcctggcattcatttggcaagaaagtaaataaagctcagcacaagttcatcccaatgtcaagaaaaataacctacagtacaacatttatctgacatatgcaccagctgaacacgaagaatacaagtatttttacttctctccagtgactcttgttccagtgggaaaggcatgcaggcagcagctgctgctcctctccattcggggcctccctttttaggcaacctcctatgtgatcctgggtagcagcagcagcagcaaaagcaaatgattctgcctggaaagggtgagataccaatcttcgatgaggctggattgtgtcattgaaatgctacatatatgccacatggaaatcatgtcataagaaaatagtagggttggcagaggccaggagtggtggctcatgcctgtaatcccagcactttgggaggctgaggtgggtgggtcacctgaggtcaggagttcaagaccagcctgtccaacatggcaaaaccccgtctctactaaaaatacaaaaattagctgggcttggtggtgcatgcctgcaatcccagctactcaggaggctgaggcatgagaatcacttgaatctgggaggtggaggttgcagtgagccaagatcatgcagttgcactccagcctgggtgacagagtgactccgtctcaagaaaaagaaaagaaaatagtgaaaatagtagggttggcagataccgttagtgttacctgcacctcattcctgttttggtaaatgaggaattggaagccctgagaagttaagtcaacatcagtttagcttggaattgctatagaatggttagaatttatgattcctgattcctaatgcatcaggctttccattacattgagcagcctttccttcatatatactgttatatacatatactagatggttattaaatgtgggagggctccagggtttctgttttaggtctcttcttggcctgcacggttcccttggtgctcttattctttgccacgatattaaaggtcatctatatgttagtgacttccaaattgaggtctcttgcctagaactctccctgaaatctcagattcttatgtccctagttgtctacttgacatctccatttggatatctgatagattaacttaagctacttaattaatagctacttaatacatagctacttaattctaatcagataggttgaaattcttgaatatactggaagagcacctgccaccctgtgaagtcctgttggacttaatcgtatcatggaacagcttaatcatatcattgaaaagcagaaatcttgaggtcttccttcctgccccagacttcttttactttcagtttttccccttcttggtaaatggcatccctactgtccttgggcattttcttttatttttgtcctatgatattcaatctatctcagcaagtctcatccatttctcttataaacccatcctgcatctgtccactctctcttccatctctatcattttagatcaaaccatacttatcacttctttggacaactatatagcatgtagtatatgattatgaaaaatccaaattcattttgtgtcttctttagaatattaaagttaaattattaaaatttctatattctcaacacagtctatcttaaatagctttagtttcagtggcttttggtccagaaaactgtaggaaatgaagctatgatgcttctttggaattaacttcagcattaacatagagattccataaacaggtatttagctcttttctgtgtcaggctttgtgagctgatgaggatatacatttatattaagagaagacacactttctgtcctccacgagctcacagcacagcagaggggatagagacataatctgcaaactctaatgcaatctaccagtgtcaatgattcaggaaataatcacaggaaagaaaaagataacaattagaaagcaagatatgacgcacattttataccattttataattagttctggattcactgaggtcttgctcagactatctcactggtgtgggaataagagaaacctgggcttccaaggtcaaatataataatggtggttgctttcactggtctcagtgctattgaggaggggaatctgcgttatggctgtgccctcatccctcgtaggtttccagatcctttatttaaatgtctgacctggagatggatcctctgacctttcttttctgcaagaataaaatgaggcagttgggtttcacgctctctcaggcccttttcaactctaaaactctgattctcaaatgtcatcagcttggcaatgctttctcttatcccaaggagagagagaaaggtgaatgaagggcagcaatgtgagtccttgttccttacaatccgcagaactgtctggattaggactcggtttagttatatcagcactgcaatcaaattttcatctccctgattcattcatccaagaaaatgaataccttggtgtactgagtacacttcaggtccatcagacctgagttttaattgatggattaacgaatcgaaccttagatttctaaagagcattaaaaggctgtttcctctttggtccattgtttactctttttgatagataatgacatgtatctgagaaaggggcttcccaagaaatgtgcaattcatttacataaatcaaactgtctccttttttttttgtttgtttttttgcttttctgttgttgcttaagtcatacaaatgtatccctggtgacagccaccagcagagcacagattcagcctctttttttttttaacttccggttctgcaagtttccctttccacaagcacagggttttatgattgcagaaagcttttccatagtacatgaaccctagctgagagttattccaccaggtgagagtctgagctacctctgatcacagctggtcctgttactctaaaaaagagtatcaggattgtagattccggttattctagagtcttgaaggtttcgaggtctaagaaggacaggctggggactttggagatcttttaagaatcgacacctgcattcaacctgagaatgtgagggtcagcactttggtgcagtgtgtgacagctgcttatgaaccaacggcacacctgctgctggctgcagtgctgtcaaatgcagggactcggtggccatttacattgccactgtgtatctttattactgtgtgtgctcaaagcagcttaactgccagcagacatctgcccataataatgcaataattgaaatgctgctaaattatgagaaacaagtgctttgaaacacaacacaaggggattgttgcaggcttttctagcatctctggcttcatgtttcttttcacagagagatgaatccttcttcactacagtttggattaagaagaaaggaaagttaaaagacctactatttattgaaaaaaatgatgtgccttctctatgtttggttcttaatatatactgagtcatttaaccctcacatccactctgcagactgcatattattatcctcactttctacgtgaagaaattaagggccacccaattcattctgaatacctactgagtgctacgtgccagggactgtgttgagcacttgggacacaaaggcattgactgtggttctcataaatgtgctattatattctggtatctgagcaattgggacatgagtgtggggagaaatatcatggaaggcatcacagactggtgccactagagctgaggcttggtggagaatcaaagatctccccggcagaccaggcaggggaaaaaaaattccaggcagaaggaacagatgtataaaggtgacttcaataaacagtaagttttccatgtgggtggcatgtagggcttaaagagtgaggaggagggatttgaggggaagttttcgaagatgcagctgtaggggtgacagggccagccagccatgaaacactttgctctcccaacaagtttaggcattatcttataggaagcataccacgtttaacaatgggataaccaggtcagatcactgaggcagaagataaattgaatacagaagacaggagaccaacaggtcagcatataatagtccagtttgcattggtattaattcaggaatgagagataagagccctccctgaagaaacaagagtggaggtcgagttttcgaacatatctgataaataaaaaaggggcaatgtcaataggacttagttagtaatcaattacacacagctaaagaatagctgaaattgaattagagcaagggtttggccatggaagccttttgcttcttcctttcttctgagccatcttgaatcagtgggagattcttaggaggagtggggaggactgtggtgaccattaagcagatgtagctgagagtcaaacctacacctgctttggtcccactcggaacatatgtatttaccttctcaccttctctctgtgcctccgtttcaatatttgccatgacaatattggcagtgggtgtttaactggcttattgtgaggctccattgtagaatcaaagtgtataatgtgctcacatagataacaaagttaatattcccctttcagaatctggagtttagcaatgcaagaattgaaaaaatgatctggctggtgtttttactccatttttttttttcttgtgtggtggaaatgacccaggtcttatttctgtgtttaaggcatatgatacaggttagagtttaaaattgagaaggttggaccataagagaacataccaaagcatgcctttcttcatactttaaatggtgtatttggaattaaaatgtgactcttttgtaatcccgggttttaaagaattgcattaaaatgatctgttatgactgtagtgatctcaaccaagctttggcatatgtttggtagaaacaatgagttgtagtttgtctctctttgtcttgtaaaactggccatatttgaaattaagctaaaagattttttttccttggagatagaaaaatcatattttgaacttctccctattctggtctctcatttgggatttatagtgatgacacccgatactgagtattacgtatgtgtctgtgcctagagcacatgtgtatagttttcctctagcttctgagaagttttctgttttatcatgggttctgttttaatcccaccaaggactgttaagaggaaaaagcagcaaacatgtagtaatcaagaatagaagtcccaaacttaaaacctaaaacttgactgacccaacaaaaaccaggcagagtataaagagttgtgtaattacttatcttgccagtagaatagatgctcagatactatctagcaaaaccacccacccccaattttagatgaagaaactgaggcctccaggtgggaaatgagtggtcaatagaatagaatagaatgttcttagtccctcgttttggttcctatttattggctttttcaaagaaatatacatgcatctgtgcatctgtgcatatttgtgaagatatacttttatgtctcatgatcttctaggcagtagtcatgccgttatagcaaagccatttggtaaatctccagtaatttgttctaactgataaattttatttgaaatgttggcaactgatttagagggaggaaatgtggagggaagagatgtatatatttctcttctctttctgtttcatcacttatcccatcttaccccaacaaataacccagcccaacagagaggatactggggtgacaagtacatctggaacttgaggctggacccttcaatatgagtggctcttgaaagacccccttctgtgggctactggacagctatttttctgccaggtagatgcagtctttcttggagaagatcatttcatgcttcttagcatgtttaacctttatagcaagacactcttatcaaaatgacaaaccccaacagagccttctaagaggccagtaaatcagaagcctcatgaaatctgtgcgattagcatgttccccctctttgtttctgcagggtaagaaagccctgtgcatttcagatttcaatcttctctgcaggccccttgtttgaaacctcctgctgtggctcactggtatttaaatactgttttcattcagtcacctggggccacatactgacatcagctaaggctggcacattgtttatctccatcagcaatgttgtaaagaaaagataactgctctgatgtttgtttagttgaattctccccatcctggaaagcatcctttctgggtctgaagatagcagctgattcctaatgtcatcattcctgtagtagctcactgttgctcagcaggatctcatctccagccagttagttgtctctgatctctttgtcccatggctcagtctgtaatgaaactttcacaagcaacctagcatcttcagccactataaggtggagcctccttctgtggaaatccacaaagtcaaggctatattgagagtagaggtagaaggagaaaaaaatgatgaataacagttctgttgtctgtatagatgataaaatatttattagggattgtggggggtgactcttttatcggagtttacacatccatattttcaagttggaaaggacctctgaggtttttgagtctaactcaatatctgatgcatatatacccctggacaaaattcctaaattgctgtgtagagtctataggaatatgtactcttatctacatatgatgtactaaatgcttagcagtggttagcttatttaatctttgcaataactacataagatatgtgctattttcattcttaatttatatctgaggaattggggttaaggataggttaagtaacttgctcaaggtcacccaagaatacgttgaggtgatctctgggtcttccactcctgagtcctctcttctgtgatcgatatactttactactctcagtaacaaggattctcacctcttcatgaagcagccattccatttttggatattactaagtagtctaaaaatcttcctttcactacaactgaagtcccttttttgaaacactctttttattttattttgttcctttttttattatactttaagttctgggatacatgtgcagaacgtgcagtttttttacataggtatacatgtgccatggtggtttgctgcacccatcaacccatcacttacattaggtatttctcctaatgctgtcccttccctagacccccaccccctaacaggcccagtgtgtgatgttcccctccctgtgtccatgtgttctcatttttcaactcccacttatgagtgagaacatgtggtatttggttttctgttcttgtaaacactcttttttaattgtgataaaatacacataacataacatttaccattttagcttttttttttttttttttttgagagaaggcctggctcttttgcccaagctgaagtgcagtgatgcaatctcagctcactgcaactcctgctccctgggctcaagccatcctgccaacctcagcctcttaagtagctgggaccacaggcatgtaccatcacacccggctaatttttgtattttttgtagacatggattttcaccatgttgtccaggctggtctcgaacttgtgagctcaaacagtctgcccacctcggcctcccaacgtgctgggattacaggcgtgagtcatcacacctggcctcattttagccatttttatgtgtataatacggtggcataaagcacattcacattgctgtgcaaccatagccatcatccatcttcagaatctttcttttggccttggttcaggctttgggagctatacaggatttattcactaaaaaaaaaaaaaaaaaaaccttcactaggtgcttatcatgccatggatcctagagatgtccagaacaggtcaagctaaaacccttctctacaatagaccttcagttattcaaagacaactatcaggttttccactgaaatgttgtcagtcattctcaggataaacatcactagtttcattaaccagttctcacctattgtggttttaagttccttgctgagttaatccagcagtcattgagagaagtgggggaaggtgggagagggttctgtgttctgaaaggaatgatggcttccagtacttcacaggggtctttgtgaagcaggccatgcccttccaaggagaaagcatgtattgttaatgcagtaactcacatgaatatcagagatagtgacacatatggactatgggtttgtgtagttggcaggattcactggtacatttatggtggtggtggggtgagtgcttttgttagtttcttatcctgtaaaaatgctttgggccaggcacggtggctcacgcctgtaattccagcactgtgggaggccagggcaggtggatcacctgaggtcgggagttcaagaccagcctgaccaacatggggaaaccccatctctcctgaaaattagccaggcatggtggtgcttgcctgtaatcccagctacttgggaggctgagataggagaatcacctaaacccaggaggcagaggttgtggtgagccaagatcgcgccattgtactgcagcctgggcaacaagagcgaaaactccgtctcaaaaaaaaatgctgtgggcccacttcaggtaacatcacatttaccacctcgtcttattcctcaaaatagtcctagattgagtgtgttaagtcacatatctcaaaagcaaagctaaatttatttttgaccataggaacatcttagggtaccactagacaaggaaatcatgattttgacgagtgtcagctgacacaaaatcattgaatgctacagctgggcagggccttaaaaaatcaactattccagtgcttataatttgcaaagaaataactgagattcaaagtgattatataacttgcccaaagttacagaggtagtaagtagccacgctgggacttatcactcagtattttgaatccttgatgagatctgtctattctaaagcaatttcagaggtgctcttgctttgtacctttgggctggtcctttgtagctgagagtaagatgctcctgctgtgtgggtcagaagatttcttcacaagctcagtgggtccttgtgattttttttaacatgtaatcgtccctttatttattgcaaataagcttggcaatttatttagttagcaacttatggtctggaaaatctcattatccaaaccttacattatcaacacatctgtttaaaaagagatgcttaaagaagtggtctaaatatgcagattcctgatcatcttgaagaagggaactactaaaagggcaacctgggagggagtagacaattgtagtgaggccatgaaagccactgacattcacacataagggagtataaaaagggaattcacatttattgagtacctgcatgtgccaggtataatttggtccttaaataagatgaaccaggtttggagtcagacaaaactggatttgtgggggcggtggggaggtgcacagtggctcatgcctgtaatcccagtgctttgggagatagaggtgggcggatcacgaggtcatgagttcgagaccagcctggccaacatagtgaaaaccccgtctctactaaaaataccaaaaaaattagccaggcatggtggcaggtgcctgtaatcccacttctcaggaggctgaggcaggagaatcgcatgaacccaggaggcggaggttgcagtgagctgagactgcaccactgcactccagcctgggcaacagagggagactccatctcaaaaacaaacaaacaaacaacaacaaaaagctggatttgaatcccagttccattgctcactattatgtgatcttggatgtgtttttaacccctttttagcctcagttttctgatccatcaaaaagccattctggggttgttatgatgcttcaataacataattgtgtaaaaatcttggcaaaatgcctataattttgtaagtgttcagtacatggaggagtattattattcttctctcttttaatttttagagcagatcttataaagtttgtggtatcattcagatttttagatacttaaaccaaggatcagaaaactaaaataaatttccatagtcgcaatgttagcaaatactaaaggtaggaatttttcacccagtctatcagattttctattattctttgccattcatttaaacaggaggccttagaggtgggattaggtactgtgggagggagagagagctgtaagaaatgagatggctttttttgttcctcttccaaccttgtcagttctctgctttaggactttccaaggggcaaacatgagaaatacattgggatggaagctgtccatttggagtaaattcaggattgagaaaagcagtcaggatcttccacatcttttcattcacactgtttgttcctaggtggtggagaagaactgtaaagtttcatggggctggtccagaagagcatgaaatgagtacagctcaaaacttttggctcatcataatttatccagggctgcaaaataccctaactcatacctgcatatttacccacatgtacaaacacacacacatgcacatgcacacacatgcacatgaatgcacagacacaaattcttcggccataaacctggacctctctaatttttgctttgctcatctctccttctctagacggggagccatcggctatgtatccccagtgccaaggaaaaggagctcaatctgtgtttgtggaggaacaaatgaaagaatgaatgcaaagcaaaatgaatgggattatttctaaagttaactatagttagaattctggtttattatctgacaaatttgaaggaacttagtacctgctagacatctaaactgcccaccctcacccccaataacaagttaggattttcgtagttggagatgtgcctagagaaaaataatgagaagctcccctaggctggggcctagcctcttgggcctgtagcaactattcctgtaactcagtattagctatagagcggcaagattcagtgttgcttaaagtggacaggtgggcaggcatggaatgaatgaatctggaatagagcgagaagcaggcttatgcatctgaggcaggcatttctaccatctaaaacaatggggtgactttgcagctctccttggtgaaaagagcacttcgtggatgatacccttttgttccccctcactccctttttattcacccctctcctgtcctgcttaccttttctttttcctgtttcctcttctttatcccccctattcttcattatttttttccctgataaaccccacacagtcctttcttcatttctatttatcgtttaagcttgatgcagcaataatgtctattgtttaaagggcttttccctcccagagggatgagattgacccttatttattcagaatgacttgactcagggctgttataaaatgtgggctgcacaaaactgcaaggtggctggtgcctaccagctacctagataagtggtatctggttgaaggggaggacaggcccctaaggcctctttgagcacattgtctaacctggaagtcatctccttttgaaccacaataaatgagaaatggtcttagcaagacaaaacaatgactataaaaccaggtggctaaaatatggctgaggaatgcagaagagtgcactggtatatcaatctctaattggggaaatgatttggctgcagcacaaaggagcccctctctgtctaacattgggtttgccccttgagctttctgcaggcggagattgatggtggtggcgtgatggtcaaggaatgtgtcctcagatgaggctgagcagaattatttctttgtaaattttctttttcccctttcttcctccctcccttcagatatctcactttctcacctttctttcaccttccttcttttcttgcctgtgatcctttcaaaccactttagtttttttcttatgtggagaacatggttgacccattcaatttcttttcactacagagtagcgttcctgggggctttgatgggacaattgatataatgaatcttgactttggtaggactgttattctgtcttcataaaatgctactcaataaaccagtctctagattatagctctgttaggagtgtttatcactgttgaaaagaagccttataaaaattgtcatctgtgggttattgctaacattatagattatgaatctccatttaaaaaaataaacactgatttttataattctaaaattaatatatatttactgtagaaaatttggcacatggaagtttattaattcaacttattctttggccgacattaactgagtacctgaatacaaaacctgtggtggttctacaaaacgcatttcatgataaacaaaaataaatataattgagcataactgtaccaagcagaaatggttattattaacatatctgtatgctttattctattattttgggaatgtgtatatatatatgtgtgtgtgtgtgtgtgtgtctctgtgtgtgtgtgtgtgtattctattcttgaatatatactatttgtgaatacatatattctattctatatatatattatttgggagatatatgtgtatatatataacatgttaatgtaattttataagtaattattctaatttttccagttcctgttttttttcaaaaattatctcgtagttgcataat[450 bp omitted]cactatacccactctagtggaagggactgcaaagtcacaagcaaaggctgtgggtatataattcagaaacaggggaggtgcaactaattatgaacaataaaacagtctactatagtagactacctgatattttgttatcactaatgtccataggttgatccaagaagactagttttttatcctttctgttaacctctaatgtgccccaatattgataaatgccatgagacctttttccaaacacataggcttcagaagacatcagagtcttctccactgcccattttctgtttggtggttctaatgtatcttcccattgatacttcaactcatcatatctctaggagttttatttcttgcttcacagaagtctcttagaccaggtaagaaactagctctgattttaatgcagagaatgcttatgaccattattttagatgggcttaaaacaatgaagcctgagacctaaaagggccagttccagaaaatcattagcttcaaaatctagacatgagagaaaggttagatggtttgaggatggttctacaaaatataatggagggaggccagaaaaggttagtgggataaggttctcagacacttggattctctaggagcagtaaggaatgaatttagttttttgctttttggaaaatttagaattactgaaatttgctcaagtctgggattctttttctacttgaggttttctcagggctttgaagaatatgcactgcatagggttttggtattcaggcttcattatttttggttccattctttgtaacacctggggtcctggttctctgctgatgggcctcttaattttgtttattttgtgtctgaacctcagattttagtttgtatttattttttgaaataataatctggttactgaattagacaccaagctcatggaaagcttggaccatgcctgctgcactattttctgcctcatgcctgggatatagaacgtgctcaacacattgttgttgacggtgataggttcagggcacaggtatcctgtatcctcagtctttgcatccaaaacttgacaaatccttttctcacccatatattctccctctcatgcaaaccttcttactttagacttatattttgtgtttaacagtcaaacatttcctctaggatgcctagtctatgtagccatttcaaagataattttctaaggaagaaatgcgaccatccaagcaaagtgtactaatgtcaaggaatcagtgagtgctagaaaagccaattcagagtggtcagaggtaacaaggagactaactaaattgattagctttaataacttgtattgtctcccagagagaaaatattcctggccagaattttgtcaggagcttgttgctctaagtcaactatattgcatgaggactcagagagtaagtgtgcaggaaaggagaaatttatttgggaagattttgtagtggaagggatactatgtaaggctaatattacagaatgttagcagaaagccatctgttaccactgtggtttactaccattcagagagtatttattgagaccgtattatatgacatgcactatgataagaagaaggggtacaaaggctagccttcaaggagctcaaggtcaccctaagaataacaggtggctgcctccaggaagatggattgaacatgaagtctattgaacaaagaccctgctcttactgttgcatgaatgaccttgtttaagatgcaagattgactgtagatggcagaggagggggaaagagaataggcctaaatctcagtcagaatagaacttcaatttctccactctcgaatgcagtgagcatagtaagacttttctctactgaggcaaagaaactttggctacagttgaatcagggatttagtgtgaaaaacatgtaggtttaaaagagccaaacacacgtatctgcatctgaaacacacacacacacacacacacacacacacacacacacacacacacacccttttcatcttactaattcctatatttcccattacttgagagataacataatgaattttggatgcaagatgaaaagaaagtcattttatccaaagggatgttatttcaaagacatacatagatgagcactcctgcatatcatgctattcttcacaatgtcattttaaatgatatttactcaaatattagttagtgatgactaactgccagataccatgctagtccttgagaggtacaatggtgggcaaaatgtgatgcatctttggcctcatggagtttatagtctagtgacaggagaaagacatttaccaagtaatcaacaactaaacatgcaatttcaaacttttgaacttgagaagtatggagagccagccctagttgaggggtgatcagggaaacagctccagagggaatgatgcttgacttgacatttgaagaataagaaggtgttaccagacaaagatggatgcagtcttctaggcagaaggttgttacaaagcccaataggtaaaaagaagtatggcaagttagagttcaaggaacagagggtaagtcaggttggagcacagaaggtggaagtggggaggagagggaagaggagacagggcttggtcatgtcatcacctactggtagagtatgatactgatttagaatttatcctaaaagtaatggcagacccttgaacagctataagcaggagaataacatgaccagatttgcttttttaaaggtcatcttggctgtaggacagtgagtggattggagaagcataagaatagatgttaaaatactagttctccaggaaagagttgacagtggactaaatttggactagggcattgaccagggatgtgaagggaagtcggtgaatttgagatatttatagaagatcctatatttgtagcacttgagatgtcaaagaaaaacaaatcaggacttagtaagaagagatttttattcaaaacaattcttgtaagagaaagaaaaggacaattgcaaaacggagaatgctataacaataaagtttgcaaacatctcaatatcaaacagaaacaaaaatgtttttctttcatagggtaaaggaggaggctagcagagataagcagaatctttggggtgggaggaagctggacaaacaaggggaaataacccctggagtctgacaggacagagggtcttgctgtcaccagctgattcccaggagaagctggtaagcaggtacatgttccccttttatgtgtgtgctcagactttgggacaagcagtgttcaggaacctgtagaaatgactgaagtttggttaaggcaaaacagaaggatgagcaattgtgaacactaggttagagaatgtaattcaccatgacctaaaagatgacttcaaagggatcaagcaggagaggtagaatcttctcagtggatcagtcaattcttatcctcttctctctaggggacagttgatatctttaattcatattaggggtttgttttaggggtttcaaagtcttctcacatccttgagttcatttaccttcacaaattcagagaagtctgttagaattgaaagacctaagttagaagtcagttttctagtcttgttattttacatatgaggaaaacacagtctagagagggaaatgtatctaagacatccccattagatggaaaactgtgaccagcacccaggacttccaacatccagtctgggaatgattcctcctttatatggccgtttcctatctgagaattctcatgacattctcatgacacttcagtgtagcactgtagattcctcccatggagcaaactaaggtgctttccacccaccctatcccctatacagctacacacatagatatttactacacacatacacatagatccatgtatcttattctgaaagctgccagatgtcaatttgaaatttaatttaattggttccttgagttttcggttccccatcatcctgctccacctttcgcttagcgtggccatcctggagttcaagatgtagttaaaaggcaagatggtgtgatggatagactgtaggttttggtggcaggcagaattggtttgaaagcctaatagctacatcatcgaagtgaaattatttaagttttctgagccttatatttttttcactcatagggctggataattgtaattgtctcacttgattcttgcaactattaggtgagggtataataatattagccaccattttattgggcatgtactatgtgccagacattgcacaacatgcttaaaggacattgccccatttaatccttatgccataacctgatgaggtgggtaatattaaccctactttaaaatgcttaagagttcccaactctaatagtaataaggactattattcccacaatcatttatttacacttttattcattcacttattattatgaagtgcctattctgtttcaggcattcttctgggtactagggatacagagaataaaaaactgacaaagcttcttgcccccatgcaactaacaatctagtgaggagaaataaaaaataagcagaatacagtaaaatatatgtagcttattagataaatgttcaggacaaaaataaaatagagcaaggggatggagaagagccaggatattgctgtgtgtagtgtagggaggtcatggatgtgaccatcgattgaaaatatattttatcatttcagaaaagacttcctggtagattacatgaactgttaagttaatttgctttttgggaaaatttagcacttggtatatcctctcattcttccctttccccttcctccttcccttcctctcttaatgcctcacacatttgtgatattggctgtgttagttgctgagaatgtaaagaggaatgtttcttttatctgcttgtctacctaccgttcttcctacttaatcccctatttgttccacaaaggattaagacacatacaaacaaataggaatggtccagccttctaattcctctgctcgggctgtgcccatctgctgggggtgatttgggatttggaagctgaactgtcctattggtacccaaaggtaccagtaggggtccaaacacagttcccaagtgcactataggaaatccggatagagttggccctaaggcaccttaccctgcaccccaagatgaacactaaaaatctgttcagctcattaaggggcctcccagcagggtggctccagtctgtgatctttgcagagcaaagtgatgggtgccctcattactgatgtagtaggctcttgacccgtgagctgcagctgcacacagacagctctgctgcccaacacactctcatcccagtcctcaggtggaggagggatagagtttactgggaaatggcaaaaaagggggggaggggtagaaatgggaacattttcaaattaatttcagaaatccagtcttagctctaaacgacagctgtgagtttaatcactgaaactctctttctattcaagagcagcatgtgtctcctgaggagggggagcattatcaagcagttaagtcgttggaagctgcttaggggctggtaggcagtctgcagggaaggggaggatggcttcgcttttggcagtgacctgggtatagtaggtactgcttacctgctatcatctcatgctatctccagcagtccctgaggattgctctgctctgtctatcactgcgcggggtgggaggtaacatcttgtacaacggaagccaatggggccaagaaaacccatgcctcagcatcgggctaaaaaagttaatggatttcttgattttaagggttggggattcaggagggaattttcctttccatctgttaccaccacagcagtaacagcaactgcaactacaacacactccaccaactacaagagctaatgcttatggagcacttcctaactccctaaacattcacgtcttcgttcatttatgatttactgagcatcgactatgtgccatacattgtgctaagcactgggaatagagcaggagctaaggcaggtatcatccttccccttaaggagccagcagtttagtggaaaagactaaatgggcatctgatgaactcaaacctggtccccaaagatgtcagctcacccgttcgaggaatgagtctcagccttggtccgtcacttccagcctaggtgggggaatgtcagctgatatgaaagctttaccctcccctcccatttacctctcagaccccaccctcaggacagtggtatctgtccgtggctcccatctgtgtgttgctgcccatcacttcagaggaaccagaagcacctgccagagagctttatgtcatcagccatgggaacttcttccatgctgtttgttgcactggcctattttagggaaaactctacgcatgaagagggaagctgaaaagacacagggcaaaaagaaatattccccaccccattctttttccccactatgattttcttcttctttgtcttttgttttatctattttatgattttgcttttcattttaacactgtggtgaggggtgggggggtgctttaaaaccagagccacaagcaaacaggaattagatcagggaaataagaaggcagatggaagaatgatttttgagtaaagcccaggcccagtggaatctgccttgaccatgtggtgctcgtgtgggcccacagaaaaaaacccagaacattgcagtagcaaagtgaaagctctgtggactgtgaatgcagattagaattaaaagatgtgcttaccacactgtctctgtctctgtcccagagcctgcctgtgaacgccaagcctccactctcttccccagatcctattctccgtcataagttctccatcacacattctcacctcttccatttgagtctggattaacacagtagatgctgctcttttttgtcatttttcctctaccatgaccaagaatagtagtttaggcaaataaagatactttcttcctacatatcaagaagttccaagcgaggcagcccagagctggtaacagcccaacaatgccgctatggaatatagtccatattttgctccaccacacatagcatgttggctgcgatcctcaggtttgttaccttatggttacaatatggttcccacacatccaggcatcataacctctttacaggctggaggaagaagaaagcacaaagaactttggttgccctccacagagccttgggtactctttcacagacaactctttatatcttgttttattttttgagacggagtttcattgttgatgcggctggagtaaaatggcgcgatcttggctcactgaaacctccgcctcccgggttcaagcgattctcctgcttcagcctcctgagtagctgggattacaggtgcctgccaccatgcctgggtatttttgtattttttagtagagatggggtttcgctatgttggccaggctgctctcgaacccctgacctcaggtgatccaaagtgttgggattgcaggtgtgagccaccacatccagccatctccttgtatcttatgttcccatcccaaaaccaatcactggaggaagggatacaattaccaggcctggtgtggaccaatcatgcttcatcttctgatcttctgtgggtgtggtaggggcctactttctctcagaacaagggctttctaaccctaccttaacaaaccaggcttctgtggtcagagcagaaggggaagcaatgtagttgataagcaatgagcaatgggtgccacttgcctttgaggtcctccttttgcctaggttgggtgccctggcatctcttaagttgggggtggatgtgagagagttatctctttatgccaatattaataattttgatgttcaaaagaagcccacatgcagtttctgacattatgttccacttttaaactctcagagccctagtctctgaattagaattctagttttagaagtttttctgggcttgcttttctattagaaaccatttggttttgtggccttgtttgaaggcaccattgctcactggttaaactgactccatttgcctgaatgattatcgcctgatgtcttgaggcttacagacccagagaaacctttattcttttctcgtaacagttaataataaagcacttgttcccttgtctccttttttttttctgccacagtatttctcaacctactatctttccatcttttgtcagctagtagtaaaattcttctaaaagacacccaagttcaccactgtcctcactttcaacatatagtagagcactttaatttgcaatttttttcttctcttttcttttcttttttttttttttacacattagccattaaccctgcaccactgccctccacatctttgtcttctacatgaaacttctgtaaaaaatgtctgttaacacctagtgttcttctcctggataatgaggaccaaagaataacccaagttctctttgcatgttggcttgcaggaaacttagagttgaaatacacagctcaatcttataaaatcttatgccctaattatcagtgataattttcttctctgagacagtatcttatatctgaatttatattttttctggttatgacttttttttcttttggttagctctgatattttaatttaatatgttttcagtaaacatataaaatcttttgtcaaataaaacaatgtatttaaaagaaaatagctctgtgcagtgggctttgctgttcttattttacatgttaggatattggggaaactaaaagtcagaggtggccaagatgttttcctattaggtacctactctggctgattggcaaatttcaccctggcatgttaggtagagaaaccttgagaatctgcatccctcactgggatagagatgtagttatcaattagcagtgactgttgtaggtttcatggaaagaggagaagtgtgatatctttcaaggacacaattttcctccagaaaatccaggaatcctcattttatatccatgctgaaggctcctagagtagcattcctcctcttccctccctctccctctttttttgctgtaacaacacgtggggagatatgatggaagcgaagaacgaagtggactcttcagctcaatggaaaggcatcaacacttcatttgatttggaagccaaagaagcaaactatgaaaacctcaccagcattgcaagggagtgatagaaatatataactcacaaatcattatagcttctcaacgtctcagtttttaaatttttactgtgtatttttttgttttgaatcactttattgaggtatgactggcatacaaaaagcagaacctatttaatgcatacaacttgatgagtttgagaaaagtacgtactcatgaaaagcatatgttcatgaaagcatcaccacatatctatcacgtcccacccttttatttattattatttttgcaataagaacacttaagatatactctcttagcatatttctaagtatactgtacggtattgttaaccaaaggccactatcgtgtacagtggatctctaggacttattcatcttgtataaccaaaacttggtacccttggactcagctttttttctgaatgataggttagatgctaatttgcctgcggtgcctacagaagttatcagtgacataggggaagataatcttccccagcctttctcccctgtctagtgttcaaattgtaaaattttcttgaactggactaaatgccttaaaaccctggaatgttggtgtctttgaacccttactttgagctctatggagacctagattgtccctggaggtagtgcagcctcatttcaacaaatcaggttgtcaaaatggctaattgtttcctcgcattactctccctgagaattacctttcttagctggcttcccacggaaactaatggtatttggcaactgtctacttccaaatcttcctctagaatattgcaagaatgtctgaaagcacaacatttttggacaggccaagatgccatgggagaaaacacacacacaagcctacgtgctttctccaaaacttggctctgaagacagtcatatggcagtcacaccacaatccaatgaattgttttacctcaggttttggaagtttcactgctcccaatagcttgcattaagccctaaataataataatgaggaaattctattaagaactatttcagaagctagagaatgtaatgattataaataagaaagggaataagccatatcaattgctgcatgtatattgtataaatagcttgttttgcttaagcattagttaagcaacattaaatttaaagagtgtttctattagccaaaggtatgtagtgtgtgatatagaatgattcttggaactttgaccagattttctgtctgggatgggagaaaatctggccagagtgtgtcttgtaggttgatcacaaattcctaatgttcatcaagagtggaattttgacggtataatgaaagcctattttaactatgtaatactattcttattccattatgtaggtaatgaaagtttgtatgtaaataaaagtttaagcttctctttataataatttatcacaggaactgcctgcaaatagattctaacgataagaatgttcttcttttagctataaatccttagttttctacttcttgcaaataaacagcttagttaaataaactcaagacaccatcattaaacaattcaataattaaggtctaatactccttttattattaatcataatcacttttttatttgaattgagctttacttagtttattgcctctattattgtctgagaggagcactcttatattgtctgctttatgcaggcaagtgtggttttaagatgagcttgggtcaaacatcaaagcaaaaaagatttgactataaatcctagcttcctcattaaccagcttggtcacctatcacaaatgattatagcctctcaaagcctcagtttttatttttttgaaaaatatgtaagatactactttatctactttgttcatagtagttattgctgacatgggacaagatgatctttatgctctatttggtgtttgaattatagaatgcttcatgaattggattaattaatgtaaagtttttgaatgttggtgtttgtttaatcagtattctataatactgccaatctcttactccttgctatccacatatcttcctgggtgatctctttcgcttgcacagagtcaacttttgtctgcctggataactccaaattctattccttttgtgcagaatttcccatgagcattaggcacacatagctcattgcttgcctgacatttctaactggatatttcataatcaactctaaatctacatgcccaaaagataactcttatcacatatcagggtatcaaaactagatatctgggagccatccttagctgaacatagtttcttaagaccaaggcacaaaatatttgtgtagaggagacatggggcaaaggagagaagaaaagcaagaacgaggttgtaaagaaccttgtatgccgagtaggaaatgttcatctttattccgaaggcaatggagggatccttcattgaaagccttctgagcaagggtgtaacatggtcagatttaagtcttattaagattgttctaggatcatctaggggatacagtgaagagaactttactgaattcaggcaaggcaaagagaaagctattgcagtcaacctagcattcaaagagaacactccattgtggacaataaaatcctggttgtttaggtctaaactttggccttggaagggctttttatataatctagtaaattttcctttaccaacaaagtaacagatactccagaagtttttaagcttgcccaaagtgactcagctggcagatggcaagtaccaggctgatatcctgcaggttttttgtttgtttgtttgaaatggaggagtctcactctgccacctaggctggagtgcagtgacgcgatctcagttcactgcagcctccgcctcccgggttcaaggaattctcctgcctgtctcctgagtagctgggattacagcatacctggctattttttgtgtttctagtagaggcggggtttcgccatgttggccaggctggtcttgaattcctgacctaaggcgatccacccgcctcggccttccaaagtgctgggattacaggtgtgagccatgtctcccggcctgatatcctgcagttttgagatacagttttgtgtgtttgccttggagaaaaagagaatttcagttgcccacgattcatacatttttatgtggcagcttccttgaaagggaacaaacgttgaagggattcatttggcaacattattcccattttatagatgtgggtttttaggcttgaggaggttgtgacttttctaaagtcatgtaattaattagtggcgaaggtgttatttaatgacagcatctctcaatatccacttccacacctttttttaatgacgctgcactaaggcaagtgcctcctctgggatagtttctgctctgttcactgctataactgcacagaggcctgcagtttgaatgaagatacacacagagataactgaagtttcaactaggaaagggcaactggggcatgtaggggcaagtgtcaactaggaaagggcaactgggtcaccttaccatgatgacttcttcatggtttcagcctggacagcaaccttgcagagtcagaatcctgatcagcagttttgaccagcacatcaagagtggctttacctcccaggcattgatccagcattagtcaagctacaagacactgatgtagaaaaccataatgtcagtttactaatgtagaataagaaataaaatctcagaagacctgagctctcctgtcagcatgacttgcacttgtacttttcctttttgtagagaagctaaattataatcagaaagttgttttggtgagcttggaatcagaaaataggagtttaagtcatctgttcaacatgcagctttcctcagctgtgatagctttttcctgctgtccagtcttcatgtggagcctggtcaatagcaccagaattctaagtctgctggccaaggtgctgcctcctgcagagagagaaagcccatcaaagttgacttcagtgactcccccttcactcacccctcatcttccacggccaaccaactccctttttgattgacacatcatttctttacatacattaatgccttccatattaccacagagagtttgttagactggaaatcattttatttctttgatctacttcatctttctctgcattgagcctttgcgtactaatttatagctattttctcacaggatagtctatttccattatatctatattttctagtggtcctttgcgtttgcctcttttccagactgtatagggcatggtgccaggcacagtttatttgttttattctatatgctgatagtatcatcttttccatctttagatgttttatctcattcagagtgagaggggcacttggtcagtcctttttgcatctcaatagttgatcctcttttgattaaaaaatatttaatttctaataatgtgtgttagagtgaaaataacaggaattattaggcccagtcaagactaacagttcttgactcatagttccaaatcacagttccaagatttccttaacctttctgatcctcacttccctcccaaaaaagtaagaatggctataattacctacctcatggaaattataaggcttcagcaagattaaatgtactcatttatttaacatgcatagtaagaactataaatgttaatttattcttacttacattaggatactgacttatgaaacagagattaaacacattctgcaaaaggactggtattgacaggctttgattctaatagctcaaaagataggccatggcttgctagagaaaatgaaaggatactcaaggctcattagattaaaaggctgctaatgttctctaagctgtaagtagatttttgcccacatttatgaaggttgatttctaatcagattagaaatggcataggctggtggcgtcatctcagagctgccacagcattctcaggagactcagccatatcatgttgggttgctctaagaacacacagagacctttatgctttttcacaaaagcatactctttccctggagtgtgtaactctatgtgttgacctttagtgggataagttcttacaatggagctattctgggtacaaaacatcactactctgtgagatttaggaagataacactgtttgctgattttacaagcccactcgagtgtcttgatgtgtcaaaatgggagtccctgaacacggaggaaattcacaacatcctaagcaattgtaacagatgaccttatctaatgagaactggggaagtcctctccttttagggaaagtgaaaaatgtgaactaaataggactttctgtaggagagatgcctaaccacccatgggcatgctcacttctacttgtgcagagagtttgcacaaccccatctcatttggtcctcacatcttctttgtattcattcactcagctaggaaggggaatggaagaacacattctccaagagtagtgcctttgcaacatatttttcaagtaaagtgttgacacaatttttgttaagactatgatgaaaagacaattgagaaagaattgtgaaagccagatcttgacatatgcataaaagtacatggatgcctggctctgggctgattaatgatctgtggttgttaaaatctagttatgcctccacttgggaggagtaggtaagctcccagggcaggtatgaacctcaccattttagagaggaagaaatctcagtgtcaggatgttaagttagttgccaagacctcaaaactcataaatagcagagccaggaccagggttgaaagtctggtgtttcacattctgccacacctctctggccagtgttgttcgtgaacttcgggactaagactccagctcaaatcctatgcggatgtaggtcaatttcttaacctctctaagcctcagttttctcatccttgatgtggggatcataaatttacttcttacgaagatgaaatgaaataatatatgtaagcagtgtgttcaataattgttagttcctttgcccttcctattttctcaccaaggaaatcaggtgcaataagctttagtgatctgctaaggctagataactggtaaatagtgaaagaagagtgaggagtcaacagatgattctgcttcttatttcacgtgctttagtggtatttacagagccctggtgcaagagtttctctttgtacttagagaagttgattttctttttcctaatttcttcttatttgaactaagaaccctctacttctctccatcccatctgtattttttctgatgagttctgtagaatatgatattgcattcaagcttcatcatacttttggtagcgcctttgcttgctacatgataactgtcattttagctgcaatttttcaaaaatctcctaaaacactcttctcacacaatcggcctctcttaactaacttgtagacaattttgcccttctgctcaagatcttttctgcctcctttagatttcctccctatccatttctgtctcttctccctatgccttgatctaaagcttttgtgcattatgggactttctccgaatccattttgtagtcattcactcatgtaggataaatgcattttttaaagcactttcattttcattttacatgaaagagaacacttgggtactggtgaaatgcttaggtcagcaatccttttgggaagatacacatgaggggtattatgtatctcgtctttccctctttcaacattttctaattcaattctatataataaatatttactgagtatctactctctgctgggtattgtgctaggttcaggggatatataactgaatcagacagaacccctttctttacagagcatatatgatgatgtcatctcaaggggagcccaggatttcaggtcacctatgtataaagtgagaaataaaggctggctaggagtcagccatgggaaggggatagaataagttgaacattcatggtaaagagaatactgtattcaagatcctaaagcataatatgttggaaaacagaaaatacagtatggccagaaggcagaactcaaaggagaatgagagccagcggatgcggtaggaaatgtggggaagggtagataaagaagttagggggtttattctcaagacaatgagaaattattgaaagagctaaatgaggaattggtataatatgaaatttaaaaaaattatcctaattgcagtggtcagatgggacaggaggcaggcagcaagtggagaaacagaagacacacagtaaaggagccaacctagactcagtggtaacagagatagcgataagtgaacagatgagaaagatctgggtttagaaatggcaggacatgctgatgattgagctatagaggaagaggaaaagaggggagtcaaatacctgtctatgcactgttcataggagatttaatctagtcaactgttttgagctaaaatgtgaaaatacaaatgccatggccagagcaaccataactattaattagcagcaacccttggcaccttcacccaaagcaatcactatgctgggaatatcagactctgcagtagaaccaaatccaggacatccgtgtacagcctactcacatcacagcatctaactgtgttcacataaaaggcagtgtgaggcataacgacccaactcagaaatgccttttttttctggatgttcttttcctcacaaaacatcaaataagagagtctggccacattctgatgatttctcttagaaacttagagaaggggagaacaataatttcctaaggaagtgaaccaattgaattgtcagatgggctgagcagtgacttcttcctggctctactgtgggcctcctgatggatggacatgggccctgtggtaaagagatggttctagaaatgcacagaaactatcgattccaagttgacaaatgagaaacaaatccaatctcaccagccaatcgggactcatcattttgccaaaacaatgcccatagattgcctaccactattattaagaaaagcttttatgctcatttcaccttcagtgcccttgatccaaggtctcagatttatcctagtttcattttcagtgaagtattgatttgataaaagaaacgagtcctgctgctgattgcttagacacttgttagtttcacctgcatatgtaaggtggagttggctgtagttcaagcaatagaaagaagaggtactattttaacaacagttttcaaatctgaagctgatgttctggaaaaattagagccatcggtttattttattgtttcatttataatctcagtgtgcatgtatcttaattctttgggaatagagaaatggcttcagagaggctggctgaatggggaggcagaaacatccaactctgtccctctgggcttctatctccctggggttcctttcacttttcctccaactttgtttctttaggccctggagctaatgcaggaattgccaaaaacatacctatgtggcacacaggtcctgcatgttcttgttctagtaagtggtgtgaatgtgctgtctctagaattatcttgtcctgtctcatcaagaaaatcccctgcagatgtgaaaccctcaagcaattttctctatctgaagatcaggctgcattatttatttatagttccttcagcctccaaaagccctggctgaccctcagtctttgagaacagcacctctgtaaacagatgaaagggattccctgtctggaatgtcatggaaggttccatgaatctagcttccgctaataccaaccattctagaggataaagcccaccactgcaaaagtgtgatccagcctcacacactgccttgcaaatattcttcaggccaactgatgggtgaaggccaggtttgagaacagcacctttgtagcccatgaagtttcttgacacatttagcctcaaacacttgcagagcagatatagtcgatatatcctgggttcatgaatgacaaaacttttcttcatgctgaaaggccaatcataggaacctcaagtttggaggaagtcgcaaacgtaggagagtaggtgatcttgttatgcttaatatctagtgtgatgctggaggaaagacagccaaattggaaagttggggtgagataggatgtgtcttttccatatgtttaaaggatagtatgctgacaagatattattaaggctacaataaggcaattgaggaagctgtatgtcaataaggtcttgagatactcagagagattagacaaagcagagtaatattttcacctgcttaccctcctcttcccccaaaccataccaatgaacaacatgggccccagccctaaattcacaatctctgatgtaagagcctgactaagcatactggcattaaacataaggatgtttgtgtaggcaaaaacccccaaacaattattttagttatctcaccatgttttcatgtctgtttatgaagactcaggcttcctaggctctctgagggccagaggtctcagagctcaggaggtaactagcattggcccttcctttagtttctctttgatagcttattacttaaggaccccaggggaacagtttcccagaattctaccatgacaatttcacaatattgaaaatatattaaactgacattaacactgacatgcataattcctaccaaagcggggaggccgttttgtcatgcggcttaggtggaggagagatagtaagagctgttaggctctctgaagcctcttagataaaagaagtccttagctttgactataataccagctatgctcaagcctttttccccccactatattctttacaatttcacagttaatctctgcattatggttctctgtagccagaagacattgcagacagggaattgagaggatgcttgagttaatctgcagggtctaaggtggtaaaggcaattcagctaccctcatagcatccccgatgttccgaagaaaggaagcagagcatatgttttacatggggataaattctctttatagctaattaattacaaattgccccccagtgtggtgatgtgcacttggggatagattaactcaggggaggagtccagctgctaattcttttttttctccctccctgtccctccttgtgctcccctcctccttgctccctatttcttggaggctgtgtctcctatcgctctgtttgtacagctagcgctaatctaaaatcacagttattagatcacattaagctcctcaaagtgggtgaagcatctgtgagtgtctcattaagtcctggacacacatagtcttgccacccctctctaattaagagattcccactcttccagcactgctgactgcttcctaaagaaagtgtgcctgccctggaggggacggaagggggaaggagtgaggtaaagtaagggtgagtcttctccatagaccgtgaccttgcccagcagtgtggcctgctggaggagcagcagtagcacctgggagcttgttagaaatgcaaaatctgagccccatctcagacctattcaattgcattttgtagtttaataagacctccaggtgattcatgtacacggcaaagcatgagaagcactgaaccaggaaatggatagaggagtggatcccaggatgcaaactggcagaatcccagttgttaggagatcacgccacaggcagaattcatctcagcagaaaccgaagtcaccaatggcaagtgttcgtgtatttgtgacattccttgggaattgtgtttgtccttgcacttgcgattttgccttttaaaagagcattttggggccaggcgcggtggctcatgcctgtaatcccagcactttgggaggccccgaggcaggcagatggcttgaggccaggagtttgaaaccagcctgggcaacagggtgaaaccctgtttggtttcatctctactaaaaatacaaagattagctgggtatggtggcacatgcccatagtccagccactcgggaggctgaggcaccagaatcacttgaacccaggaggcggaggttgcagtgagctgagatggcaccactgcccaccagcctgagcacagagtgagattctgtcttttaaaaaagtattttgaaagagtaaaaggagaataataatgtcattggacacatttagaacctatgtatgccaagcattgggagtagaatgcaaggcaaacatggctcttaagaaattcacagggaaggaagattctgaaataatctctctgttcagggctctatggggattcttaaatattgggcttatatgtcttggaagaagagacattaaagtgagattttaagtaagaaaaagtataggcgtgggaagggtgtagcaggcagaagaagcagtgtggatagaggcccagggataggaagagccttgccctcagggctagttcagattggctgcaatgtggggcctgaccagagagagatggtgcttggctgcaagggtgggccagggtcatttcacgcagggggttgtaagcctggtcattaggagctttattctaaggacatcaggaagctgatgaatttttaacagagaattctgagcaggagatgtcaatgaatgtcctgattgtcatccaggtgccagctgcattgactcagcattggcccacgcacactgcaggctgagggtgtggtgtacacactctgctgcttccctggtgacagcattccaccgactctgcccttagatacagtgaccccagatgtcaattcagaaaccacacacccacgttacacagtctgtaagtgaccagccactcaggtgaaacaggagacttgagtgatggcagcaaaatgaattgcctccaaattcaactgaatatgaaaacatggatgggttctcatttcccttcaacaaggaagttccatgtctcaagcactcttttagttactagggatagatacaacagtgagcaaaacagaaaaaaaaaattctgtatttctggagcttacatttggggttagcggctgggtgacttgtatcgatttccatcattatgtccttaatttcacagacgctgaaactgctctggtttttggctatttagagattgcactctcttcctttgtggcttaagctggtgtcacctttacagtaagatatgttacctgaaagagcttttaagaaaattaaatctattttctcctgcccctgtggattagaggaaaacttcctattgcccagtagcattttttttatgctctcagtgaataatgatgataatggcagctgagatttgaatggtaacttgggtctaagtactgcatgtgatacatttagtcagtccccacaaacctgattagaaaggaattacctccagcattttacagaagaggaaatggaagcttagagcagtgggtaacttacccaggttgaaattggcagagctgaggtccaaatcagagaaattcagcatcgatggtgcaatagactctaggaagtggcctcatatatggtctagtcaatagaagaagccagaaaacgcttttcagagaatgagatctagtcttgtcaccttcttcacttaccaccttttcttggcttcccaaggctcaaagaataatatgtaggaactgctaaaagataaactggggcacattcaaattttaaggagtttatttgagcattcagcaattcatgaatcaggcaacatgagacttgggctgttcagagctccatgacaagggtgtgaggggaaaccttataaggtgtttacagaagcacaggaaagaaaatgtttgattggttaaaatggaagtttgtagttcgaggttaggcgttagtttcggattgttaagctcgagttttgcttttctaggctatgactctactctgagttgggttttggtttgcttaggtaggaacccaccacactggagctgactcagcctaatggtctcccagttaattattttaacactatggtggggttacaaggctctgtaccagttggcctccgtttctttgttcagccccagtcctgggtactccccaccccacaccgttctcctcactcccagccacacaggccttctttcagtccttaatatttcccctgtttctttctaccacacaggctttgcacattctcttctcaatgcctaggatatgtcttcttcacatattttctcaaacacaaatgcagatctcagtttcaaggtaatttgctcttggaagcagtccctaacttctctaactacatcaaatcccactcttcagttagttccacctttcaattgcaattaacaaaattgtaattttatatttagtagtgcagtggttttcaaagtgcgactgccacaccagtggcatcagtatcacctggcaacctgttagaagtagaaattttcccactccactctagacctactgaaccagaaactctggaggtgggtggggcccagcaatctgagttttaccaagttgtcctactgattttaatgcactgtgaactcgataaccaccatttcagtatacactttttttttttttttgagacagagtctcactgtgttgccctgtatccacacctttttataatatgcttttggaggttttcccatcaagaggtggaatatatttctctacttatttaaaatacctgactttggacttatgttgtctagtaaaaggcagcaaagttacattgtgccagttccaagcctagatgtcaagaggctctatgctcttccatttactctcatggaatgcccaggctaaagtgaagtggcacgatcatagctcactgtcacccccgggctaaattctcccacctcagacttccaagtagctgggactatgggtgtgcaccaccatgcctggctagtttttgtatttttttttttttttttttagaaatggggtcttgctatgtcgcccagactgttttcaaactcctagcctcaagcaattctcccaccttggcctcccaaagtggtgggattacaggtgtgagccactgagcccagtctagcgcatgcctttaatggatgccattcttccctcataggctgttggttctatcaggacagagactgagttgttgttgattctctcttgatacccttacttgctattcagtacatgttaggtatccaattaatagttgtttagtcaataaatgagtgagcacacttgacttttgtaatgtctttttaaagaggtattattttacagataaaaaacacctgaggctttgggagttctattgactgctaggtgtgagttatgttgggtcttgtgaatttacaagtttcttctttggagaaaatagcaaccgtagcagctctaggtgcaaaacatctttgatgaagagattccattggtatttcatggataggctgaggaaaggtacttagtagcagtcccctaccaacctgaaataaacctgttttgcttccttccttactcaagcatttctcaagtatactatagctgatcttggcattaccaaaatgaatactatcctcagaaagcttaaattatctgtatgtttacctatctgctgtgtgtatgtagatttcctatagatacacatttttctaaaaaatgctaggcaggcagtgacatatgcaagagaataataatcaaattagtaccaaatacttccagttgaaaaacatagattatgtatttacatgatggttttggacatggaaagtatgagagatatttctcacaaggctgcttatagcaagtaaaataccattagggtagtctctttttcattgaattattcatccagagtcattgagggcttccctagacaatgtttatgtattttgtgtggaaagtataatatccaagaaaaaccattttcatattttttaacacttttaaatggttcactagccgggtgcggtggctcatgtctgtaatcctagcactttaggaggctgaggtgggcagatcacctgaggtcaagagtttgagactagcctggtaaacgtggcaaaaccctatctctactaaagatacaaaaattagtcgggcatggtggcatgcacctgtaatcccaactactcaggaggctgaggcaggagaatcacttaaaccagggaggtggaggctgcagtgagccaagatcgtgccactgtacttggctctgtacaagatcagcctgggtgacagagcctgggtggctctgatcgcccaagctcagcctgggtgacagactgggattctgtctcaaaaaaaaaaaaaaaaaaaaggttcactgtaaaatgaaagttttgttgtacttgctttttaaaatcacatattccattctccctcacccttgctccaacttttaaaaattgactttgtttaaaaaacaaaaaacagctgtacttggcagctggtttggaaacagcattgaagaactgaggaatttgcacaattaacagctatacatagatactggttctaggatgaaaatgtttaacggtgtgccaccaactctgttccgtgtaatagactgattaaaatcttatttacatttcttccaagttcttacaaatcctatatttctccttaattttcatttggtgggttattagatttggttgaagggaaagcgaatgctgtttaagtgtttaacaggctgttttctctactcagctgatgactgttatatttcacatttactctgaatttgaaaactagctttgcaatctcagcagaacttgttactctcatctgaatgtgccttgcctccaccttaaaacaaacctgaatcttaagactgatggttcagattttcataacaatgattaaaataggattctgggtggagcacagtgcctcacgcctttaatcctggcactttgggaggccgaggggggcagactgcctgagctcaggaactagagaccagcctaggtaacatggttaaaccccatctctactaaaatacaaaagaaattagccgaatgtggcaatgtgcacctgtagtcccagctactcaggaggctgaggcaggagaattgcttgaacttgggaggcagaggttgcagtgagttgagatcgccactgcactccagcctgggcgacagagagagattccatctcttaaaaaaaaaaaaaggattctgcatgacaaattaattagcaatcatgtacctcccatgtgctaggcagagcccagtgttaggaaaggctaggcctcaggaaaggcatagtgtctgtcttcaaggtatggagtctgtctatgctagtcctcaggaaaggcatggtgtatctgtcttcaaaacactgaaactctgcatttcccaaaggaggatggctaaaggatgagattcacataatgacattgtgaatgcagtgtggtatcctgggtcggctcctgaaacagaaacaagacatgagtggaaaaactgtgaataaaaaatgtgaataaattctggggtttggttaatggtaatatgccattgttaatttcttagttttgacaaatgtaccattgttgtgtaagaggttaatatttggcaaaattgggtgaagggcatatgggagcttacattagattcataacttttagatttgtaacttttctataaacctaaacttccaaaataaaatgtttatttttaaataaaagcactaggattctagtaaagacttactggaaagctcctgggttatttatgggaaataattattttcaggaaagcaccccattcttgccctccctccctgcagccttagaggatgtgtgaagaattaactggtcactgggagaatgaagttatcttttgtggataagggctgtgcaaaatgaacatagccttgtgaagtgggaattagggccacatctggagaattggtacctgctcaccactttataattgtgtggcttcgggtcagttaatgtatctgagcctcaggttttttaatctgtacaatgaacgtattgttttgcttatgcagacaatgggactactctaatagcgaatttaaaataatgttgtaaaagtgctgtaatcactgtgctctaaaaatgtaagaaaggtacttaaaccttccagccatggccaacatgactaatgacagctgagtggtacttctaggtacttcccagacttgagccttcaacaacctgaactccattgctttattgaagatggagagacaaagctttcctatgaaaaaaatggccaaatgtgtgttttatcctcctctggtggatagtccaagcattgcagcctcttattggacttgagcattatctgcaagagcagttccagacagctcttatgtattgcagtcgctctgctccctgcattccaccttcagggcagctccatccgtttttctttcttatggtgcctcaaatggccttacaacaacagcgtactattaaatgtatcattttttgagaatgcgctaatgcttttccccttatacctctagggtttactttgtcattctgtccttttatggtttatttcaacatacttagcataaagcctagagtggtgggatgcaatatcttaccttagctgaattgtggcctggatcatcagtgtccttcgcaaagaagtatagctgtagattctccctggaggaaaaacccatttaatatttagtttcatctcctttcattttgttcttggtgtaccagaaaagcagcaatgctggctcaggaaagagggacttttcagcaattcatttacctccctagttttgaccttcctcagctggatgtaggaaaaaaagatgttctcatcctgacttcacccacaccacaaatgtacatttagtacctcatcctccggaccagatgttaggcactttaggttcaaagggttgctgcccacaagagttactaactgggaagactgaggcaatgcattaaaaaagctcacactctgcctcatgtaatcaatgccatctggtggtatttccgcttgttggtaataggtagtgataacaacaagaatgataacaacgacaaacattaagtcagctctgtgaaccagcctctaaccaggtgcattatatacgatatctcttttgatatgtccaacaatactagaaggtaatactctttaagatatttttgcaaatgaggacactggggcttgatgaagttaaataacttacccagatataaccattgtaagcagaggagtaaatattttgattacataaatatatcgctgagttctgtcattcagtcttttctcatgacttttcctcatttgtgtcacacatcactcatcagtcttggcatatcatttttcctctggagattctgaaattggcctcgcattgcttcttagccctgactctaagcagccatgatttcttgattagggttggcatagaagataaatcctattttccattcagcgaataaatgtttgttgaaagaaaaaaggcaaaaaattcctggctgaggtgtttaaggaaaagcttaacagaaggagtagaaatttgtctcagccttggaagaaaggtgtagggcctggtaagcaaagtttattatgatagtagcttgattattgagtgcttactttctgtcagcttttgactatagccactgtcaatccatttaaagccacagcatttctagatgatatgtcctattagtatgcccactttacagaagagaaacagaagcacagagagttaagtagcttgtgcaaaatcacatagtctgttcaaggcaaagccaggacccagagcctgcagtcttttttttttttttttttttttttgagacggagtttcgctcttgttgccctggctggagtgcaacggaacaatcttggctcactgcaacaacctctttctcccaggttctagtgattcttctgcctcagcctcctgagtagctgggactaggcgcccaccaccacacctggctaattttgtatttttagtagagatggggtttctccatgttagtcaggctggttttgaactcccgacctcaggtgatccgcccgcctcggcctcccaaagtgctgggattacaggtgtaagccactgcgccccacctgagcctgtagtcttaatacaccatactattttaagagagcagagatgtctgtttactgatgtattctaagggtctggaacatagtaggtgctttatatatagcgaatgaataaaaataccctctttctttggtaaaataaaagaggaaaggcattctagatggggaaaatagcaaaagcaatgatgaagagataccaatgatttgttagtgataaatggatttttatacagcaagaattgaacatacatttggcaaggcggattggagccagcctaaagagtttagactttttgtttagctctcattatcagaaatcgtcacttcctacctgtccaggtttgcataaaccatggatgctctgttttatggtcccatataatgaagattatgtgtaattacttcatagtggattgcactctagcaaaattaactgtccatatttcttctcatgagccctttgcgttaataaatgatgcatttgaggaggcaaaaatggttgggattttctgtgggggaattcctcatgaggagataggaggaatcatggaaaatacctggttctaacaagatcttgattattgacatctgtttctttggcttttcaaggtagtaattaccaaacagagtagtatagatcaccgtaatgacatatttggaattttctgagcaactcatgtttcatgtaaattgaggtatttcgatgtgtttcatcatattagcaccatagaatgccatatctagaactggggaaaggaaattattcataaaaaacaatcttcatggagaattcagctagagaaaaagacggaaatgaatcaaaattccccgcaatcgctcttttccacccaccattcacaatatgtgtttcttcttgagacctcaatatcctgaaagaaaatcctctgtctcagaaagtggaattaatccaggtaatattttgactggattttgactggtaatatcagctgttgctgataaagtcaagattaatgattccttggctaccagtgggctgagagtgtgaaagtcaaaacctgttagaaaccaggggaattgcccatgaaataagatggctttgtgaatgcgtaggtgactctgatttccagaggggattttgcagtaaatcaatccttctaagatatttagcttgtttaactcaatgacattttcattcataatgcttttatttctcatctcaagcaggagagacagtatcagttctgcacaaaactgagcttgaacttttacttgattgtattttcccatctataaactcttatcagggtgctaaaactgggaataaaacctagcagtttgaaaaaatataatcattttattaatgaaagagtctgtggcttgtggtagagtacacattggggcctcatttgaagaattaacaaggattaaggaagagctgcttttcatgagtgcttctctcaggaatatctgtacgtaaacatattagaaatgagtgctggtgagcactttttggacagcatttgatgtaagccctgggagaaagatgaaaaataacaacctgatggtatttagagtttattcatacatttttgtgtatattgtctcattgtaattctcataatagtttgtatcaagcagggtgttattatcatcattttacagatagggaaattgaggctcagatggattcatttactcaccttgggtcctgcagaggaaaagtgaaagcaagtgtttaaacgttgacactcagatctcttactccaaagaccattctctttattattaaactattgattagcagtgattcacaaaggtctgttttgtctcctacaaatgtgtcattgtgtatgcatgactgaacctgtcttcttaggaaatcacgatgtatcggtggttcctgatttcttttttagcacataacatacctttctgaccctgccacctaatgcaaagtgtactactattcactcattctgttcttgcattttgtagattccaaaagcattcattttcacacctactatgggagacggagttaggtaagggaacggacgagcgtagacttgaatagcagctctttttcttaccagcggggactttgcctctcagaaagctacgcaatctctttgagtctcagtttcctcactcataatatgaaactgagagtagtactgactgtatatttttgtaagaataatgtctgtcatcccctagcccattggaggtgtcaacacatgggggtgagttaaaaagagaagggtaagacagtctccatcatgaatacatacttagtccaaagggcgggggaagaagcaaaagtattgcaatcagtgctgtttcctcagttgaataattaatgtaataatactgtttacccaaaaaggataaaatgggataatgcatggagaacacttagaatcatgcctggcacatagtaagtgctcaataatttttagctctaatcatagtaattagtaagtgctccatcagaggcttgcactggtactatggttgctctgaggcaaaagcttcaatcattgggctaagtcagagaaggcatcacaaaaacagtgccatttgaatttagtcttgaggcatgtggaggagccttccatgctgtccagagttcttcaccctgatggctgatttcataaataagcttaagtgcaatgtgtaggaaaattggagtgaaagttggcaatggcgggagtgctggtatgtgttggagtaagggtggcagggactacaatgtcactgccaacaaatggcaaattttatggaaattaaaatatcctgcaaagtgcggattcaaggcaatgctgtcccctttgctacaggtccactgcattaatcacatcctttattacaagtgtcaacacatgattgggagcaaaattctttgaggcttaactgtaaaggaagaaagggataatggcacaaatgctgacctccattcaaatcttgccttaccactaactagctgcgtgatcttggagtaattgcattgcctttctgaggtttcattccccagatcttcaaaggaagtgacaattatataccttgaaatgttgttgtaagcatttgagataataggcatacagtgtgtggtgttttggtagattctcagaaaaataaaaatactatatataattataaatatgattctaatttattttataaattataatatatttacaattatagctaaataccaagcactgtgttaagagctttataggaactatctcctgtaatgatgacatgattaataatgacacatgatggtgatatgattgacagaaagatatcagcaggcccagatggaggatatagagttcttttaatgacaaggatgcagaaacatacggagattgtatagtacctagttttaaagcagcatgcacctagagagaggtgcagctttctgggtctcccagtgtttccctgggacacacagctggggataataccacctacctggagtaaggattctattgggtgcaagaagctccctttgctgtcacaagggtgatttaatcccttggcatttcttccttcacatctgactgttctgggaatctgttgcaacttagagttgcaaggaatgaatgcgaagacaccctaggacatttctgatagttgactgtgacactaggtgatgagcatgtcagttcctcaggatcattccttgggagaactggctttaggtctgtctaatgttccccactacagagcactcagtaacttacccaagatcacacagccagtacatggaaacattaggatctaaacatgatctaagtgttcctaatgaccatgccatatccagttaagaattgaattgtgcatacaatttacaaactagttaagagtagagggaggaaagccaaacatcaacttccaaagcaacagaagttagatattctataataaagttatcggttgcatgttgccggcagaagtaatgaccaaaggagttagagaagacagatgaccaagggctggaatagctgttgaggaggaagtacattcctggcatgcaaatgattcattgcaggagggcttaccacatctgatataccacgaggcttccttgctttccagctgaaatacaaccacaacttcaccctcactttcctttcccgttaagctgcccacctatcacactccaaaacaacatgtgggaaacataccttaaacagcttttaaacttttcttaattctccccccaccacctcttctggctccatagagaataacaattgctaagcttaaaacatgttacaaaaatgttaagaattcttttctcacgttgccaaagtgactactggcttagaagaaagttggaaataagtggtgaaaagcagcttagcagaggggaaatgcgtggtcatttcctgaatgtaaaaaacacctagggttgggataatgtgaaaaagagacagtgattagatcaggcttccaagagttttcgagaggagtgcaccattagaccttgctcagcgagccaccgtccaaggctccctgatcagtctatttggctaagagacaaatgtgccaacctccccagcctcactcaaggactgaggaatcaatatctgggggcatacttgcaaacaattcataaatcttatgtaaagggatttagacaagatttgctttgctagtgaagggagtgggtagaagaattatttaacctgcagctgggcaggttaactagagagaggaagctaaatgtatgctatggtcacctctgtagaggaagagagcacagaaaattttaccttttcctggattaccttcccttcttgtttgcctggtgtcctttttttgttttgtttgtttgaaatggagtttcactcttgttgcccaggctggagtgcaatggcgcaatcttggctcactgcaacctccacctcctgggttcaagaaattctcctgtgtcagcctcctgagtagctaggattataggtatgcaccactacacccggctaatgttctatttttagtagacatggggtttctccatgttggtcaggctggtctcgaactcttgagctcaggtgatccgcctgcctcggcctcccaaagtgctgggattacaggcatgagccaccgagcccagctgcctggtgtacttttaattattcttgaagatccaaataattgcttctcttggaagctacctttcacaggcagacttcatagcttccatatttgttcttgaatgaactccataggttacaaggatttcctcacaagtctgtttctcctgctagagtcactgagattgtgatactaaacagtgacttactcatctttgtattgctactctctagtagagtgagtttactggttaaagcattttcattaaatgtttgttaagtgaataaatgttgatatatatatatatacacacacacacacatacatatatacatatatatctttatatattctcaccttcccccatccattatttctttggctaaggccacctggattttctctgttttcatctccatatctatagactgcatagacctctcacacaaatttgcattgctagttgaggtgttctttgagcttctcagtggttatgacaaaaaggactttagcagtttgtgactgtgccctggaatccttcagcagactgaaataccttcagctgaaggagatggtgtttatgcagaagcccagcacctagcccatcaagcagtctgaggtttcagttggtgccagagataactccagtgagagaactcggtctaggtttttagaagttcttccccagctaaagatgacatcttaatatataaaggtttaataatcatggatggtcctttgtagacatctattgctgtggaaactctagttctctttaccttgagtagcttcttaaaaagaaaaataaagagaagaactagcagtgggaagggagaaggggtatcaggttgtataagcaaagtgatttctctggcttatgcttctataaatttgtttataaccacaaacctctggtaacagggcatttgcagaaggaaaatatttatagaagtctaccttgccaattacattgcaaaaaataaattgcctttagagtccttaaaaaaattcaaatatgttttccctctccactgccacccccacatcaataatttgcagctcgaggtctatgtctaaaggataagagtttccacaagttgattgtggatatctgaaatcaaatttaattacatgtgatggatcaacttcttgaactcccatatttctttcattgtcttcttcggattccatgcctcacctttgtggaaactgaactatagagaaatgataacatgactcagagccagccctgcaatcaagggggagtcatctaacccaaattggtgagttcaggtcagcagcatatagtgtcttggaaagagcatgggctttgcggtcagatagacctccttgaatttgaaacccagactgttattaattatattgggcagaattcttaaactctcactctcctcatcttttaaaatgaggtttgaaattcatcatggagctagcatgatgatttactagggaacatttctctgggtatcaaggtcctcaacactcagattgcacttgctctccaacagaatttcccagtaattccctatgctagttttcttttgctgcataacaaattactagggacttagctgcttaaaacaacacacattgattacctcaccatttctgtaggtcctaggtccaggcatgaattagttgggttctttgctttaaaactgcacaaagatgcaatcaagcacagggttgtgatctcatctgaggcttgggatcttgttccaagctcacacggttagcaggatttaattccctgaagttgtaagactgaggccctcagcttgtagaagctgctcagttccctgacatgtggcctttccataggtgtttcataatatagcagcttcttcaaagttagtggtaaaggcagtaaagaaatacatttacatttatatttactaatgtaatcacaggaataacatcctatcacctttgccccattgtattggttaaaagcaagtcacaggattcccacccatcctcaagggaggggaatcacatgaaagtgtgaatatcaagaggtgaagaggaccgtgtcaccctagggtctatctaccacactgtcaacgtgcaatacccctggcatgtgtcgcagagcgccctcttgtctgtgtgggttactaattgttacagtgaaattagattcctctttccaaagaagtcagagttgtgaaatgcttgggaaactatgagctgtttccccatcccttactggtgtagacaaaaataactgatacagggcttttatttcctgtgggttcacacttagtctcggaatgctttaaaagacaacacactagacagaagctaacatttggtcagtgtcagaaagtgttataacacctattcaccattcttgaactatattatatcccagtgggctagaagtatgggtttgtctagcaccattttaagcttagtagagagaactcatctcagccttgtccctgggtcccttgaagtacaagtgtccttagtaaggacaatgacaattcatgtggaattaattagtagaaattcccacatataaaatttgtccttcactctatttcttaacaggaaaaatcaaatcaaatacattaacaccaattagatgacaacataatcgaaaacaaatgtgtttaccaaaaaaaaaaaaaaaaaagtacagataggtaactagggaaattgttaacccaacaaagagagactacatgagtctgagtcccttgggaaggataaacatgtttgtaaataaatttatttctctgtcaatatttacttttctttgtgttcctctccatgtgctgagaatttccttctcaggccttcatgattctatgagtgaattactagaaatgctgttagtctcattatttttgtaaaagaacaccttgtgcctgttcttgggctcaatttaagttagagaaaaacaaaattcatgcacatgagagagttcttataagatggaagagacatactattgatctaagacttatttgttttaataggggtccttagtcatgaattatcagtaaaaagcattttatagtaagtgcaattttggcaagaccttgtttctctagttgcataaggaatcactacatgataagaaacaagaaaagtttactggcagaaatagagaaaagatatgtacatctattttatctacctaaacataagtagataaaaatatgtgtaaatagttccttatgtcaggaaactgtgtctgaatatctttctatccttaaaggcccggcacagtgctaagtacatagtacacagtaagcatatagtaaatgtttccatatttcagggacagagtttggacgctaaaatgccaatatttgtttggctatagtgatttaatccaggaaaatagaaattagtttccatgctgtctctggaacttccacaccattctcccagcattttcatctattcaccaaactagaagctctccaaaccccatgttttaaggtttttaaggaggatccattacaaaggcatgattaattaaatcattgtccactggtaattgactcaatctcctccatcttcatctccatctctggaagtctgggggtagggtttaaagttccaaccctctaatcacatggttggtttctttggcagtcagtccccatcctgaagctatctagggtccattaagagttaccttattaggataaactcagattatggttcaaaagggctacttatgaataacaaaagacactctcctccctgtcactcaggaaatttcaaaggattttgaagctcttgtgatagaaaccagggacaaagaccaaatatgtatttcttattatatcacaatatcacaggctgtcgctgtatccaaatttcccccttcctgtaaggaaattaaaataaggccaaccctcatccagtatgaccttgtcgtaacttgattatacctgcaaacatcctatttccaagtaaggtcacatttataggtactgggggctaggacttacacatgtctttttgaaagacacaattcaacccacaacagtaactaattgacttcctttctcctgagctaccctgtgattgaggcagagcaattttctctaaggacatagcactgcaaagatagagcctataatcaaacatcctagttgctctttaggagctcaacctaggtctagcctgctcaatttagtatagttcacttctacgaataatactgaacccaaagcaagactctgacgaggatcgagaaagcagtgacacacctaaccatgctgtaaggcagaatagaagagatataacagagatcaagtgtgtaatctagaaaagggacatattgattatgctgaggaggtaggcatgggaggcagtagccatttgagaggcagaagcagcaggagcaaatgcatagagacaagaaacttccatctattgagtgactggttccacttggctgaagtataaggtaagtttggagggacagggatgccagggtgtggaaacacaggtttttgcttatgagtcttcaatgtctgagaaaaaaaaaaaaggccgcatgggatgttcttgtctatttttgctgttaggtgataaataggcagatatatctaggtatgtgtgtgcgtgttgccaagggatctgtatttatacagatttagtgacaacatttattaacacaacggggtgataggctttggcatcaggatgttgtaatagttgtaatttggcttgtatcaacatccctatttttgcagatgagtaaactgtggctttgaacaataaggacctcacccagggtcgcccagcgctggtaaatgttgggtttaggaactgaacccaggtctagctggttccagagcacacattggtgctttccgtggcgtggcctgtaggtgacttctgagggaattcagctccttggtgctgagggcttagccatgattcctttcagagtgagttctccatgtcttctttggccaggttcctgtgctcagggggattttcaaagataatggtgtccactggagggaaatatatcttggagcaaagatgtgcaaggatggttccagattctccattcctatttatgaaaactggcagatttgctgactgtgaacatagtggccaaagggctgaatagatatgagcatttgagagtaaaatgtgttttgggaagctttaaattcttatttttgaaataagataataaatgtccaaatcaaatgggaaattagtgaccaggttaaaaaataaactgaggttttccaactccaagttcagtgtattttctattttgttaaaaaagtaaaagtaaattgcaaagaagatacttggagaggaggaacaaagtaagtaaggcaaggacatgatggatacagggggattaactggggagggaatgtctgtaaagtgtataaattttggggttggggggggtacagctaaaaggagctgtcctaaatcctggcaaaggccctccactttaataagcgttgtaactttctctttcattgttggaggtaacacgtatgaaaggaaagcagcaatcagaacaatgcagtttcccagagggctctttagcagaagtctcctgtggttccatgctgttgttaatgctccccttattttagtctcctggactccctaaatgctttggaccacttgagcaaggccacgttgctaattgtgcagaaccccttcagaggtggcaccgctgagcaagaccaggcaactcaggctctaatgggccttgattgtggtctctggagcaaaaaccacctcttgaaagctgctgtgagacagctattgggaggtttggtaggaagatttagtgctgctctttgaaggatcgatgtctaagctcttcaaaacctcctgacacctcagatggattctaggtggttccccagtgggcacaatctcattatcatccacatacatttatttatctcctaataggggcccatcactgtattatgagggccgcaaagcctagctatggggctaaaacaagcacacatgaagcaatgaatgagtattaactgctgagatgtatatttctgatggcctcttcaaggtgcagagaaagaagatctcctccaagagaattaaatggtcagaattggggaggtaaaaattagaatctgaagaaactaaacatgctttagagagacaggtggttggcatcagaatgaattcctggcaatagggagcaacctgcagacagggaataagaatgtacacagaatggcctgagtagaatagaaaatgtgtgtctcttttgattataacaaggaagaagtcaagtttgtttttagtttgtctgtaacacccactcattcttaccaatttgccttatttgcaaagagacagctgtgcccaggcctttagaaaggaacagtatctaccgtaatttattggtattttattttcattctacagattgagtattccttatctaaaatgcctgggaccagaagtgtttcagattttggatttttttgggtctggggatatttacatgtacataataaaatatcttggagatgggacccaagtctaaacatgaaattcattatgtgtcatatataccttatatacatagctggaaggtaattttatacaatattttaattaattctgaatacctgtcacatgaggtcaggtatgaaattttccacttgtggcatcatgtcagtgctcaaaaagttttgaattttgtagcactttggacttcagagtttcaaattaaggatgctcaacctgtatttatttttacggttaacttctataggcaagtgacactggtttcaatgaaaatgtatgtaaatgaaaagaagtgaagcaatttaaggaaaaagacgaaataataattcaggtagtatatagatggggcaaaaatatgtgatattgacgcaccattgaccaaagtttgggaaaaagaggagtcatagtaaaatgttgatccttgtgttgaagtttctgatcctccttgcactactcaccatagatactccagaaaagtggaagaatgagtcaataaataaatcattcatgacttttccaaaggaaataatccaactatctgctaataagtgtcaaaactagggtaatgacaatgataaaaaggaatcaatccaggtgacacttgagagtaagaaataacaaataacagatcagagttaggtcaatgtttcttaaactttaatatgcacacaaatcatctggggattttattaaaatgcagattctgattcactaggtctggggtggggcctgggattctgcatttctagcaagctcccagggaattccagtgctgctagtcagtgaaccacatgttgagttgtaaaagttctgggtggtatcagagaggggcagaatcacagtgaactgtaaagttttgtgctactttaaaattttgttgaaaatgcaattttaaataagaaattaaaaacaaacttctacccctaaacattctaactcggaggaagttcttttccctgtaaactttagtaatgtccttcaattctataatctcttgttttatttctgtaattcatttttagttacgttttgttcttgattctcataagcataaagtcccgattggctcataataaactctgagtagacgaggcctgtgaaatactctaaaatcatgatttcattaacacgggttgtttgcacttgaggatgaagttgcccaatgttacactgtaatgggcaaaactgctttgcaaactcaagttctctaattctggatgcttttgtgtgatgacttattgctattcccatgtctctataccaatgacaaaacctttcaaccctctgagtttttcccctagctcctgggactatgggtgggagagtctgagggtcatctattgatattgaatgtggcaggagtgagattcctactcctccccttcccttgcccttcttttccaagggcataagaaggaaagcatggagtgtcagccaggctgcatggagctgcctaccagccagaacctgctaattcttattttatggaagtacctgtcatgtttggccaaatctcctacagaaggataaaggaaccaacacagaattcagctcccacactcccctgcagttataaaacttacttagctttatttaatttttaattttttttttaagtttagaagcttcagttgagaactgcaaattaagttgcgttcaatagtcttttccagctcatatgctgctgctaggttgcaattattgctcgacacccttcctcagtgttttgacatcttcgccagcctgagaaactaaaacacaattatttattaattttaggtgagttttcttcaattttaataattcctatactttatttacttatttgtttgtttgtttgtttctttattttgagatggagtctcactctgtcaccaggttggagtgcagtggcgcgatcttggctcactgcaacctccgcctcccgggttcaagcgattctcctgcctcagcctcccgagtagctgggattacaggcgcccgccaccacacccaactaatttttgtatttttagtagagacggagtttcaccacgttggccaagatggtctccatctctggacctcgtgatcaaccctcctcggcctcccaaagtgctgggattacaggcatgagccaccgcgcccggccacttattttcttatttgcatgctttatacctgctattacttagttcctgtgatgtttcccagaaatatggaattagctgtgccagacactatggccagaagactcaacagtcacatagcgttatgatggttaaatgctaggattgaatgttaaataaattttaaagtaaattttaagtggctgcataataatttattgtgtattcactaataataaatcctaagaatctaatatcccaagataaatgagcccaagaatttattcagactatattctgtaatattctgtgtgaacaaagggaataattggatagtttgaggggtaccatgatttcttacatgttgtacaacttaaatattctaagtgtatcttagatcacatgctacaaatttctattatcactattaatagctatcagatattgaactctattaagcatcatgtactttagtcaatatttgaaaccactcattgaggtggatactattatctccactttttaggtgaggaacctaagagtcaaaaacagaggttaagagcaggtgtggtgccttgcccctataatcccagcacttttagaggctgaggcaggcagatcgcttgaggccaggagttcaagaccagcttgggcaacatagtgagacccttgtctctacaaaaaataaaaatacaaaattagctgagtgtggtagtgcacacctgtagtcccacctacttgggaggctgagacagaaggattgcttgagccaagggtttgaggctacagggagctatgatcatgccactacacgctagcctgggtgacagagtgaaaccctgtctctaaaaaaaaagaataaaaaatagaggttaaataactcatgggtaatgagtggccaagcttagattttaactttttaattctaccatccatgttctcaaccattacactacacccatttaatattatcagtagatttatctgtatctatcctgaaggtatttattttcaacctatatacttcctgcataatgtgatttataatcaatatttttattccacccctaatgggtataatgcactatgctcagttctgttgagaaatgcacagaagtaaaagccatggtgcttgtttaagagctttttacaatcttgttaggggtgtggtgtgtacatatatacaaagtttagtttagtagaaggcctcagcatctatacaagttagtaggataaaagctatcccatactcagaaaaaaatttcaaattagtatcatggttaagagcaacttgtctaacctgtggcccatagggcacatgtggcccaggatggctttgaatgtggcccaacacaaattcataaactccttaaaacatcgaggtttttgtattgttttgttttttgcccatcaactatcattactgttagtatattttatgtgtggcctaagataattcttcttccgatgtgacccagggaagccaaaagattggacacccctggaattttacaggaatgaggtgccattgtgagatagggtggcctgacatattctgctaggtcaataagtatctctgatgtggaaaataactaattgtgggttatatcataaactattctctttttaatttgaagacatgttcctttctttaggtatttctcaatttgttaaacaaggccatgtttgatatctgtattttaaaatactctactccccttttatccaagatttcactttcctcagtttcagttatctgaggtaattcctgtatgaaactattaaatggaacattccagaaataaacaacttataagttttaaattgcatctccttctgagtagcaggatgaaatcttgtgccatcctactctgtcctacccagggtatgaattactttttgtccagctggccagttattagattgtgttaacctttggggattcaccaagaaccaatgttatatatgatccaagagtccacttcagtcacacactcacacccagaatgccagaacttgcaagccactgtgtaaaatatagtctggaaattattttatggaacatagttatatggcattatatgaacagttcttcaagcatgtatacatataatgatagctatattattaaactgtgccaattgcctgccctaccctttccacattttaactctgattcctaaactgttagtaaattcagaattctgagtagtgttgtgcaatttcaaaggacctgccctttcatcatactgttctgtctctgattaaataccttctttgtgtagatccttatataacatagagacagatataatccttctaaatggtctcgtaattttgtataaacccgagcagataatagtattgggggatataggatttagagaaatttattctgataactatgagaagaaatttataggtcagtgtggcattatattaatcctttttcatcttatcacacatttggctcagaatataaaatgtgtacagacatgagatctgtacattaggtagttatttatttttctttgaataattcctttctaaaacaaaatgttggtcagcagaggtggtaaaaatgctagattgttggtcttgtttgctaggattcatgacctgtttcataaaggactttgctaggatttgtgacatgctccatgaaggacttaacttgatcagacacattaaacttcggaactgaaagaaatatctgagcttgttcaacccagaggttctcaaacttcagtgtacatcagagaccaactggagagtgtattataatatagtttgctgggtcccatcctaagagtttctgattcagtaggttggggtagggaataagaatgcatttttagcatgttgtcagatgatgctgatgttgctggtctcagagccctactttgaaaaccactggtctattgtaaggctttctttttacctatgagaaaactgaggacatgagggaggccattcatgtacatatattattcaaatcctgttcctttccatccaaaagccctcatgtggtatcctgttgaagtttgaataaaatcccaaatccttattatctagaagatcttgcatgcctgttctctgcccatccttccatatcagagtctccatagagccttacttactttcactgcagttattcaatggacacattcttatttcagcatgaaaaacaactaatatgggcacatggcacagaacaaaagtgaaggtttgacttacagagaatttcaattccatttttcaattcctgccattttcttgggggctccaaatacagctaatataagtcgcatgctgagtgacttgtcagtctatattcccatgtggtgggtccatcttgattcctctgttttatctatcagagagtttgatcctcattataataatagctattcataacatgtattcatcagccatgtactagctactgtgtcaaacagtactgagatttagatgctgacttctgaggctagactctttattcttagaaaataaacaacactgcccctctattatatactgaaataatagtgatgtttgtctaaacaaccctagctggtcaaacaatggcaaccccttcccctggctgctgttttactcaccatttaacaaaaaattaggtggtgcctttggaggaagagaagggagatttaggcggaaggatttttttttaaaaatttatttttgagacagagtctcgttctgtcacccaggctggagtgcagtggcaccatctcagctcactgcaacctttgcttcctgggttcaagtgatcctctcaccttagcatcccaagtaactggaactataggtgcatgccaccactccggactaatttttgtagttttagtagagacagggttttgccatgttgtacaggctgatctcaaacccctagcctcaagtgatccgcccacctcagcctcccaaagtgctgggattacaggcatgagccaccacacccagctgaggttgaagggattcttacaaagacatgtgaagagaataaattgaaaataaatatgattacattaaaactaagctcagtactttaagatgtcatgttctctgacttgataactgaagaatttgtgtgagtcatgagaagaaggtaatttgttgtactttatattttcagctatccttgagaatggtttctgcttcttacattctcaatgatagacaagtctgacacatggagtttactttaaacggttaggcaatcccatgggttgtggcccatagggtgataacaatagaatttccttttgtctgaccttaaaaaaggatatcagataaatactgcttccttggtgcagttaattttaggccaaaatacaattattggtcagatgcacaaattatctctttatttcttaaggattagaaaaaattttgaggaatcctactttcttcctaaagcagatctgaaatagaaataattttatacaagctaatttttccagggtttttgtttgtttcttcttaaaaaactattttaccagaaaatatgaatacgttctgaaactttaccataaaaaattctcatttcttcccttcttttccttttcttttctcttttcttttctttctttctttctttctttctttctttctttctttctttctttctttctctctctctttctttctttccttctttctctttctttctttctttctttctttctttctttctttctttctttctttctttctttctttcttttccttctttcttttttctacctcttcttattttctctcattcaagcattaatgacctatcaattctacagatagttaattcacacttacaatgtgcctgtcatatttattttaaatattgaaactcactagaaccaaagtccaaatatggatgctctgtcgtggtgagtccacttgttacaaggaccctggaaaatgaaatcaacttggatagaaaccaacatagacccaattttatatcattaaaccatcttctattctaaagaacaactgtatgtgtattacatataggcttctaatagaatttctgatggacatatcagcaaatttaattcggtattttaaaaaatacatcctaaacaaaaacagatttttctcaggagtgtgagaatgatacagcatcagataataaatttaatataaataatgatattaaagataaaggaacagaagcaaaatcatttcaaaaatgtagaaacatttaatatagtcagcatatttattaaaagtaatctgaacaagcttagattggagtaggacatttttacctcaaaaacaagaagctaccaagaaactacagcaaacatatatttacattagtaacaaagcaagaatgaatactatcattgtttctattgattattgaagtgaaaaaactagccaatggagtaagacaaaacaaaaaacaaaaaaacagaagcaaaaagattggagaggaatctacagtacttttatttgcagaaagtccataagggtttattggcagactattagaattaaaaataatttccacaagtttgttgggtacaaggtaaacatataaatctaattatcctctccctacaattataattaccaattaaaatgtagaactgaaaaaaaattcatatacaatagtgacaaaaatgtaaggaagctaagaataatcgaataaaagattcaagaccattaggggaaaaatgacaaaatattattgaagattataaagtcctgaataagtcatcaacattgaccatatttatgtatgggtagactcaataacatgaagatgccaattttttctaaattcttctataaatccacacatttccactcaaaactccaacagaactgttcatggaatttgacaagctaactctaaaactcatgtatgatcacggggccaaaaatagccaagacaactcttgggggtggggaaaaacccaagagaaaagacttgcccaactagacatcaaggcatgttttatccccaaattaattaagacagtgggacatcgacacaaaataggcacaccagcctgtgggacacaatagagctcagtaactgttccttacagtatggaaaattgatccttgaccaggtagacattgaaaatcattagttaataaacaaactagtcaacctatgatgctggaataatttcttatctatatgggaaaaaatgaaattagacttcattttatatcacccatgaaaataaattaaggatatataaaaatttaaatgtaaaatgcgaaactttaaaatttttataagaaaataatggtgattagctttacgacctatgtatgggaaagatttcttaaaagaagggaaaaaagcatagatcattaaaaaaatattgatatatttgattacaattatttttaaaacttatgttccagaaagatatgataaattaaaagacgagctacagacttggagaaaacattggcaatgcacccagcacacaaaggattggtattctaaattgtataatgaccccctacatgtgatcaagagaaagaaaaataacccaatgaaaaatgagcaaaggatatgaataagcaaatgacagatgccaaaaccaaaatggatagttaacatataacacataaaagcatgtatagccacactagaaccttgagaatacaaattcaaaaagcattgagatattacttcaaaccaccagagtagcaaaaatgtaccattctgacagtattaagtgttggcagggaggagaactaagagctctcatatcttaaagagtgggaatgtgaattgaggcagccactttgaaatacaatttagcattgaagctacacatgacatttggcctcacaattgcatatttatgtaaacacttaagggaaactctcaggcaatttacattgagctagttattagaatgtacactgcttgttatgtgaaaaaaaatctaaatcagaagagtgcatcaataaattgtggtatctctatataatataataacatccaatactggagcagaacaaatgagagctacatgcaacattagtgaacctcacagtcatactcttgagtgaaaaaagcaaattactgaatatgcaaactgatactatttagataaagcttgtaaacatttaaaataatccaaaatatttcatgtgtagtttcatatatattaataatataaaaacatgcatggacatgacgaatgtcccttttagaaagaagaaagtgggactgttacaagaatattgacctatgcctgtaatattttatttcttcaaaaagaatctgaaacaaatataccagaatgttaggaattaataaaaaccaggttacaggtatgtagatatttattatattattatttctacttgttcgaatgtttgaagtacttcaaaattaaataaagaaccagcctcactgagatgtgtgtgctgagtgctctactaggtttattcacaaagttcttacactccctgctctcaatgggactgatgaaaatgtatgactcaaccaaattatatatgaccgcatagcatgacattcagcctcattgagaaaatgtcaaaattgtgaatgttaaattctaaaatatcaaggctcaactgtagacatacaaaaccaactagggacataaagaataaaaatgaaaacaaaataaaagctgtttaataatagaattcagaacaatatataatctcttcttccctgctaaaatcaggccagagattggcatttgccttcctgaaggcaatagttagcaggaaaaaccacacaggttcatataatacaaaccaaaacaaaacaaccttctcacacgaagagaaaagaatactttgcaaaatggctgctgcatcttcccaaatacatatttcacctccccaaacagattttccatccttgaccttctcgttggaaacctctccttaagcagttacacacagctctgcaaatgttagagtgacatttggactgggcttgcgtactcagcttgcccgctcttctgggcttccccgggggtctgccaagctccagcacattggtattagccttgcaggcctcacctcccagagctagcaataacatttaccagctacagttttctccattttcaaatatttcctctggcccacatgccagtgatccagctcctccatagagtagaacctgaaaggagtggtttaaagaaaggagagccctcctgtaagaacttttaacatttacctttcattaaagattttacttgtggtttaatcgagctctcccactagaattctggtatgtttgggaaaaattaattactaaaatcttacatctctgggaggcggggtacatctttgatcattcttttgtcagtgaaaactctgaaaaacaacgcctctggttggaaaggaatcaaatctgagcttttgccgaaagctttttgcaatcccaagaaatctggattgaccaggaaattctaaatcataactgtagaaacagtttcacagccttgctatgcctaatatgtgacagggactgggtctaaggaccttcataaagtcaggtgcgttgtctctctcatttgttgtatccccagtgcctgaatgaatggatgaggaatgagttgaatagtctcccaaaagctaatgagtcatgagctaatattatccttatttcaccaatgagaaacctgagactcaactgagagatcaagtgacttgtccagtcacagagctaataagtggcaggcctcatatagaggctgagaacttcattgtgctggtgtaatctgtactagtagagatacatatgtgttcaaatgtcatgataagcactggcaaggagaggtaaacatgaataagaacacagttgagtttcaactcataaatgtaggaggaaacaggaaaagagaggatcaccagtagacaaacaccacattaataaatattgcaagcaagatcactgatggatgctaaaattagtggataaaagtttgaggagaataatatttgcataggctcaaagtattttctctaatacatgtatcaactacaaaggaaaatacaatcatttagaagtagagagacctggaacttggaagatcctgactttatcaaataagcaggaaattatcaccaggaacaaggcatgggaatatcatgaaccccttgatagaatgcactgaaaaggacacaatatcatttttatggtgttcttgccaaaaacatgtaacttctctccaatcctgaaaaaacactggacaaaaccaaaatgaggatctttgatacaatatctgactagttctctttaaaaagacatgaaagacaacaaaagactgaggaactattgtagactggaagggagcatggcaaaataatagctattgtgatgtaggatcctagaacagaaaggaagagaaaaacatattaatgggaaaatagtaaaatttgaataaggcctgaagtttaaaatattgaatcaatgtatatttgctatgattgataatcataccatggtaatgtaagaggttattagcattagggggagtaaggtgaggggtataagaaactcagtataatttttataacttttctataagtatgtaagtttgaaataaaaaagtttaaaacaattaaaaaatgagcagaaaatacatttgtccttccagtttgcttacagaattgagagagtcaaatatgtaaactaaactaaagtacacacaaaaaacagtcctgtaggcaccgccgataataaatgtatgtaccagatagaaggccatggaaaagggtggtcatcttacctgggaagagagcacaggtagcactcaggataggcttcatagagaagacgatgctcaaagatttcttatttatccaccatctgttttatagagcatctactatggaccaggcactcttctagaacatagctacatcatggtaaacaaaaaagaaaaggtatctgcattcttggagcttacagcctagaagaagtcagataacacatgagaaaaaaaaaaaaaaaaacaacaccaaacaaaattaattagatattttcggtgttgtcatgaaaaataaatgagctgatgtgatagaatatgctcagggagataggggaattggggaatacctttctgagaagatgatagttaagctatttgggctagggcctgaatgggaaagagccagccgtgcaaaatgaacaaggagcaggtaattccataccaaggaaacagggtggctgaatgcccaaatgcaagaacaaattagtatgtttgtgtttaaggaaacaaaagtaagccagcatgctgggctgtaatggacaaggaggcaatagtagatgatgagctgtaaagtaaggtcaccaggtggctctaagtccaaactggcacacttttgagtaaaaggtggtgctattaataattacaccaggacaacagaagtgaaatgagactgtctggccaaacctggacataagatcatcctttagcaaggaaagaaatcacgtaggacttggtgagccagccaaggagtatgaagttattcccagtgcattaggaagcatgggaagttataacaagggtaggaggtgattgttctggctgccatgtggagaacccactattgagagcaaagaatgaatgtaggggggatcattaggagatgatttcggaagtctagttagtagacagaggatgggggctttgactacaggagtagacttgggagaggagagaactggatgacagtagagtcaatgagccttgcgtgttctcagaagatagactgagaacattttagacaaaaggagcagcctgagcaaagtcacaggggcagggcacgttccaggagccaagagtgtattctatggccaaagtgaaaggaacagcaggggcaggccattggcctggagataagaccaggggctcagatcatatgcgatttagaattcaaggctaagtagtaagaactatggtgccattgaaagtgatatgattagattggttttagaaatatgagtctagtccaactataagagaaaaagataaaatgaacagaaaaatacagtgaaaacagagatagcttttgctagttagagaaataaacaagaagacattttgaggatggtacaataatgtgggagatatttttatttttactggaaattgtccacccattcatcagacacacacttgatcatctagtgttttgcaatataattagttgttgactcaaggactgctgaacagtgtcactgagtcataaagacggctccaagaggaaaactttgggcacaaattaatgctatgtaccctctactttctatcttctgctgcagcgctattcttggcccactcatttctaagttttagcaatatttctcaggctggtgtgcctcacatgcaattctggcaagctaaacatggtgacggagccagataacttgttccctgtagactcataaactcatcagctgtgggctggtaatataatttacaatatactttgccagccctataaaacagcttttttcttgcagagaaatggagccctgacaagaagtgtttatgacttaattttagctgtgttcttcgttgttgctgcagtagtagcctgcgtatgatgcatcctagtcatccgccaggcagttacaactttgttgttgttgtttttggcaagctaaggacaacattagactttgcttaatacctaccccacaatcctatttcaatggtggccatagcatgtacctccatgtttatgaataaatgaatcgagacacagttgttggatacctcacagccgtggcttataccttgatgaaactatatgataccatatccttctagataaagttcctgtaaaatgatattgttagaaggcttgagtggaaaaatctgaaatatgctgtttacagtcaaaatgattatcctcctgctgactagttgttctttattcttctccacagtgtactacaataactatttaccattcatatttcaggctaataaggttacttctattcagccattacataatgtgactgtagctaaaattaaagctccacaaggtaggaaatttgttttattcattgctagatcctcaaggtctggaacaatgcctggaacaatagtatgtactcagaaactacatgttgaataaataagctcaactattgacatattaaatctaccctaatgatttgggaactaatactacaaatagtgtagtcatcttccaagaagagcatattctcctgaggttggccagagggttgatgaattgatgtatcagccctgatacattatatagcatccaacagtcattccaataacatgctaagatctgcaaaactgtaactgcatatttgaattcaaatccagggacagttttttaacctaggtaactctagattctactgtacacaaagttagagttgtgagatttctctttattaattctcttttttctcttagccacatccactaaaaaaggtacttttatttcatgtcctgtatgagttgtatgtaacgtctggctctgtcaccattcctttgtgttctcattccatagctaactttccttaagaagtgttgtaatagcatatatttcagtgttcacaaaaaaacacaaaagcaatgttctgactaggtgactcaatagattttatgtgttttatatatacttatgtatatgtacacatatgtatttaatcatctgtttcacaacattgttgattttgtttttcctgattttggaagcaggattccaaataaggacagtaaaaagcaaactttttcatatctctgtaagaagggaaatcaaggctttaaaatattacctcagtttcctcaggtatgaaataaaaggtatgaatgcaggtaaatttcaactttctttctaactctaaatttctatgcaattcagagacagtaatatgacaacttctatggttctttttcgataaagtgacaagaaactgattttactttaatcagtttatcagacttcttaaattttctttgttggcttgacttttctaggaaattcatcctatatcttagacaacataattttggttcacgttgtatttgtgacccagtttgtccttgtaagttgtatgtatagaattgaggtttgttgaactggcacattgtgaaacaactgccaggaagaaagtatattttcttctgccaccctaaaggatttatctctctgatctggcctcagataatatggaagcacccacattctagtgagtacaactgtgtgtggagcagttcagttatctagcccttcaacatagtcatttggaaatcaaaagcgttaaccactagattagataagacaacaaaatcaagagttcagttgaccattaatcatttttccaaaatcagctcaatgacgttgtgtaataatatttagaataaagcaaaggtaataggtataaaaatccattcatttacagatctatacccacagtcaaacatccttcttgatggttcagagctaaagcctttattcaaattttactaaccagttattgtcaatgataatgagagagtaaatgtattctctggaatactgagaaaaagaatatggcagagtgaggcagcaagctttgagcaaaacaagcaagaatatctacagaacagtgctgttcaagatgaaaagcataactggaccatgatatcaggctcaatcactaaacatagcctgcccatgactgttatgagccattcttaccctcaaagaaatataaaagatttaactttggatttttgaatgcaatctctaccatgattgtgaaagtagatccattgtgtagggagtttgagaacagaagaaagcagaacgtcgcccttatttctctatttaatcaaagtagacttcataatgataaggaagactaacaaagaattgtaattaaccctttacaattatgttccactttacagtttgaattgcagagccctttcaaacatattttcttatgcagtttttaaatatggttcaagatttacgtaagggaaaagtaaggtcccacggttgcatgcccgtgagtagtggagctgggacctcctaacaccaaggctctttctactgaccagtgctacctgcaacatggaagtatcctctcatggaagcaatgggccacctctagacctcaaggaaattcaaacacatatgtacatgcatatatatacaacatgtactgagcatggtattatcaggcatggcttggatattttcacattcatacttcagtgttttcctttgtgctggatacattttccttgcaactctggatccatttccaatctttctccacccttcttcattcagttttgcaccttggaatgtgattctatgtggattgccctgacagctcccttgtcttctgtatttcagttgagtttgtcctgtgaaaaatactcatggaagatgaaaggaaaggatgagaatgagatctgggtatttaatttcctggctcttggaaaggcttgtctgttgacctcaaggtctccactcactttatctctttcccttcctctgcactctagcaattggccctcccctagacccattagggaaagtaaaagggtctgctcttaatagacctgaatactgcattacccctagagggcccactatctcttacctataccttttaaatcttacctttattaaactttcatcaaatggcacaattcaaatgggccatctgttttttaatggtttcctgactgattcggtattattattacacttgggaaactgagtcccaacaaggttttaccatgaaataacttgcagacctggaattccacccagatcttctaactccaagcttatatgcttacagagacagcacaccaagcaatgattctgaatgggaggctgacccatatgtgtaatcacagctctgcacaatagagctttcttgaattgactcagagcaattctcagaaacataccactgtcatttataatggtttattttgaaattttataacatgtttgcacaataaagcaatggcaaaagtatctggaagaaaattgaataagattacatctagtctttcactacaccacttggtcttccctgaatcaccggagttagtctaaaaagcaagtctgatcatgtcactttctatctaaaaatgctttctattgactaatatctaaacttcctaactgtgctttttagagtcatctatgtgttcccccatctcaaattttaccatttctttccatatgctctagttaaggggttctcaactgggggtgacttttccccctaaagggcatttggaaatgtctggagatgctttcggttgtcacgaccaaagggagtgccacagatatctagtgggtggaggccagggataccgctagatatcccacaatacacaggatagcctttgcaaccaagagttatctggtcagaatatcagcagtgtcgctcttgacaaactctaatatactccagccacaccaaattcctcctgaaccttgaattttctgcatggtattagattggtgcaaaagtaattgtggtttttgcaattaaaagcaatggcaaaaactgcaattacctttgcacccgcctaataactatcattcaccagattctgtgcttaataaatgatttcatttcatgcacttgtgaaagctgtgcttctacatatgctgtttcctcagccagagtgccttcccactcttctctttgctctttactcttatattcttgaaacatggtttacaggtctccttcttcttaattctcatctatacctttgtatagatgcctaagctgaattctcacattttctttattattcaagtataacagtttacctgtttgagtctacaacacccacttgctatattctgtactaatgacagagaacatgctatttgtgctttcccccaatttcagcacagtgtctgtcacatattagatattagtcattgaatgagagaacaaatattattgcaagcagttgatagagttctgaagaattgtgttatgtttaatttgtataaattaagtcatattttaaaattcagtggtaaaaattgctatttaagaaaagtctctataaactttttggtaaattgaaattctattagaaggtatacatttataaaccagagtttctctattccatttttttctcttttgaatattaaaaatatgaaagagtacatgcctgcttttcttaaagtgataaatatcaatccaaattgttgtcatccctttagagtgctctagattttggggaatgagaagccaatatgaccatatgtaatggcaggactccgttgagaatgtgaagttagttttcaaccttgtccacaagagggaggacatcaccccacatccattttgttgattccctggaaccgttgggtctgtttggagctggagatttatgttgctcctgctgttgcaaaatacagatttagaacctggcaggcattcttgcatagatttgcatgcagtttaagatcagcccagtttgggtggagggaaagcaatctgggcattttagaagctttgtcagaataaaacacacttaagcagtgtgtgatgccagttgctgcatgaatgagcaggagagtgtcttgaaggtacagaaagagaaaagggtgagggatgtgataatttggtggtaatttgcttacaaggttgaccaggagagtgtcttcttttcacaggagatggcttaagggctggtgggagtatagtgctaggaatgaacgtcagcttgatatgctaagagcaaaatgagagcagcaaagtccactttgtgaagttatggagctaattgctcataatactgtatcagtgccagtgggcctccagcattcactagcaatatcacatgaattgcatactctagtacttttgtttacttctttccttttactacctgccagtctggctttgtctttctagactctagaagatgtaaatggtatcacttccttgcaggtgtagccaagaagatcctggttatcattctcttcctacagtccattttccttatagtttttacttttctttttgattaggaccttatcacacctaaaacaacatatgcactggtaagattgaagactttgagctctaagttttagttattttctatctctttggatgttcagatatactaatttgattaaagaaaggaaagtgggaaaatggtagaaaggaagaacagctgcctgctaggggttttctctttcaagttaaacaaaaatgaacatgcaaaccaaataatcattatcccaaagtaagaaaaggggtacaacccaatgtcataagtctcaaaaattaggagcaagacagaattctgaagccaacccaggaggaatggtcaagcatgatgagcctgctagccccacctatgttcctaaagtacagtactatccacttggtaaaaatgctgagaattattactaatatccttatatatgaaaagaaacttagtacatattcttacctgttcccactgaaaactgaagagtagtggaaatggctataggagaaaaaaatatatgtaatagaaacagacaacgggactgagaatcaaaagaaaagtcaccaggagcacatggattcccctccattgccttgggatgttctctttaaccaggcagggtgacttctggaataggacacttaacaaagcttcaggaataagacacagtccagatagctaaatgaagcttacccatagccttgacacagctcttgatgtcttccctccatttcctgaacatattctgccatctctgaagctacagaaaaaaagtgtatagaactcaaaatattacacaattaaaccgtagctaattctaggtggcaagaagtcaacgaaactgtgtctgaacaattaggaactctggacagagatgcctgagtgtaagcaaggtaaaagggaatgacatggcaatacaaatgcaaagcaacagaacaataaagttaaaaaaaggaaaaaaagcttagaaaagtcaaataattcgatctagagaaaaagcaaaagaacagaaaatttcccgtgagctacattctatggctcaatttgcattattgaatgactcaagaaaaattgaattcatgtcacaagaactcaaagaaaaaaaaaaaacaaattatctgaaaggaaaagggagattgtagactaaaggcaaaaaaaaaaaaaaaaaaaaaaaaaaggaaagccaaaacaatgtgatcacataactaatttgaaataattagtaacaacagggggtggaaaagatatggctaaaaattgaaatattgccagagggaaagtgctgaagatatcgcagttaatgctgatgaaaaaaaccagagattaaattaatcacagagaaactgagatataaagagggcagatggtataattagatccctgaaagagaaaacctaagtacttcaacaaagaaattactcaaaggtatcaaactggaaagttttcttaatataaagaactgactctgaagtttgaaagagcatgttaagttgtaagaaaactacacagtatgttcaatgctaagatgtgcattgatcaagtcattggacttcaaggattaaaataatatccttaaggcatataagcaaaatttacagcacttatcacctatgaggtagattgctggcattatacaatctcattacacaaaacaatgtctataaaattgagcataaaatcaagtgggacaagaattatctgcaaccataatgtaactcaaatgtaaacagcaccagcagacattcacaaatacgaacaaactttggtaatataacactaaagagttcttttttaaaaagttgttaccatataataacaatataacacagatgagctctttttaaaaatgttgttaccatacaataacttaacagtacattttaaaataatttaaagagtgtaattggattgtttgtaattcaaaggataaatgcttgaggggatggataccccattctccatgatgtgcttatttcacattgcatgcctgtatcaaaatatctcatgtactccataaatatatacacctatattatttacataatcattaattatgtactcacaaaaataaaaaacaacctgggtaaactaacttatttttaacttgaatctatactccccccaaaaaataaaagacattacaataaaattcaagcatttaaaagaaaataaagttactcagaaatggaaacacttggtgagaacagtgacggcatttaaatatgcaagaaatacatggtacacattataaatatagaacaaagtatacatgtgtcagaggtcccccaaaccaccctcaatctgcatcactctctagaaggactcataggacccagaaatgagaatgtttatgagtatggtttattacagcaaaagttacagagtaaaatcagcaatggaaaaaggcgcatgggggcaaagtctggaggaaaccaggcacaggtttccaagagtcctctcccagttaaatcacaaaggatgttcctaatttctccagcagtgatgtgtggcaacacacatgaagtgttgtcaaccagggaagcaaccctggagtccagggtttttaccggaggtcagtcacataggcatacgatgcttacatgactgacttagttaccgaggctccagaccccagagggaaagcaagtgttcatcataaattatattcttagcatgaactatctagaccaactggtacagtctgactcaaggccctaggcttgcaaaaacactcttaccactcagaaattccatgagctcaatacacaggagctggtgaagggccagtcgtgcaaataggcctttcttgggagtgcacagtttgaacaactcagatcttttgagttaaccctttcttacacaatatgtgataaaaatagcaaaaaatcatagatgaaggagaaaatgtcaaagaataatgttctcatttttcataggaataaggcagttttactgggtaaatttgcaggagggagttcaaataataacaccagactgggcatggtggctcaaacccgtaatcacaacactttgggaggccgaggcgggtagatcacccgagaggtcaggagtttgagaccagcctgaccaacatgggaaaccccgtctctactaaaaatacaaaaattagccgggtgtggtggcatgtgcctgtagttccagctactcaggaggctgaggctcaagaattgcttgaacctgggagacgaaggttgcagtgagccaagattgcgccactgtactcccacctgggtgacagagcgacagagcaagactctgtttcaaaaaacaaaaaacagaaacaaataataacaccagttgtcttatgtgtttaataatatcttttgtaaattttagtgagttatcttggaaggtagtacctcataaaaagtagttgaaattcggagttttttcttttgctaactttgtgtaatattaaagtttagtttaattaaagtagtacatatagattttcctctaaagagtttgtctattctatttgtgtgtgtgtgtgtgtgtgtgtgtgtgtatataatatatatatgcttagaaaagtacctagaaatatgcctctctactgttaatgatggcatgatttgaaaagcttaatttttttctttatgtatgtctacatctcttatattttaaaatgatgaacatgtactatttaacaaaattaaatctctggctagatgcagtggctcacatctgtaatcccagcactttgggaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagcccaggaattcaaggttaagtgagctatgattgtgccactgcactccagcctgtgtaacagagcaagactctgtctcaaaaaaagaaaaaagttcttaatttgatatttgatttttctttgaaaagggaggaggataatgaaagaccgaggaaatcataactctctgagacaagtttaacacagactgggaagggtggcttttatttttaagggaatttaagcatcgtacagataaaagaaacatacataaaaaagtaaatactatgattttctttctccctggattgctcctttaacacaataattttacagaaacctttttccattgtaagtattattatattgctcaattttccagtgccaatcccttcctttatttggaggagcctctgaatgccagtggggagatagttttcctcttactggtcagaggatggaaatttagagagaagtcattgattattgagattgaaaagcaatcagacaataagtaaacaatcagacagtaaaagcaaaaattggtactaaaatgtgttttaaaatgacacaatgattaaataaaattaattatatcctctagaaatagaaatgggcttactatgacaaatacagatatataccatttgggactaagaaaaattttatgaagaaaggtatgtgaaatatttttaatagccaaaaatagaggaactctggaatgggtgggaaaggagtgagcttagcagaccttctctgtgaaacaatcgtttagctggtgaaaattattaaaacatacacacacaaaagaagctaagacacacacatttaaaaaattgtcataaggacacacagcaaatggaaaaacatttattcaagacatctattaaataccagttagaaaaatgagaggtgtgatatttaaactgtaaccagctgccatccgctagctcacccctgctccttgttttggaagccaaaaggacaagagctttcttacctgccagttatcagtctagggctacagttcaaccccagaagaggcaggctactggtgcctctcattttccccagattcatgttgcagaagcggtattatgggtaggcatagccaagaacattgggctcacttcttttatccagcccccgtttatagggtataagctctataccaattgtggcagaccaataataatgcgtgtccaattgtctcttcctcagcttgcttataaggcagaggttccatgctgggaagggcaagctgaaaaggccagagtccaccatctttcccaaattcccacttatacaatggtagtgtcactcgggtggaagtgggccgctatttgtgcaaccaactgggctgtaatggcacagaaattctgcccagggatagatgcagagtgtcacaataagagtttccactctgcctggagtcactgactatctggaacagaagttagagaagttcatggctaagggttttcttaaacaatggagatcttgatggcaagcagcttatagggagcaggcagctctatgataccagcagcaatgagcaaactggtaaagcagccagaagtcgagtagagagaatcagggaatgagaaagccctgaagagccctctggggatcacacttatccctgagggtatggaaagttgtacatatttgcaaggctacacaactcagaggtaattagagtaagacacagggcagatttgaaagcattctcaagccatacacagatgcctcatccaggaggaagagtcttattggttcagaaggcttaaacgtgatctctcaaccaacactggctgaacaataaggtactcttactcaggtgctattcctaggaaaacaaacttaaaaacaaaatcgttcattcttggtggtctggaagactgtatttattctgaaggctgaaacatctcaagggtgacaggaggataatttctaagctaacagtcctttgctgaacatgaggcaagatcataaacttcctcaaagcagtctccaagtcacacatatacaacagacaaagggcaaaaatctaactgaccaagggggcttaagtacagtatttgatcaataagttacttatattgatacactcacaggaaggcaagccaaaagataaaaacaggggaacctttctgaggggggagacgagagccgtctgccgaaaatatacaagtctcagaattatctctatcaaatcactaaataaatgaacatatgaacaaacaattagaaataaacctagaggaacagggttagtgtccagacttgttacaatgtattatctaaagtccagctttcaataaaaaattaggagaatgcaaataaacaggaaatgtgacccatacacagaaataaatgcaggcaatagaaactgcctttgagtgggctcatatgttggacttaatagacaaagaatacaagtaactattataaatatgttcaaataactaaaggaaattatgcttaaaaattaaaggagaatgagaacaatgattcatcaagtagataataaaataatgaaattttaatacatattgtatatgtctattcatctatcttccaatagaaattttagagttgaaaagtccaaaaacctaaatgaaaaattcactagacgagctcaatggtagattagagttggcagaagataaaataattgtattagtctgttctcatactaccgataaaggcatacccgagactgggtgattggtatgaaaaaagaggtttaatggactcacaattccatgtgactgggatgcctcacaatcatattggaaggtaaaaggcacctcttacatggtggcagacaagagagaaaatgagagccaggcaaaaggggtttcctcctataaaaccatcagattttgtgagacttattcactatgatgagtagagtatgggggaaactgcccccaggattcaattatctcccaccaggtccctcccacagatgcgggaattatgagagctacaactcaagatgagatttgggtagaaacacagctaacccatatcattccatccctgacccctcccaaatcttatgtcctcacatttcaaaaccagtcatgctttcccaacagtcccccaaagtcttaactcatttcagcattaactcaaaagtccacagtccaaagtctcatctgagacaaggcaagtctcttctgcctatgagcctgtaaaatcaaaagcaagttagttacttcctaaatatattcagggtacaggcattgcataaatatagccattccaaaggggagaaattggccaaaacaaaggggctacaggctccattcaagtcccaaatccagtaagtcggtcattaaaccttaaagttccaaaatgatctcctttgactccatatctcacatctgggtaatgctgatgcaagaggtgggttcccatggctttgggcagctccacccctgtgggtttgcagagtacaattcctctcctggcagctttcatgggctggttttgagtttgtatggcttttctaggtgcacagtgcaagctgtcagtggatttaccattctggggtctggaggacagtggccttcttctcacggctccactaggcagtgccccagtggggactctgtgtgggggctcacaccccacatttcccttcggcactgccctagcagaggctctccatgagggctctgcccctggagcccatctctgcctagacatccaggcatttccatacatcctctgaaatctaggtggaggctcccaaacctcagttcttgacttccgtgtacccacatgctcaatatcacatggaagctgccaaggcttggggcttgaaccatctgaagccacggcctgagctctaccttggccccttttagccatagcgtgagtggttgggacacagggcaccaagtccctaggctgcacacagcgaggggtttgggggtgtggctcagccacaaacaaaaccattgtttcctcctagcttctggggcacctgcagttggagaggctgccataaaggtctctgacataccctggaaatatttgcctcattgtcttggcgattaacatttggccccttattacttatgtaaatttatgcagctggcttgaatttctcctcagaaagtgggtttttcttttctatcacattgtcaggctgcaacttttttggacctttgtgttctattttccttttaaaactgaatgcttttaatgacaccgaagttacctcttgaatcctttgctgcttagaaatttcttccaccagttaccctaaatcatctccctcaagttcaaagttcaacaaatctctagggcatggaacaaaatgctgccagtctatttgctaaaacatagctagagtcatctttactccagttcccaaaaagttcttcattccatctgagaccatctcagcctgaatttcattgtcagcattttggtgaaagccattcaacaggtctctaggaagttccaaactttcccatgtttttctgtcttttcctgagccctccaaactgttccaacttctgcctgttacccagttccaaagttgcttccacattttcaggtatctttacagcagtgcctcactcccagtactaatttactgtattagtccattttcatgctgctgataaagatgtaccagagactggataatttataaagaaaaatatgtttcatggattcacagttccatgtggctggggacacctcacaatcacaatcatggcggaagtcaaaaggcctgtcttatatcatggtagacaagagagaaaatgagagctaagcgaaaggggtttttcgttataaaaccatcagatcttatgagacttattcactaccatgagagcagtatgggggaaactgcccccatgattcaattatttcccacagggtccctcccccaatatgtgggaattattggaactacaattcaagatgaggttggggcggggacacagccaaatcatatcaataatcaaacttgaaaatagaacaatagagattatgcaatctgaatagaagaaataaaaattttgtatatttataatatataactttaatgaatggcgtgtttgtatatgcgtgcacatacaaacacaagaacttccatcatgaagcattatggatgtgctttggtgcttggaagcatgggtgtgctccaggcatagctctatgacaatttggcaggactgttaagtatacagctgggagaatcagaccgcctgcatgcaactcccagttctgccatttattagccatgttacttgatatctagaaaatgagataataaagtcttcatggtgttcttgaagattaaatgacttcttaatgcatataaagtcctagaaagcaccaggcgaatagtaaatgctcaattttaggtatcattattgatcttctttagattctgcccttccaggagataaaagatttgttttgttttgcttcacatctggatcatgtgttaaatttagattgtttccaatctaagaagagatcttcataatatgtcttattgtaacggtgtttgcaactgtcacacttttatctgtaatcgctttatagtttgcaaattgtaatgtgcagctgttagcatgtcatgagttttacctgggagatggctgattttcaggactatcataagtgcatttatattacttttcatcttttgtgtggtatctgaacagagtagggatatgataacaacacagactattttgggacccttcaatgtggtctgcctgactcttgtttctccctgtttcacttctttctagatatgagggtacgggtgtttttctcttttgttcactgttacgtctatcacctagaatagtgcctggcaatcagtaagcacagaagaatatatcatggtatctcataatctaaaaccatttactttccagtagatgcccaagtcctttgattttattccggtctcaaactaccttacatgataaccattttaaaaattatatgtctgatgctgtattagcctgttttcacaccgctctaaagaaatacatgaggccgggcgcagtggctcacgcctgtaatcccagcactttgggaggccaaggagggcggatcaagaggtcatgagattgaggccatcctggctaacacgatgaaaccctatctctactaaaaatacaaaaaattagccgcacatggtggcaggtgcctgtagtcccagctacttgcaaggctgaagcaagagaatggcatgaacctgggaggcggagcttgcagtgagccgagatcgcgctacagcactccagcctggatgacagagtgagactccgtctcaaaaaaaagaaaagaaatacatgagactggtaatttataaaggaaagaagtttaattgactcacagttctgcatggcttgggaggcctcaggaaacttacaatctgatggaaagggaagctggcatctttttcacaaggcggcaggagagaaaagagcatgtgaagggaggaactgtcaaacacttacaaaaccatcagatagtgtgagaactcatgagaacagcatgggggaaaccacccccatgatccaattatctcccactaggcccctccttcgacacatagggattatgaaaattacaatttgagatgagatttgggtggggacacagagccaaaccacatcagatgtttctgttaaattgaatagtttgttataatctgagcatcctccttctttctttcctttatgtctatagagatactacctgatctacctgttcaatatgatgccattgcttctttcattacaaaccctacccatctaccaagaccaacacagactctatcccatctgccttaattgccttcatccttcagcttccctcctctgaatgttacttgctttgtatttatttcctgtgtcatttaaccacttgtatgttccagtacagttacttgtgcattctgtgtctccctttagaacagggaccttgtctgtttcacctttgtattctccatagtgcatgtaggtagcaaatatttgacaacagccaatatttaataaagacctactcagtgacagatactgaacccaatgactggtttgattcctaggaatgtgagtgatattctcttcctgtgttttctaaaattatttgcctagtgaatatttaaacaaattcacatgttgaacatcatagtgtttcaaaacagcccctggacttggtatcagatatattgagtcaaatccagagatgctgtgtgactttgggatgataacatacccctttaagagtcttggttttcccaaacaccacatgttctcactcataggtgggaactgaacaatgagaacacatggacacaggaaggggaacatcacacactggggcctgttgtggggtggcgggaggtgggagggatagcattaggagatatacctaatgttaaatgacgagtcaatgggtgcagcacaccaacatggcacatgtatacatatgtaactaacctgcacgttgtgcacatgtaccctaaaacttaaagtataataataataaaaaaagtcttggttttcttgtctgcaagtaggaataatagaatcacactatagtgttaatcgaggtaacaaattgtcggtaacctcagactgaggaaggtatcaaataaaagtgagttttcagccaggcgcagtgggctcacgtttgtaatcccagcactttgggaggccaaggtgggtggattgtttgaggtcaggagttcaagaccagcctgggcaacatggcaaaaacccatctctacaaaatatctaaaaatcagctgggcatggtggcatgcgcctgtaatcccagctgctcggtaggctgaggcaggagaattgcttgaaccagggaggcagaggctgcagtgagcgaagatcacactgctgcactccagcctaggcaacagagtgagactgtctcaaaaaaataaaaaataaaaataagtcagttttcctctttccctatttgaataaaagtaaaatgagtttttcaagggtgtcattagctttatgttattgttctaactctgcctctatcagatattctttgaatgggccaaactctcacaatggctggacactggggatgttatgatgccagaccatgctgctactttttccttcctttaaaagctctctggtaaatatcgatttgtctgctctggtggttataaactgctgctctcctcctattcttcatgaaatacagggattctaagttttgttttatgtacttgtgttttatctatcgcatacagaattgcaaacaatactatttgtgaggggcgttttgactttttcaaaatatcttcatatccattatttaatttggtacccttcacaagtctatgagcctggtagggcaggtacctgtgtcatcataatccccttacaaatgaggaaatagagcctcagaggttaagtggtctgcccagcgtcacacagattaaaaggtggtaacaacaagggttcatcaaacacaagtcactaggctacaaatctggcaccctctctactcgcttagcctgaaagcaaaggggtatttggcaactgtgacatccgtcatcctaacgatcttctccattcttctttggcagaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttaggtatcgtatgaagtaccctctgccacttcgtttgggcttgtcttccctttcttttctgattttcattggtttgattgaattctttgtttgtttcttgaaagttagctgctcacctcttgtttaacagacccaggataaaacccaacagcagcgatcaccttctccttgtttctgcatgaggttttgatgtcaatttctggtttctgacagtggtgatttctttactagattatttgttttctaagtttcctttcttggttttttggaatcgtttagctttgtgtaaaacacgctactttggtccatcttttgatcaatcatattcccataagtccaactcctcagtcaccactcaaaacagtcacagctgaggtcagggacagggcaggaagtggaggcaaaatgttgatggtggggttgtaggaaattaaactttgtgggtagggtgagaagtacattgtttctagctccacagctactattcaaatggagaattctggtggccttgatgacactgatatctcctttgactttctcctagagggaggacaagtagattgttgttcccttggaaaataattccctaagttgagtctgtgacacgtggaaggaaaatgtgtctcctgatacgtatacccatttttcttcttgacattcttaaccatcactcagcatccccttgtgcaaagattgttaccttgtactatcactcactaataactctcttcttcttatataatacatatctattttacctcagagttgaaaaattatgacttcaaatttgtggctttattggaataggattttctctttcattgtaattacctataacagaatctttagaaattttcctttatatggcctcatattctcttctgctattgacctttactgaattctaattgatattctatagagattgggatcctcttggtttttggcaaggaaaaaacaaacaaacactccatttctgctgtttctaatcagcagaaagtcaatacccagcattgataagattagtgagacagctgggtccaaactttctaagctagtgaatgtatttgggtacgtagaatatgtttggatacagtgataccttataaagatttcagtgaaatggtttgtcagagccatggagaaaaaatgatgaacaaatgtaccagatgcaagatcatatgtaggcccacatgtcctggtgggaaggtggggtttttgaatccataccaatcttatctgctgtcaggtcaactggacacacttggaaaatgcctacatcataaacctaaaatctctgggacacaaaggactgttttgagcagtgacttctttagttatgtcttttttttttcttctagttttcagtgtttacagtaccgtgctctttttcttgtccaacttcatttgatttctgttgtcagtgtgtctcttggtttttcttttgtttgtgtattgtgtgtttggtcattttaggttatatttttttcttttgctggatctttttgtgtgcgtgtgttcctgagtttccaatcctccccgccatcaaccatggtaaatcaaaagatggtattcaacccttcaaaggcccaaagcctgcggcccgcatagcaaacagccttgagaacacagcgtattgagcagcctacagagactggcatacccctgaccctactaccttccatccctgcaccatcctacccaccttaaatcaatataagagtgtgttacctaaaaccaacagccagcagctgattatctcctcagaaaaaaacaacagaaaaaaaaaaaaaacagaaccaaatacaaccccataactagctcactgaaaaagatgatgaagacaatttttatctctggatctatttcaaagtcagagagagacaaacatatgagaatgattcagccccacgcgatcctgagggagtgtacacagtgtcattaaacagacatttttttccccattaggtgttgtttagtaaagattagagtgtcaactttgacaggtctcacatcttagaaggaaaaactggggtcagtgggggtacaaataaaagcgtataagaaataaggaaataagtgtacagattctcattctctctctcacacacacacacatacaccttgagttggtcatacatcccacatgcatttctagaagcattatttttgtattttaaactctagtcaaagtctgagagatgtgcttttccaatagactttgctttttttttttttttttcccctttggcttcttttgttgcaatttcaatctagctcctgctgcgttgaaccatctcaggcaaaggagaggtagcctctctgtagagagcactgtgcttgtccagaagccatagttaattttttttacaccaaaggataggttcatcataattactggtttgaatttatttaactttctttccaacctgacatggaaaactgaacttaaactctcatgcttgtgtaaatgcagctcttcatatccacgccttgtttaaaggttttccttccgttccctccccaaaatatacccctttgcaaatattttctttctctttgccgtgaatttgtgtttcatttttctcaattacagaagaaaatgtatccaagtagaatttgtcttcacatgcattccaccaaaattaatttcaaatgatcactttgctccctcactctattcaagttgtgtcttttttctagcccatgcactaacaatattttagtttatttcaaattgatcacacatatgcattcatgatataaaagcctagtatatatttctctgatgtaacatatcttccaaatgtcaaggagactagggttttccaatggctttatcttctgcaggcagccatatgtggtgctaacaggtatgagaaatatcctataactcagcacaacttttaaaaagttgagaggttgactattgatcaaccatattttgattctttagaattataagctataacattttattattacagcatatttaaagatttaaaagaccttatcttattttaatctcatgatctcatggatctcatgcgattaatgataatctcatgataattttgtgagataaatcaagcaagtgtttttatgcttacttttacagatgtgtagcacagagagaaatatattacttttcaaagcttacataaaaagttggagacagagctggaactagaacccatgtctctaaactgctagatcagcctgcgttatttgtttccttcacagatcagcactatgggtcaatgatgtgttagtcttaatggcttccaattgtttttatgatggtcacctttgaaacacacacagagagaatctccattttcctcagtgcccagtttgaattgagctgcactagggaaaagacagttgatatggacaaaacctttaaaagatccttagcagagtgccaggagcccttcttcaatggcagactctgagggagtggcatgtagtttggtaaattgcatttgaattctccagatgttctctctctggaaatgtggacttgctattactgtttaccaaacacattattgaagacacacagctcttagaaacatttacctcttccatgctcgacccaaagctcaacaacgagaaaaactttcttggccaggcaccttaatctaattacagacacttaggcctgtaatcccagctctttgggaggccgaggcagcccatcacgaggtcaggagaccagcctggccaacatggtgaaacctcatctctactaaaatacaaaaattacctgggcttggtggtgcgtgcctgtgatcccagctactcgagaggctgaggcaggagaatcgcttgaacacaggaggtggaggttgcagtgagccgagatctcaccattgcactcaaacctgggcaataaagtgagattctgtctcaaaaaaaaaaaaaaaaaaaaagaaagaaaagaaaaagaaagagaaagaaagaaaaaaactttctatcatttaccataatttaaaacaaaacaaaattaaaacaggcaacacacagatatgaacacatacacatcaaaagatatgccaagacttaggcagacttttttcaagcaaaaagtctggctgctaccaaacgtagatttaaaggaaattgccttcccaactcagttctttgactcatattttttatttaaaaaaccacatatataaatgtgtatgtgtgcgtgtgtctatatacacacgcacacacacacatatttatacatatatacatacacattcagtaacaagaacaccccctcagagcctatcaagaaggctctgggatagattttccttctcaaaccacttgttcttcaggtaaaataacaaagtaattcttcacatattgaggtaaagtaaacaaactgtctgccatcttgaaagcgccaagctcttacattggtttaaagaccgcatccactttacatgaaatcatttgagtgatccagaaagatgagcccaagccaccacctctcactaggccagcttcttgtctaataataaaatcctcagctatgcagaagccgaagacaaaacccacttgttgtttgcagtccttgggtttgttgctttaggctcactcttcctctcataagcgtgcccatacaccagtttcctctctctctttaatatgtcaggaagggacatttctccagctttgggtgatggtaggtgcagtcagtagctgaagccatcacctcttcctccctccctgccctccctccttccagtcctcaccaggggcatggcctcctctgtctggtaatcataccggttgctccagggctgtttgctcccacttttctgttgcggttgacgacacatgacaaacctaaccgcacgaaaccaaacccagatttttctcaagagatgttcttctcgggaacaaataagcattctgcctccttactcagaataactgggtgctataaatcgctcctctccagatttcacgtagcttcattctcccctttattcttgctcctttaaaatgattcactttggggaattcaaatggtggcatcatccttgacaagtcctctaaaaactactgggtcaaccttaagcagaagaagagtactttgtgactatattttcccctctatctttcttcctttaaaaaaaaaatcatttcgcttctaccttttagtatctaacggtaaacaaatccttattggaatttccaccatgataaaccaaccttaggctgaaccgggcagcttggtaacaactaacctgagacctttctctgaccttttctgcccagtcccctactatgcccactgattctactcaaggacttctatgttgtgtgtccatgactcccaagcagagattaatacaatgatagatatgctgatctctggcacagaataccttgtctgattactagctctggccagttggtcactcttttcttccctccctttcccatttaaaaaagtgaaacaaaaaccaaaaaattttctctcctcaagatgtggaatcacagagtgaaaaatactcaagatgtcaaaggtgccgagacctcctccacacgtgcctggcttgccttctccctgaatgctgtgggcacttgattcagtctgcgtattcaggcaggaagacagagatgggctgcgcgagggggttgatctgggagcctttgaatcactagcaatcagagaacccaattcattgtgataacatcatacaactcctttgaccctacacccgaccccacctctctaaaatctgggatgggtgtttgtgcggttagctgtttgcaagtggccattttatgacaggaaatgaccaggtggtgttaaccctttccttaccactaaggaagatggcaagtgtgcctatgcaaatttctatagcatttggggcccaacctaaggagagggtggagggagtttgattttagaaaaagagaaagggttaagtacgtcactgagcaacttcatgggcagattttttaaatgatacaatcagtcagactggtgatatgtctttggaatactaatacaaaaattgtgttaatgctactttaaaaacgaattttaagaaaataaattatagaggaaaatagaatataacctgcatttggtggggggaattattgcctatttttccaagtttgacaaaattaatatttcaaagtccaggtttgaaatactttatataaaagaatagctttttttgaaaaaaaaaaaatgtttggtgtctactgtggatatatatgtataccagtatatatctctatacatatgtgtatatatatgtgtgtgtgtgtatatatatatgtatccaactttactaaataatatactgtacatatacacccacccttaaacttgtacatactttatatatataaaatggccacatttcttacgtgtgtctgtccccggaagggtggactgattgtttttggatgtctgcagctgttaccttgaaggatgcaatttcatctttcatttatttttccccatctagactgtatcaggataaactgtaactccagtaagttttccctcaagtttcattttgttctttaaaaaaaaaaaacaaaactgactttattttgtttactgttttatgagctgttttttatttgaattattttttcttttaacaatggagtgggggggacctggggctaagaagatggggggctgggtgagggtgaagggctgagtgtggttttgggtgtggtttctgaagtgagggcaggtcctctcttctttccttgcatttgctctatatgaagaaaagaaggcaagggcacatgaataatgaaataatgaaaaatcaagttgaaatgatgatttattgtttttgggaggtaactctgagagtgaacaaaaagctttagggcaaccagcatgcacttctccactaccaaacagtttagaaaataaaagcactgttcttgacccacaggtggctgccaactctgacatttctttcccagtatttatctctgttgggaacttctagcaggtgggcagatcactgctattggtgataaggcaacactttaaccaaagacttgagacacactctgtctctgcaaaaggaagaactgcagtattattttcaccttatcccattcagataccctagttcttgaagaagggtcctaacaaggcacaggatgaaaactactcatgtatttcttcctcttccttagaagtaaacattagcttgagtcaacatgtagaaggggaatatgaagataaataggaagaataggcacaagagaaagaataggcctagatgatgaaaggaacaaaggaagaaatatgctttgagtactatagcatattatattaggcttattaatactaactactgtaacaagcaatcccaacattataatggctcaacaaaagaaggttttatttcttgttcagtcaaagtccaatgctaattggtcagttttcccagacagctctcttcaaagaggtaattcagggatctaggatccttccatgaggtgggtccaccacctcggagttctttacttctggctgtatccgtagggaagagagagagagagagagcttgggtggttgtgcagtaggttttattgccttgcctggaagtaacaaacatcgcttctatccatatttggtttgctagacatgactccatcctacatgcaaaggaagctgggaaatgtagtcggctagtgcacccaggagaagaaaaactggattagttgatatctagcacatgtaattctccatagtatctcatcatctttaaaattctttcctcactaggaaaaatccaacttttacatttggtttacttgttgattccatcctagtaagtcttttataggtgctagtttaaacttctttcttggtagaagatatattataggcatgacaaactaataaagcccaattctactttttggggggcaaatgttccatctaagttaacacaaaaagaagaaatttaaaatatcgatataagcaactgcttactaaatagagtgctttatccttgtcttggcatcacttacagttattttaagcaatggcctattttctgtgtttaaatatttctaattagccagaaatttgtcatgatatttagatcattaaaagcctaattgaaacatcctttctctccaaagcctggagttttctgttcctgtttttttggtttgtttgtttttttaagcagctttattgagatacaattttcataccactacatttacccatcataaacctacagtttaaggatgataattaaacttataaagttgtccaaatatcaccacaatcacattttagaacatttccatcatccccaagatttcttttctggtcatttgtagctaatccctgctcctacccatcgtcctaggtaactattggtgtgctttgttccaataaatatgccttttttggacattttatgtacatggaattagacaaattgttatatagtcattgtatcttgcttcttcaaaaaattttaatggcatttctatggaaatattttctctttccttttgcattggttttcagaaggaaataaggtggaaacccagcatgaaggtggaaagcctcgtatccgaagctacatctagcatcttctagcttcagagacttatttggagaacagggaactgaggcagttatttaatcaggatatcagaatttgcttttgctgttctatccacactttctcatgaagtcaatcccatatattccacatgatcagccacggaaagtcatcataagacaactcccaggattacctctgttgggaagatggtgacacagatgacagcaggttttcttaatctgataaaatattttctatttacaccccaccaaaaacagcattgagaggaaaatatgtcagcaaagttatattcccagctttgatcacaaagtatagaaagaatataactgatttcaattcaatacttacataaagaatcaagattagattttggaaattgtttttgagattttcacaataaacctttaatgtactaagaacatttattttgttggaaatttaatatcagagaaataatacagtgctcaatggttgaccagtgtttgactggaaaaaacaaatatacatgggtcttttaaactaatctaacacctttagagctaaacaatgtaaccacgtatctagggttatgtagagtcacaaagtaaatataatacattttttttctgaagctaattttaattgttaatatggagtaaaagtttaaattgaaaccaagttgatatattatgcagaagaatgcaaataagcataaatctttaagaaaaaaacataagaattcaaagacatttcatttttattgtgaatcttctctatttcatccctggtattattggcatttgagtggaaaagtttgagaagactatgcaattaaatttggagagaaaaagggcctacatgatccgaacttctaagcccctcttcttattgactccatgtcagatttcatagcttgacctgttacaggatctcacattgtctctgtaataggtgtgccggtccttactcttatctgattttcaactgtgagagtatttgcaccctgggtttgagggagaggaggttttccctgagccttacctcttgctgctatttcaatagaagtcatagggtaccttgcttaattttcaaaacagagcttcttttttttttcccccttgaagggaaatactgaattaaatttgaatcaaggtggattataagtttgtgaactttttcagtcattcttttttagaatgcctgtcctctgaaaagtcacttgggtaaaatactgaatgacatcagctatttttttttcctgttcatctgctataaaatgttgtttgttctgggaaatggctatttccaaggcattctgtgacactctttaatggagacaagagcatgaaaaagaaggatgatcttccagcatcgagagaaatcaatgggccatgagagagaagggtgatcttgaggggaaaaaaagcagttttcttctagccttcttccttttggcttcacttcctggcccttttgtcagagactatggcccagttccatgccaagtatttcctcccaagaagaaaagcaattttctaatcagctcttctttctgcctttcttaacttctcttttttaatactttgtctttcctcatggtatctatgatatattcattattattcattacaaatcctactactcctgctttccaaatcctccaagaataccacaccataaattgctctctagttactatcaataaacatatattacagagtgtgtaaatcaaggtctttggttgaatcaagtttgttgctgaatttgattcatctggcgggaatgtatttcttaatacacttaatacatatagttctagcttagaatttatttttaaattgcaaaagaacaacagagttggcagccatcatggcgaattgaactacagggtgacctggaacactactaaaggaaaacagaactggccggatgtggtagctcacacctgtaatgccagcactttgggaggccgaggtaggcagattacgaggtcaagggatcgagaccatcctggccaacatggtgaaaccccatttctactaaaaatacaaaaattagccgggtgtggtggtgtgcacctgtagtcccagctactcgggaggctgaggcaggagaatcgcttgaatccaggaggcggaggttgcagtgtgctgagattgtgccactgcactccagcctggcgactgagcgagactccatctcaaaaacaaaaacaaaaacaaaagcaaaaagaaccagggctgttttctggagaatttctggaggaaatgtcctgttcctatggctgtagttccataaggctggcagtaacctaagaggcacgcggttctgaaaacaggtatgaacttctcgttggtgtcatgagtgcgcaagtgaaagtatggaaaatgactttttgtctttgaccttgtctgattgtgcctttccctgtgatttcctagccactaatttattctatccctttcaagccatgtgcagtatgaatgaatatagagaactaataataattaaatatatggatagcttgaatgaatacagtaaacacatattaatgaatttcaactttttctttctttttctatttctctttcctctcaaacgctaattcttctgtgttgtggccatcttcattatctttctaaaatggagtgtatatgtggcatggaaattgtgagtttgtgtataagcctgattatttaggtatatgtaacagtgtctctctcactaattactttgaacctgaagacccactaatttctctgtgacaaggtttattttttcttcttagacacagaggagaaaggaagtagtgtgctgtacaaaaatatattgaccttaagacacttaagtgccacaatagagttatttgtgtcagagaatagctttgatgatcttgtgtattccctatataagctgatacctttgattcatcatagaggtgcacagtaatctcagagatgtatgaaaataacatcacaaggatatgatatctgcaaattttatctcccaagactactagtgtttgagtctttctcctcttggacttgcttggataatttgtttctttcttttttttttttttttttttttgccttttcccttagcttctctgccttaagtttctaagcagactccatttccagtgctttggaaaaattaacagcatgtgggtggttattgcttaatttaggcatagtttagtgagctgcagtttattatactggacttatggttttcttctctttcttttactctgtctttcctctccatggtacaagaatatgttatttcatctttacgaatcgtttatctgagaatctcagagccaaattgtttagctctttcctttaactcagaaactcttgcctcagaccaataaggagggctgacttcttcatcactaaaagtcattctcaaaggaaattgtagaaccctctttggtatccattttaaaagtcaagtaatcattactgtcagccatttacctggtgatgccacttattagaatcttagcagagatggaaaagcaagagcctatgtatcataatgtattctctgtcaaactataagcaagctataagcattgcacttcagagtttctatcttcataacgcatatttttgcttcttttggtatgttttatatttcttgtaacatatagaacacttcaagtgtaacaatatttatcgtatcaataacagccagattttagtatgatagtgggatgcttcctaaatatataatattaaacacttcttaataaatattaattcagattggtttattttaaaatagttaataagattatacatggaacaaaaggcaaaatagtaaaaattcttcccactcatcgtattcctcaaactccttttcccaaaggcaaccaaatttattagggatttttgtatcttctttcaggggtagcctatgagtatacaacatataattatatccacgttcttctccttttcttctttctgctcctccttctttttgacacaaataccaacaagcttttccacatcttatttttccactaaaaatgtcttagagactattccatgtaagaatatataggtttattttattccgtctaatagccacataacatttcattttaggggggtgctatattttattaaatcagcaccgtacatttaaatttttctcagctttttactactaaaaatgtaagaagtatatacttttgttcattagttaatgcatacatgtataagaagatctattggataaattcctaaaagtagaactgctgagtcaaaagataagtgcattataaatattgatatatattaccaaattgcactccaaagaggttttacaaagttatatttctaccagcaatatatgtgtttgcttctcctcactcttgtaacacacatcatattatcaaactgtattttcattctcttaagatagcttttcaaaatgttgctgtcacatatttatttcccatagatcttttcctcccatcctttaacatcttcaaatatacatagggatcattgtcattcatgactttggtgacaacttatatcagaaatcttttaatagcaatctgctgtagcaacatttcatatgttaatcttgttttgataaacagggatattgtagaaaagtagcaatatgttatagtaattttgtgtaatttatctcctacattattattgatctgtgttgggatctcagcacagacaggcatttagtgcaattacaaagagcaaggaggacactggagccaaatagcctgggttcaacacttgtctatgccacaaatgagctacatgtctttgacaagttgcttcaactcttagtttcctcaattgtaagtttcatatgaaatttagaaagaataaagggaatgggatctagcaccaaattaaaaagtaaacgtgatgtgaacttgaggcattaaattacaaataagtggtttccaaaagagagtatgctttgtctcatcaaaggaagaagcagaggaaacagcaaaagaggaggagaaaaagaacttgttcaaagcacaagccttcataagttatgtcttagtccatttggtgttgctatgatagaatacttggggctaggtaatttataaagataagaggattatttggctcttgattctggtggctgaaagtttcaagagcgggcagttgcatttggcgagggcttcatgctgcttccactcatggaggaagacagaaggggaggtagtatgtgcaaaaagatcacttggtgagagaggaagcaagagagagaaaccaaagaatatagactctttttaacaacccactctaaagggtactgatctattcccatgtacaaagagaagtcactaacccctgcctgagggcattaatctatttatgagggattcaccccgtgactcaaacgcctcccactgagcactgccaccacaaaaaaaaaggaagcaaatttcaacatgagttttggggggaacataccatatccaaaccatagcaagatatatggatataaacaaagttaatagagctgctgaattctaggaaggattgctagacaaaggaataaatttttaatatctgaacatcttaaaataggcaaatacccagccaatgtagaaattttatattgttaaatatcaggttaatagaggcagtatatagactcatataactgtttatcaatcacaatttgaactgctgtattatgttaaattagtgtacatggtttagatatataaagttagtgtacctagtttggaggtatgtatacacacacctgcacacacaaagagtgagagagagaaatatctaatgccagtacagcctaaaatttttacattgatatctgccactgtatgatttttatgacttgaagctaccttggatatagtatatgcttggtaaataattgctaagtaagtgaatggggtaatgaattgtatccattgcgctaccttaatttattatttatacaaaattgttaagaatcaacatgcaaggtacaagcctaaaaattgtaaagtacagtgttttgtcttgttgtcactcagaaaggaagaaaattaaccaaggagtgaatttgtcgtcttaacctaataatctaaaggaatatatattactttctctgtaaaataagagatttctgacaaataaatattttcatgaagtctgattgggccatattttggttgaaagtaaggaaaatttcatgaaggaagatgaacgtgtatctgtaaatattgcatgttgtcattcttccttgttcttcctcattcacttattccatggacatttactgagagtaagcagagttccaagagctgagtgtcattttaggaatttatactgcaaatttccaaggaaaatgtaggaggaattctcatagactgagtaatttctttatcccaccctactcttccctttcacattgcccacctccatttcttgtttttcttgaagaaattggacctcagatgtatgtatctctaaaatccagatgagtctcttatggattttgttcagggctaattcaacattcaattcaacataatgatgtcttttttcacaatgtgtgtgcatttctcatgatggggccctaaatgctggtttacttagggattttcctgatttccttttttgttttgatttgccctccttcatctgaccacttgcttggagcctcgcaagctgtgtttctgctcccctttaaaaggctgatgtttcagggactgtaattttagtaaaaatactatttctgttttccttctacctttccaagatttctttatgtactccaatccattttatgtgtctaattgctatagtcagatatacaaggtgacaaattctgtaagtacagttggtcctccataactgctggttctgcatctgcagattcaactaacaaaaaaattgaaaataattttaaaaaacaataaaaaaccaatataacaatagaaaataatacaaataaaaatacatataacagctatttgcatagcatgtacattgtgttaaatattataagtaatttagagattagagtataggaggatgtacatagtttatatgcacataatataagacaccattttatataaggaacttaagcatctacaaattttggtattcacaagggtcctggaactaatttctcatggacaccaaattaggaccgtattagtttcaggcacagtttatattttgaaaattaggaggtattatggtaaatttaaatggaaactgggcctgagaaatccctgagcagaacaaagccagttaggccgcataaatgaccttaaccttgctggatttgcaaataagagcaaaagttaatttgagctacagctcataaatacctatattcagagaaaacagaatgtaagctcaaccaatcagaagcagccaacaaatttataattatataactagggactttccaataggataggccaaataaggcaacagtgtaactgtaatccatcaaatattttctttgctttactcgcctatttatcctataaaagcctgctatttgcattccctcagtggagctcctgagccacttttgatttagagcttccctgtccaattcatgaatcactgtttgttaataaagtccttaaaatttttattgtgcctcagtttatcttttaaccgtttgacctctatgcggtgtaggatgtacagtgaccatttggtaagctaatattattaacctaaattctttattcttgtttggtaacaagataaatgtattaatggatgtatttccctttcattatgcctaatatatataaattatatgtataaagtacatatatacatatatatatatataaattgcagttgtttttatgcatatcataaaagataatataatttgaattctggagtttccagaataattagccacaaaatgaaagtctgtttactgattcaaagcatctcaggaaacacagtttccaattttgggaagaaaactttacagaccaggagatgttatttctaaaaaaaaaaaaaaaaaaaaatggagtaattttctggctgttctgttgacttactagaatcacatagctttttaactctgagtttatttgaagttagggaaataaaactaagaagactttatacatttccttctcaaaattaagctgtttcagaggaaatctgactatataatatctgttcagaaaatcattgtcatccccaagcctgtgccagccctctgtcagcagcactgtcctcaaagattcctcaagggaccctgtggaaaaatgaaaacaagagaggctatcaaggggtgcaagtaagaggtgcagtgttgagttataataatctaagtgtccttcctaaatggctgaaagtatattgcagtagaaaagtattaaaatgtgtatgtgtcccaaaaaagaggcaaaatgtaatggagatcatgtcctctaaagcaaaatatttggatggttatgaactcaggatcctccaataggcctgctggggcacatttcttttttaatatcaacatattacaaatggggaaaccaaggctcatggacactgagtgcttgacataaaatctcaaggtgatgaatggtaggcatgaacctttataaatttagttttataattcttcatcatatgagtactcttttgtcccctaaatcaagctgtctcttaatgatgacacaggactttgtttttaaaggattaatggggaaaaaagagggggatcactgcaaaggtaacgaattagaatatttttacctaaaccgatgaataggagtggaatgaaatttatttctgaaatccaggagatgacagagaaatgaaattggtgttatccacaagtgcgggcaggataaaatctaaagcaataaacagagggctgctcctctgttccagtataataaaaagtaatatttgaaacacaaaagcgagagagaggaagacctgcttatttcctgtgaggggttttcctgtgataggaggcacttttcttcctttcctccccagaatccgaggagaaggaactgccccactgaccagagtgacaatgcccataggactgaaggggtaagagcaacagaaacggaatgcttgaaaggagcagaaacagtgtatggcagcagcaaatgtgtgtcagatagaaagacaaagggaaagggacacaaagaagtattcacaatggagcaacacacatgtagtgtgttttataatgctggaaaaattctgtacctttcccatctcacagagaaaagagaacacaaaggaagatggataaaaaaaaaaaatgatgcagccactgggccggttatctctggctagagaaggattaccatttccttacaaaaagaaattgataattgaaattaaactcagattgcccaggtatacctgccggcagttggaatgtttaacttaactgctcggtttacttattgacaagcaaactcccttttactaatagaaccaatttacaaaactttccggtcatcataaatagaaaagccagatatggtaacaccgcgatgactagttaagtactcaggtacttatccatgactttgtttatccatcctcctacatatctgatagaaaacacaaggagtaggaatctcatggttaacatttcaaaggcatgaaaattgaatactaagtgaagatacaacttcattctttcccctcttcatatcttcctggaccctttttctcctttgtcacagcaaaataatataggctactaagtctatgcacaaggatatttacaataaacatttgacagtctttgctattgctatatgaagtgcatgcacttgacaggtggctactaattattatagtaaaaacaatagcattgagtgatttctgccattatgggataagaagtttgctggcattatcttatttaatcttcaccacaatcttataaggtaggtgtcattaccctcattttagaaatgagacttgttcatatggaggctgggtgtggtgtctcaggtctgtaatcccagcactttgggaggccgaggtgggtagatcacttgaggtcaggagttcgagaccatcctggccaacatggtgaaaccctgtctctgctaaaaatacaaaaattacccgggcatggctttggacacctgcaatcccagctacttgggaggctgaggcaggagaatcacttgaacctgggaggtggaggttacagtgagccgagatcgtgccactggactccagcctgggtaacagagcaagattctatctcaaaaaacaaaacaaacaaccaacaacaaaaacaaacaaaaaaaaaaaaaagaaaagaaagaaatgagacttagtcatatggaatgttttgcctagcttcagattcagtctactccattccaaagcctctgctcctcaccattgtacatattgcctctgccacttgtatgctgaagtgttaatgcctaaatgaatgaaatctatcactctagaacaagtgctgatggtcccatgaaagaggccacttctaatcactaatacctcctatctctgtaggtagtctttctgaagtcttgaccttccagagtcaagctccctcagctcagctctataggcatattagtgccccatgcttgccataaccagtctcgaaggcattgtctatttcagtgactgaaaggtacttggcatttagagatgcatagaagatgaattaggaattattattcaggaacagagacaactaagaagaggataacattagaatgccataattcaacttatgtttattactgatgaatcactctccacatgactgatgctttgttgaccttctcttggtaatgctggtactctctgtctcttatttccttccattgtactctagtcctctagtcttagccaacaggttgtggctgctgcaatccccgaggctcttctacgctacctctgtgtccatgctttgctgtgtgccctatagactgttcctctgtatctgcctttgcaacagctgtctgctcatccttcataacagctcaaggggttaccacctagatgaaaccttccttctactccaggcaggtctagctttttccacctttaagttctcctggcacttcgcacatctttcagaactcttatcacagttatatgctgtaaacaaagaatcatgggttttataaaattggaaaggagaactttatttctcataaagggttgcagcctgcaggctggccatcccagaggctgggaagcatagcctctggcaaaagctgagagcaagcacattgaggtgatcaggggtaaagggaacaggaatttatgctgagcagggtagctgaatatacatatttaatacactatagaaagagtcatgaatatttacggaggagaaccatgcaaatgtgcaattgagcttcatgcctcttcatgggttacacgttaaaaaaaaaatagctgtgttagcatgatctgagggtggagtttttggccctctgacatcaaaaagtaaaccagaggatatgaaaattgccagtgtatatcccccacaggtcagccaaaactggtccagagatggtggttggtttttaggaagggatgccttgtgaaactgattaactgtcacatcaatactgtaaagagggagagagagtctggttgtggcctcaggtgattggctaaagacaataaagaaatgggtcacctgcttcttttttttttttttttttttttccagagctggtttctgttgctccttaggaaagaatcctggttaaaggtgaataaggaaggggtatactgaggcatgaatatactaaggcatatctaccctccctgcccatcatggctggaaacttagtttttaaggtttctctgggtactccttggccaataggggattctgttcattcagtcaagggacttgagattttatttttagttatctattctttatttgtttccatgagtatcttcagaaccaacctctggactcctcatgatttggggaaatgcactattcatcattgtatcttcaccatctagcacggtgctaatcatatagaaggcattagtgaacacttattgaattaacaattgtaagtttaatgacttgaaactttgagccacaggagaaatctgtagataaacacagatttcttagtaagaggaaaattattccatccttacaaagacagaaatctcagcagatcagatgaaaataccatagattatcataatgagggcacttgcccaactcttgaagggaaatatgtttttagaaacccttattaaatactacaatatcagaaggctaaatttaaattaaaaaaatgtgattccaaaacaatctgagcacaacggggtgaccacagtcaacaatatttcattgtacatttagaaataactaaaaaaaatactaggattgtttgtaacacaaagaaatggtaaatgcttgaggtgaaggatactccatttaccctgatgtgattattacacatcatatgcctgtatcaaaatatttcatatactcaataaatatatacacctactatgtacccataaaaattaaaaatataaaagtaaaaatcggatccatcttttccctaaatagtggttgttcaaagagacatttaaggcacaagtgttgtttgtgcagtattgttttgcacatatcaaattctaggttttatgtcttacccaccctggatagaaatttatatccattccaggaggcggaggttgcagtgagccgagattgcaacactgcactccagcctgcgtgacagagcgagactctgcctcaaaaaaaaaaaaaaaaaaaaagaaaaagaaaaagaaaaatttgcacccattcctgtattctttttataggcttctgtaagcttcaaaaatgatccttaaagagattgaagatgatgactcagagcagaaaaataaaacaaaaacaacatgggtggcagagttgcgtgatagaaagaatggaaccttcaggtccagttaaacctgctctgctattaattagtttttggttttgaggtgatttttccaagccgtcattattagtaataagagctacaatatcattggatgaagaagaaaaatttctgaacagaagcatagctcccaaccatatgttttccataccagcatctatacaggcaccaaaaatcatggatgttcttatagccttgtgcctcacggcgtgaattgctcattgatcatttgaactcgtaacaatggaaacatcagttttaccaggcctcctgggcacttgtctgacctttctgatttgtcaaatggaattgcttcgtttgtaaaatgtttcataggagacaggacaacaatctctgtttgatgaaggtgaatgtacccaagataatttctagggttttaatggaagagttttgtgacagctggtttagcatctcatgtaaaataaattcaaggccttttgtctcactgaaagtaaggtcacattattaagagagaagatcctcctctaccaaagtcacagggattgactattcagttgaaccccagaggggctaatctgtccctgataaagttgagttggatgagtatcatgcattgcatgtgtttgcccatgatgagatatatgcagaagaaacaagaacaataatataggccaatatttaatgaggacttaccttgtaccagataatgttttcaattgtcacatgtattagatcctttaattctcacaaggatgatatggaggatacaggaccatttacattatttgtgtgatctagtgccaaataaaaatgtaagctccttgttctaaaggcagaatgaaagctttttcctttctttctcaattttttagttaacctgtcaaacatagggatactcagggagcaactgtagacccccacaggcactcacgaccccaccccacgattctttgtgtggaggcagaaggttgcagcagttgctagagggaggcagaaaagtgaatgaggaagaatctgcctgggtaggcaagaacattcaagccaaggctccaagtccctggctcatgttccattgtgccattgaacttgaaaaaacatgcacacgcataaattcacagataaaattcttaagcatttcaggacagtgactagaaagcattaagccccaaactcattgggttctaagtgactgcactggttgcatacctttgaatatggttctaaaagtaggtaataatattatctgaattttacagataaagaaactacaattaccagaaacaaagtttttgtgtttgtttgttttggtgatgtgtttgtctaccatataatcacgaaaacatactatgcctattatacaaaatttagcttgttctatattttggtatacttttaatactactgttttaaaattcttaatttctcctgcatgtcttccctcatggctaaagataaatttggtatcctatgaactatgttttccgtcaaggtttgcacaacggcataaaacaatccatcacatttttctggccaatagatacatgctttatttctgaatgtcaacgtttaagagactgaagtctgtgactactgttaattttgctagtaaaaataagttctccctgattttggttattatccattgaagatgttatcttcaatagttatccatgcctatgtcatgatatcttcacttcttcccaaatattatcttcctcagatattcaattgtgaatgaaaagtcaagctccttgtccatttttactgtacctcagccttcaaaggcctaaattaccatttcatttctgttgctgatcatcagcaactagaagacagaatttggatattctcacaccaatgtactattgctgcagaaatcctttgggctaactgagaggaccgaaaaaaaaaaaaaatacaaaagaacattccagaaataattacctattcaccatctttagtacaatgctgtacaaataattaatttttggttcgttattctctattcactttttcctaacatatggacgcatatatatgggtccagtgaatcccattcaaagagaatagatggtgggaaaactattggatgccatcagaatattttaaagaaaaaactgtcctttgaaacaaattctgcagaatattttgaacggaataagagaaaattggtttcaagttaatcagtgaaagtgaaacacttgctgaggccataataactgccattcctaagggctgacaggtcatgccattttccaatgtcttgctgaaaaaaataatttgtgtaggctaccactgagtagccatactggcttgccttgttcctgccttccttctgatttggggcactgcagtgggagctgacatgctgagctactcagctgtctcagcctcatggccaggcctcactcaaaacagtgtccgaggaaaatgacaacatccctttggggaactgagctagacctcatatagtatttgcattcatggaacagcgttttcttgtacttacagaacactttgttctatttaacagcatacatagttgtatctgattttattgccattgcctttgaaggcacacattcattgtgctatggtttggtaatgttcttctattcaaattgatttgtaacaaagaatgggtttacttggactctctgcatctagtgttggttcatgtcgcaattacctgcaggcagcaactgtttattgatgaggattttaccatagttttatgtgattacatgttagtttagctttcccttctaaatcaccacttagtttatagttcaatattatcgatccaagtgctaccagagagcaattctattgatggcatgttacgtgtttggaaggcagtctaactttcaacccacactctcttttggagagaatgttgcttcaactaacaatattgaggctcttgcttaaatattcatctcacacattagagtaattggcattaaataaacttcatatctgaatattttcattaagaactggagagttggtggtccactctaaagtgtccatatagaagttggctaactttttctgtagatggccagatagtaaatatttagatttaaaagccatatagccctgtcacaactactccattgtgctcttgtagcacaaaacagccatagacaatgtctaaacttattggtaaggctgagttccaatacaactttatttactaaaacaagtggtaggacagattttgcccaatggccatagtttgctaatccctgttctaggaccctaagagaggtacatttgtagaaattatgtttggaaagcagactagctacccagaattccaaacaataggcacatggaagtttggaaaactcttcatttaaagcattttttagttctagatgctggtaatgcaatgctgaacaagaccaacatggtttctctccttataagatttgcattaacatttgtgaatgcataaagacttaagtgagttcaagtaatgccaaatgcaataaataaaattaaacagagtaaagtaaatgcctggatgtgggaggaagtataactttagataaaactgccctggaagcttttctgagaaaatgatatttgaattttggacatttgatacttgaatgatgagaaggatctagtcttggaagggtttgggaaagagcattctgtgcagagacattgacaaaggtgaagggcttatggaagatacatacttggtgtgtttgaggaataggaagacaccagtacggttgagaagggaaagggactgttatctctatcttgaactgtccccattaaactgatctataatcagaattttaagtgagttaaattctctttctgatttacaatcatcctttcttttgttcttagtcacttgtggaggcaaattcgcaggttatctgcagcctttcatgtcaaaatgtaaatgtttataaattccaactcaccattattaaactggaagcaagccagtgtttcagttgagggacagttaaatcacactgtttgaaccatatttgaagaaatgatgacaccagtgtattagtggtaagacttgtggggttaaggatccataggtctagtcatttgagctatagagaggatttcaccatagtcaatggtcttcaattgctaaatcgggtaaaatagctcaactattagtttcactatggatgtctagaagcccaaaactcatcagttaattgaatactgtagactgggggaaaaaattattttatccaatcccaaaagaatcaactcaagtttattttacagaaaaatattgcatctagtcctatattgtaattttctgaaggtttttaaaataaaattattttaaatcctttgttgctaatggttgtaaaaacactaatccaaagagaattgccagtatctaaataaaacaccctgagttaatttgactcaaaaaatcaagtcctttgcctcagttaagtagaatgtgagaaaatggttctaacagaatcaagttcagctcagggaagttaattagagtgtcttgccttaaaagacaaggtagttttctaggcaatggtatttgataacaatgtttcacatgaatgcaacaaaattctgtgctctgttaagaattgccgaaagagaggaaaactctgtgagagagtaacctgttacagtttcagatagccagagggggaaatcagtctgaattcataaaatagtatatcatggattttttaaaaaataaaattgcttcgaaatacatacaataactcgcccaagatgtgtatgggtgcgtgtgtgtgttatctccatcccaataaatgctattgggaatatataaggctgacattatcattttagttgattaaaataaaatatctaagttactcgtagcatgcttaaaatatttttataagtaaggtaaataggcttgacaaactggtgatatcttaatttgcttctcatatccatttttatggatatgataaaggtacttgtcagcctagattttgttacaaattctcaatttatgtttgattctgaataaaattttattaaagatgtctaaatgcagcatctctgctaacataggatttccaaaattttaatttgtcaggaaaatgaagagtaagagattacattgtgtaacatagggcatttttttcctgcctcgtcttagcacaagatattacaggggtttttactctttttttaaattttaaatcaggattagtatactcatttttttcttggtgtttcctatttgtaactgatataatgccacaggcctgggagctttaaagaaaattatttaataataaaatagtatttaggagctcttttttttttcattttctgagaagatataatgcattcctttaagcattttgaatctcttctctagttggcagcagcaaatattgtaagggaatatttttgaaatatgaatcttaatcacatcttctgccatatccacaagagtttccattttatatgccacattcaacttcattcatctgacaacaatggaaaaatgttactttagacatcaatggaagttttactgagtatcatcaaatgcttagcaaatatttaaaatatttcacatattcttacgatcagaaattacacattgaagaatacttcttgatttgggaactttaataaaaagaagtgagaaatagatcttggtctgacatggaaggtggagcaagctgatgactttactaagtgacttgctacattcttatagaacaaggtagtgggagtatttttcactaaactatttatgggaccaaggtcacgtaacttactcttgtagcctaagctggtgataaggcttggacttttaatttccaaattatagcatgcaggtattagaaaactgatgacgcaagccacgattctcactgaaaaagaatagaacaatatcacacctgtaaccccagcactttgggaggtggatcacgaggtcaggagttcaagaccagcctggccaagatggtgaaaccccgtctctactaaaaatacaaaaattagccgggcgtggttgtaggcgcctgtaatcccagctacttgggatactgaggcagagaattgcttgaacccaggaggcggacgttgcagtgagccaagattgtgccactacactccagcctgggtgacagagggagactccatgtcaaaaaaaaaaaaaaaaaaaaaaaaaaacaacaacagaacaatagcactttcactcatttgcaattttagcagagttttcatgggtgaatatcaacatctgttgctccatttcctgaaaagtcctgtgggttggaatgccagtgctgtcccaattcactttgtcttttgctttagtaatagcaaaaatcaatgtaattaccatcactattcacagttttttttaataaatagtgggaccctcatttaagtcgataaaattgttctgtctcattctttgcctttgttcaggatcacatatgaaattcttttctgcaagatggttttctacctccattgaccttgaaatgaaaaattctttcaaaataaatattttacaaaattatttctaagtcgaaaaagacttagtgtcttggtgtacaagagtggggtaataccagcatgtttctcagtggggagtggggtaaaagaggaggacaaaaaggttaattaatgcataaaagtgcctagatcaaaggcaggcaccactgtaagcaaaagacatctccttgaatatttcctactaactttcaaaaacgaatggaactcagctgtggtttaaataataataatgcaagagacaaattcaagagctttgtctcttgaatcaaaaatggttgtcaagttttctggttgcatatacttaaacctgccaaaggtaatgatggctacttcaagaagtctgcctaagatgttgatacaatcaacgactctgtttagttgttcttgccaagaaagaaagaaataattccagattccaggtgttactacttagctggatgttttactttataaggaggcagcaattcatgagaaacagctgtaattacacagcattcaggtatttcataattaaactaacagctgattttaaggtggcacatggcatgagattttgcaactaggctaagtaagcatgaaagtgtagcttagttctcttgctgtcggctttggacaaatcctctctgtgccttggtgtacaagagtaggccaataccagcatgtttctcagtggggagtggggtaaaggaggaggacaagagggttaattaatgcataaaagtgcctagatcaaaggcaggcaccattgtaagcaaaagacatctccttgaatatttcctgctaactgtcaaaaacaaatggaactcagctgtggtttaaataataataatgccaaatactggaatcatagaaaactgagtattcttatcggtatccctgtgactcagtgattttggttccttagagaactcatcttgttatgtaggactgaagaggagcttggatgtcagttggataacattgatcctgttgaagctgtaccaggcactgtgtaaaatacaaaagttgtagagtcatctgcaggtctggtatacatggaatttacaatctaagtttcacgcataaaacatctttccggggaagacataagctattgcccttgaagatttgtaacctaggggttggagatagactccatgaggctgaggctcctctattccccatgcttcaggagagttgctcaagttagtcatggctgtgcctttgcttgtctctcccaagttctatttctattgcttggtaagtaaaacagcttattttcagggttctttaacaaattctgtaattagtactctaaagtgttcagtgatcctgactgtgttacttttcactattgcttaagatctcatgtcttttgagtgacctcttccttcaggaacccttagagccttggttttgtgagcccataaatgccaggaagcctccaagatttctagctttgtgaagtttacagaccattcatttccgcagtctcctgttgtcatctctaggggaattgcagtgtgtccatccacccttgaggcatggcaaggtgaacatcccttggactgaagactgaatgcttggttttgttcccatacttaatctgagagattcaaataattctttactttgctgctttcctaagactattttaataagaaaagcatcaaaagaacttggtcaagatggggaatcttgggtcaggaaaatttggagacttacttgaagagaatatttgaaaaagattcaaagattttgaactatcagggtagagggaaattgtttctggtggttaaaatggtaggaagtggctttcaaatctgaaaaaatctaaatgtttttaaggtgttccaggcactgtggttaacaatttatattccttttcttatttagtcctcccaacaaccctgccaaagaggtattattattcccctttgaagtgaggaatcttagtgcattcaaaaacattcatctactatttattgagcacccatatttctaagtgctgataatgtagttgtgaacaagacagcttatattttagaggagacaggtcattagcaactcaacaaataagtagcataattttcctaggaaaatatgttgtgcagaaggtaaggctaggttacaggtcatgccaattgaaggtgggaacacagtaggtgggtttgcaggacagaaagaatgtatgtatggctggtgagtgaacaagggaggggtggtggtgggaaaagatgcaaggatcaggcagggtcttgctggccaaggtaaggagtttgcatcttattctaggagcgacaggaagcttgaggaaacatttataaataaatgagtgatgtgattccgttatgtattgcaaagtttcctccggcagctgagaggttgaataatttgttcaaggtgaggtgggcacaaagaagaaagatggagggggataaatgactcacttggcacctgggtccctctgccttgaaatccctttcctgaatactggtctattttacttgactactagtattaagagattggaaagaaagaatgcaagtaatggtcagagaggcaaaccgacttaaaaagctgaagcaaaaagttgcattattttaggaaaatgaagcaggttcattcgtgctaactcctgggaagctggcctttgagtggctggcttgcgtggcccttgcagtgttacctggcaactaaggtaaccaggtgaggaggctcctttttaaacataccactgagaacaaagcttcgtttttggatactcaggtacaaggaggactgatatgtttgggtctcctgaactgtgttcctgaatttcctctgccttcttgctaataacctgaattgtgcagatactgctgcggctaccagcacacaccagtgttgaaagcagcaagctttggaaggttaaggagcaagttgtgcatgaaacacttgaccctgccctgctaaataaagaaccgacatacagcctacagtgggaagaaaagagagagaggatgctccttgagaatttttttttgtgttgcagactcttcccctccccttcctcctcccaacccacccccagtccatctgtgatgcctgaattctttacaggctgtcttgctaaagacatcctagccttaatcaccttctctgtattgtgtatcactcctgtatctatctacttatgtcagttgtttaccagttcccttcagctgtctgctttttatcatattattgatcagtcagtcttgggcgtcttaggttggaggggagagagagagaaccggcaaagggaagcaggagtagagaatagcggtggcggacaatcagttaagatggttccaaaaatagctcagctctgctgatgacagctctgcttgcagccaccccgtatgggatttacgcacttcactaagattctctgctgaaacggattcgaccagctgctcctgcagttggtggtggctggtggcggcggtggcagcagtgggctggttacatcttcagagaaggaattggaagcgataggtttggggcaaggcaggctcccacacagggacatgagatttattatcagaggctattaggactcaggttgtggggcatctgtgttctttgtacactatgctctgggcacttggcatccagtttctttttgtccctatctcttttgaatgagatgagggagtaagtgatgagaaattgttatatttctcacccactgtgtctattttgttgctattgctctagtttattatatacataggctttttttccctactgcactttctgttgggagactcagctatgtacaggtcccaactttataattctttggtcttatccaagactttcatttgtcaaagaaactctgcaaagtggctgggtctaaaaatgtaatataagtaagtacaacattgatagagggcccctgtccctcaaagactctaagtctatgctatgtagaaaatgcagtgtttcttatctagtaaggtgatcctctcttagaaaaagaaatgatcttgcacaggctctcaggcttttgtaatcaagactccttccagccacaacacctctaattacagggtttttggcatcctgattgtcccccaatgtactatgtgtaggggcactgtgggggtgccctataatttgtcaagcttattatcttgctctggcacacagaatacactgaatcaatttttaaggtctctttcaaaatgtgtctacgtcatctaaaacccataaatattaaaatcatatgcactagaaacagttaagatgtttaaattttccagaacacagagacttaggaaacaggcaagacacaacatgaaagcaaaaaaggaaagagaatgttacttattctattatctgccatgatggggaaaggggagacagaaaaacaactttctccttataaatcccagcttttgctgctgcctttactataaatattgttattcaaaaggttttcacctccttcttgggaggctattcagtgaagtataagatataaagagcaattttattgcctaaatgagaagctggccaaagtgtagtttcctcagctccatgctcagaacatctgattcagtaggttgagttgggactgatatacattttcataagcatgtgcagtaattctgatgtagctcgtctgtggaccacaactcaggaaccctagtcttttaaatgtatatttttttaataacatggtgctctaatttggagccctcagaaagaaaggaaaataaaacagcataacctgtgtcctccatgatagtttagtgggctctagtattagtttatttcatgacatgtaattgttattttcatttaatttgctgcacaattacttttatgtataatccatgttgagatgtgaataggacaatttactttatttaaatactttcagcattggcatacctgaggagataatagactatgagtagggaagacatgggctgatgttctacagtgttccagggtcagccattttcttgctgcaagccggagaagatccacacttccttctattctattgagccttagagtggccacaaggagtatcagttgctccctcctttgaaggctggagtctgtgaaggcagtgttcaagttcacttgttaacccacatcgccacctactgtccaccccccatccttaattaagaaacttttgcctgggagttgggcggagattagtgtgagaggctacagtatgaatgaaaagtgagattgtgaatgcacctctatcgagccctattcagaatgcttgatttgcaatagtttattaagaattacagcattactatccttaaatctaaagtctctctctctttcagtccagaagcaaattacttttgggttagaaatagcagccaagttcctgttaaaatgaaaacaaacctctctccaccttgtgtctaaggccctctttgttggctttaaaatgtttattgatttggggatttaatgttggatccaactgtgaatagtggccactttgggcctggtgagtgatcctggaatttgtcaaacaagtttatggaaggaaacctgaaaatgcttcaccctagtcctttgcctctttatttttgtgggttttttttttttctctttgagaatgttttctatttgagtggagaatgctctcatatggtacttttctctgatccttttggaaagagcaagtgtcctttgagaaatacttgttcttggttgttccctgctccccacccccatgcctgtccctgccacttctagagcaggtggaagtcgcctgtgggttcttctggtctcaggctttgactgttcccctccacaaatttgttcttaattcgattttgtattgaagcacatcagttatttgggcttccatctttagtgaaaagccacctttgcgtgttgttatgccacattacagtgttccagaaaacatattggtgtagatgcaaaatcttgccttcataatttttagccttatgttggattagagagcatattttcaagttgatctcttggaacctcagcatgaatctatattagaagcccagagaatgctaaacagagttttcactgagccatattagataacaaattattttacctataaatgagatattaattatatagattagatttttgttattagattatcagctatggagtgatcaccaaggaggataaaatagaaatagtataatcttctttgcccccctttaactctactatctgtggaatatactgaactttttacaaccaagtctttaatgctctttactttccctagcaaatgttcttccatttaaaaagtctttaaaatacttctttattttagcagtgcttcagaaaatctatcttagaccattctatgcttttaaatctatgataagattaattaagtaggctaacaacctcacttaaaaatattacctcgttcttgtaacattaatttctacagatttttttattgtgtagaagtagatacatagatattcctagtaactatagtataatataaaattaaaatcctatgtgttgaatcattatgttaataatagctgccatttctggagcactgtgtcttccaggcctctggtaaacactgttgcatacattatttgtcttagttctcaaaataatcttgagaggtttgtactattctttccatcttacagatgcagaagttgaggcacatgaagagaattcttaggatcctaaattttcataaatgccttcaggggaatttgacaatcaatctccattaggatcacattctagtagttttggccaaggagagtaaaggaaaagcttgtctttcttgcctagaagtttaaaggtcaaatcctctctctagccatattgcaattctggggacagttcctattgattgggcacttccatctaatatgctgttcaactgagattctttctggccaagagctgtgcaggggtaggtggcctcagagaaggagctgctggaagggagaaaaaggtggctttgtccaaaagagatgaagctcataggcatgctgtgcttcataccctctactagccttgctcatttaggttatttgctgaaaactatgcctgtctcagggagaatagtgggtgctggagatccgttggtgagtggatgctttctcttccctcatatagcttaattgttagtgctagagacagatactaaaataaatgtactggtgcaaagttaacaacttgacttcataagagccataaggggaaattttaaattgtgtgaaaatatatgactagaagagctgctctattctgggatggccatggagcatcacgaaaggctttgctgagcacatttgtgctggacttagaatgatggctaggagttactaggctaagaaagagggatgtgccaaagatctttaaggaacttaacatgaatgtggctgaggaaaagtgagggatgagcttagagagtgtggaaagggtcagataatggaggacacagtcagtcgtgataaggattttgcttttttatcttaaaagcaatggagctcatgtactttcctcttgatctgcccaagtacttcagtcttcttttccccttttatgcttttcatctgtccaagctcttcagctgagctttcctcactgatgacagcactatctggagtgaaggaggtgcagatcctgagatggactgcacaccccttggggctggatggacagactactcttcgagtgagataagggatgcaagtgtaaagggcgagtatgttgcctcactcaatcacatgttcaccaccctctctgccaacctttctgcctcctgctacaccctgcctaagccatgctgaccaaccttgtcactctggcctcactggagcaagaaagtcttagaatgctggagggttccacaagaataaaaagagcccaccacatctgcatgcataaacactacacagctagctcttgcttatttctgagtccagcaaatattatttgagtgtttttacacatcactgatccaataaggaaaacttgtataaagactaatgtttttatgcttcctttatagaacatgaacacatttgaggttttgttacttattctggagcattaatgcaagatccaagaatatcagctttaagatttgtttttctattctcagaataggtttgaaacagagagcaaaatacctacctgtatgccttctttagtgacagttgtttctaaaatatctgtctttcttctgagagaactatttgagtagtgagaattaagtaggaatggacataaagagattatcatgaagatggttttatgatcatcactgtcattgccattgtcaaagaggcatttattaaatgccagatttgattttagcattgttttaagttctgttacctgaagagaattcaaaatcacagtctttgtcctatgggaatttcaatctatcaggcagccttgatttagaaacatttgaagaggacataaaggtaacaagaatgaaaagagattggatcaatatataaaaactgaaagcatttatattacttagaagttaaaagtcaaaacaaatctagaatactgttgggatagtcagaataggttaggctgtgttgtggtaacaagccaaccccatacctcaggagctagcagaatggagtttatttctcacttcatacttcatgctcatcacaggttggcaagagtatgctttgtgtcatcattgttaagggacctagactgagggagcctttactatccagaatgttgctcgtcaccctggaagcaggaaggaaatcaggtgaattctgactggctttgaaaggtttctatccagaagtgacactttactttcacattcgctccattagcccaggcaagccacacggtaatgcatcactcgaagagaattagtaaaacagtaaagaaacacttctgatcaaatttagtaattattctagccacagtaatcagtcaatctaattagatgataatactattagtacttatcagcaacaaaacatgtgctaggtatcaaatgctttgttaagcaattcacacacattactacatttaatctttactgacttatgaggtgggttctatcattatctctattttccacatgatgaaattaaaactgggagtctttaagcaacatgcctcaggccacacagctggtattttgtagagctacaattaaaacccacttactcctaatttaagagtctgagtgttttttcaagattcctatcatgtcacagaagtccactgacttgttttgatcgagctgagaagaacagactagagtcacttctgacctggccacttagaattattaagaagtgtctctgctttgctagaaatctgtctttggctttgttggtatttagaaccagatggatgatgatgatgattattattattattgtaaaccgtcttccacttgttttctatttcctttctttaagggtgttagtgaataattctttctttcacccgggttcctggagctccttaagaattaacttcccaggctctttcatgtttttctggcaccatcttggatgatgagggcttagaacattttgtgactatgcccactgtctggaaaggcttgtaggtgaaggattctttaagaaaactcagatacttttctcaaattcacttatgatgatgttttcccaaatcattttttatcaattctatttttggtttctctcacttatgaattgtttctgtctccttcattttggaacatttttctagttcattgtttttttgttttttcactctccctccagtgtctagcaaaagcctaacacacattacttggatattcatatcttaaaaatgaaagaataaattagtaaagtggtggattcagaattctagttgtttttcagctcctctgccttgattacctctcaccaagattttaacgaagagtgctatgttaacaactgagccacttactttctccattattatataattttaataagtttggtagcatgttttctcacctgtaaaatgagaataatgatagcacccatctttcagggttagaatgaggatttgataatttcatgctgcaaagtacttacgatactgcctgacacacagaaagtactaccataacagcaacaacctctttatcctttgccttgggaatcaaatattttctacagatttcacttttcaggttttctttgtacactgaattgtacctaaaatttcttgtgcctcctataagagttcatcccgaggagattggttgcattattaccatatatttagatatttatttcctttaatctggtcatttattatcaggcaaaattcacccccaatatttcacataggttcttttctattttcccgaagtgttggcaggtctgagaaataaagggaaagagtacaaaagagagaaattttaaagctgggtgtccgggggagacatcacatatcggcaggttccgtgatgcccccaagccacaaaaccagcaagtttttattagtgatttccaaaaggggagggagtgtacgaatagggtgtgggtcacagagatcacatgcttcacaaggtaataagatatcacaaggtaaatggaggcagggcgagatcacaggaccacaggactggggcaaaattaaaattgctaatgaagtttcaggcacgcattgtcattgataacatcttatcaggagacagggtttgagagcagacaaccagtctgactaaaatttattaggtgggaatttcctcatcctaataagcctgggagcaccacaggagattggggcttatttcatcccacagctgtgaccataaaagacagccgcccccaaagtgaccatttcagaggcctaccctcagggatgcattctctttctcagggatgttgcttgctgagaaaaacaattcagagatacttctcccacttgcttttgaaagaagagaaatgtggctctgttttgcctggctcactggcagtcagagtttaaggttatctctcttgttccctgaacattgctgttatcctgttcttttttcaaggtgcccagatttcatattgttcaaacacacatgctctacaaacaatttgtgcagttagtgcaatcatcacagggtcctgaggcgacatacatcctcctcagcttatgaagatgatgggaataagagattaaagtaaagacaagcataggaaatcacaagggtattgattggggaagtgataagcgtccatgaaatcttcacaatttatgttcagagattgcagtaaagacaagtgtaagaaattataaaagtattaatttggggaactaataaatgtccatgaaatcttcacaatccacattcttctgccatggcttcagctggtccctccattcggggtccctgccttcctgcaacaatttatcatctgtttgggttattgtcccagggaatcatattttggtaagacacgtattctttttagcttaaatacttgttattataatacaataggcttaatgactttggctccatgtatagcaatgttttcatttgttgatttgttcttttattcaacacatatttattgagaaaaagaaaaataattacagagactcttagagctagaaagaatcttaaaatcttttaggcgaaattcaccctcacttgtacagacgtaatactaagcatgcaaaaagatcagtggcagaatttgcttcttcagtgtcaaagtagattcaatgagagcagcaaaggaaggaacatttcacttcttttcatcttttccttgggtaattccatttccctcaataaagaagggaggttcttccatgaaattaggagtttctgctcctgtaggtttgctttagtattagttgaaacattttgaatcaaatatgaagaacagtaattcatatataggctgaaggacctagattttaagttgttatggctggccccaagtctgcattgacataaggaatgtctagagtacattctcaggtctgcagccttgcattctgatgtcaagaagcttgaatggtgtcacagaaagggtgtctgaagacatggtgcatctgtttcctgtggcttccaagcaaattaccaccaacctggtggcttacaaaaatacaaactctcttgcagttctggagcctggaggtctaaaatcaaggcactggcaaagttttagtccctccagaggctctcacggtgactccattccttgtctcttccagtttcaggtggtgctcagcactctttggcttgttgctgcttcactccaaactctgcttccatcctcacatggtgtttgctgtgggtctctgcttctctctccgtctaacttataaggatacatgtgattgcatttagaacatgcgtggctaacccaggataagcaccttctctccagatgcttaatttaatcatgccttttgtcatataaggtaatagtcactcttttgccatatgagataacatttatccattctggagattcacaggttctggggattaagacagggactcatcttttccaggggctgccattcaactcactagacctgaatttaagttcttgttctttgactgcctttccatgattgggcaagttactgcatctctccaaaactagggtttctgctctgtaaaatgagaataataacgcctaatttacagggttataataagaaataaaagtggtaaatatatgtatttatatatatgtaaagttacctaacccagttcttagcataattagttgctgtagttccaggcattcaatagatagaacagattttaaactactttaaagactagtgtgaggctggcctatacttagttaagaatttgttaaagtttgatgatttggttgaaaaaatattctggagtgtgatggttaatccctctggagaaccctgactaatatactgagtaactacaaaatgattttatatttagttcaccattatacatagaatagccacaaaatggttttatattcagataaccattatttgttggccatgcctcatttaataatatttcctctgtctgctttccactgcttcataaccactagcacattttgaaacatattactatgtgatgtcaaattctttaaataataatgagttttagtttgagtaacaaaccagtgatgtctgtgatgtcacaggcctgaaaaaaaaactgttgcaatgatcttcattggctaaattaaaatataaagagtagtatagaatttatcatccacattttacagaattattgtttgagtcatttagggtttctattccagtctcttaattgaactgtactttctatatctgcaagtcaaaacactcatcaaaaaatatgacttcaaatatgatagccaacttttgtgttactacatagtgttaattttacagttttttatatgaaataactctctgagttaggagacaagtaaagaaatgttgccaacactcatagatatgaataacaacgtaatttaaggcatgttgcaaaacataaacttttaatatatccctctataaattcttacttttagtattcttaattctcagatattactccttttcatatgattgcatttatattcttgtttaattctctcttttttctacttatatgatttcctccccactgacttctgctcctccttcctgcttatagaaagaatgttgacctcaaatgtctattattttttcattcaatgaactacagtaaagttgatgtgtaggtgacaattagtgtaggcaaaaggtagagtaatgttgctttccaggtatcttccaactctaatattctgtggacttatatacttgagagtattcattctgcgtgtaagatctcacacttctatagctgatacattataatctgcctatgtctctttttatctgatctatagaaaaaatattattttcatatcttcatatgtttttgggttaccttaggctattaaaagaaaaataatgaagatgttaagatatttcaggacagtatgagtatgttggggtgtgtgtgtgtgtgtgtgtgtgtgtgtgtgtatgtgtgtgtataaaagattttactttttactcagccaacgctttagagatcttctgagtttccaagtaaatttatttgcttaagatgtgtctgtttgctttcatacagccattccacatcttccaagaaatgacttcaagaacatctgcttcagtactcataaacatcctatctgctcatcattttcattcttttacaacactcccactttcaaatcacatccaaaatggcaaaaagaacccaaagctaacatgattttagatgtcaattgtgtcctctctgtgaatgttttccatatttgaaatggctgtggaattatcttgcctctacccacagtaattgagaatgacaggaattggaaaagggtcatttcctctgtctcctgggattctgaaagctgtgttttcttttatacctgatcaggtctgccagttgcaaagctatacaatgtagtggagaactgcatacggttaattatgacaattacaatcagttctttacaatctctgctgctgttatgggatttaaataccataatgtatgtcaaaaggacaaaataatgttcctatgttttctgcttacagctgcttttatgattgggttttgctcataaacaggtggttataaagttgcaatccttccatgaattcctttatctttcctgtctcctaacctggcttccctggtgtgtcattgaacacaagtgttgagattcctagcatctctgaggtgatctcagatcctagacagtgtcccttgaatatgctgcaataaaaatgaaaccacttatggtcagcagaagtaggtagatgaatttagttaattctcaaagtctcccttgctacttcagacctctgtggtttgccttcccactgcgtcctgcaccttctctctattttctacctttgcttaatccctactttttcaattttatctcagtgaaacactgtgcctagtttcttctcaccattttggtctccagctcatagcatgttgtgaagactattgcatgcggacttgaatttatgtgctgttgatacttgggtacttgtctctgatgttacaagttaatccatacagtgcacatgtggtccctcactgttgctcaaggcagctggaaaataggtaaggtaatctttttctttcagcacaccttccgtctctgcagctcttacctctacctgaaaggtaggtataaagagaattatggccaatgaaactccatatgagagccctcccctcctccccagagtatatcttgcttaaacaacacatttacggttaatgaccatctggtaaaggtgacagcctttagtcctcctaattcttaactgtctgaaaaaatgtgcccaacctgccacggcttgtgactgaattataaaccatgaagcataataaagtcattaagtttcaacatgtcaaaatggactcaaattgcatcttgcccagaatttgatggcctttccccagcacttaagagagcagggctgtgtactgttcaaaaagcactttgtcatttctcgaagtactcttagctttgtgtggctgtctggacacaagcatcagcatctccaggagaaggaggaaatcgagtgaagtgagagcatggaggggccagtatgccacttcctagggaaaggcaaaggcatttcttctcaggaaaagagcagagaatgatgctgtacctcatttggttattgctcaccctcctgaatatatgattcattttacagtgggaaaattttggataaaagcttgtgctttacaattccgattacccttccccttttatcccccactatcaaaaataatcatattctataaacgtcagtggaaagtggtgagagtgcaactacgttttggagaaccaggtgtcagctctgtcagatttctatgaataggcacatctatatacactttttcaaagaaagaaaggtcactcgccaccctacttgtaaaactgtcagaggatttaggaaagaactaagttaggctgtcttttcacatgggaaaggaaatctggttctcaagatatttggggcattgcagtgaataagggatattaatagaattccacccccggcctctggctaagaacttatctgcctagaatctgaggaggaaaggaatctaagagttacccaaggctcagtctcactgcaataggaggggataacactgaacatggtggggcagatgtgggctttggtatctgttgctagtttatcctcccttcacccaccagcgcagtactgccatttcttctttcccctggaattctctatgtttagtgagcgagtttaagaatggaggatgctcagggatcttcttctcttatatagagactgggataatttgagtgttccatgttctgacacaggtggcatggatgaaggggtgtcactgaagaagctttggcaaaagctgatttacctttccaaaggctctgtgtcaggtgctggataaccgttaaaagaaaggaaagcaagccctctggcggctggcatgcagaaatgcacctgctaagccaatgagccattacaggccgtgccttcagattagagaaggacatgtcaaattagttggagagttttagaatactttatttattccagcttgtacatgaagttatcgatgcatctgctactccaagcatgttcagatgaaataatagaagaaagtctttaaggtattaaggttcatcttctgaaattgttcaacacttcttaaactgcagcaggcccagttgggcactgatagcaacttaagttgtcattactttgtgggattcagatctcgagaatatttatttagtgagagggagccagcaatttgtttctgtaggcaaaaggagattacagaagagagaccccctttgttgctgaattgagtagctgggaggagttgctggaagtgatgaatttaccccaagccatgaaggatgggtaagattagaacagataaaggaaatgaaagtgaacgtttgaaatataggggccacgggagcaggagtgggtttgtttttgaagtcagtagcaagcaagagttgagagtcagtggtaagtaattatgcacagagaaaacttggcaaatagataagaaaaaatcacattaatatttaaagtggtttaatatcaattgaatcacaaggacatcttaggtattcattatgaagctagagacagtatagcctctggacttaaggagtgggtctgtattcaaatcgtagttctgacacttctgagagtcctcaggcaagttagttagcttctctttgaccatttttcccaatctgttcacttgggatgagaagataatgtatctttagactcagatacacaaacattatctaaatccaggatgtagaagttgagtgcaaggaaagtctcagttgtccccaggctgcatatcattcaactggtgagtttccagctgctggtgtgcacaaacagaagctgaaggaccaatggcaggagaattacaaggcaagtttatgaatcagatggatatttggaccagatgacacccaggggccctccaacctagaggtctggtagttctaaaaattccatgatgtcccacaagagctaactgagatgtggggataataatgacataagtttacatcttacgctaaaaatgttgtttaaatttagttcaaaatgttctgttctatgtgaaaaaaatactatcattttatttaatgcaacctatcactgaaatgactatctcaagctgtttctctctatctcgtggagggaaggagtggaattgggggtagggtgcagggtggaaagaaaggagaggtaatactgttacccagagccaacatgttgctcttcaaaggggcttcagaaaatagaacaaagattccagcctgaatgagaaaggaggtggagagtttgaggaacacaaagctttaagtggaatttaccccatctaattatttgcgaaggaaagggtggaaagaaatgttgacagcaaagatttcatggagaacaggaacaataagaccctgtgccagagcactgtattctttgatgtaccacatatggagaagggatatagaacttgagttcagcaaggtttaaaaggcaaaatgtaatcacttccctttaattaactcaaacaatgcacggcaggttatgttaatgtgcctgtagctgagatagaggcagtaggctgccactaatacctgagagagagacagagagagagagaggaagagggagagaaagagaaagagaaagagagaggctcctgtaatgccagagcaggaagggcctagaaaccttatagactaattttacagatgcgagaacaagcctagcaaaattacagaactcacccaaggttatatggtctctcagtgacaaagtgaccataatacctcaggcctttaccaagttagtattctctctaagacactgcatgacggagtccatagtgatttcaagttagcccaggggttaaaactaaccatagtacatttgaatacggattaacatttggtgtgtcctttgaacaaaaggttaaatagaaaggtaaaatgtagaaaggtatctacacgtattcacttcagtcaagctttacttttaaagttgctttagaatattcttattaaaaccagtggtgattttcatgcagctgttttaattaaaatgttgtatgttttttataaacaaagtgatgaaaatttctggttatagccttgtagaagactgagcagggaaaccatcagaattgcaagtggagcaaaaatgttataatttagatcatgtgaccgaaataccaccaccgctgggtagaatctgcttaaactgcagctttggatttttcaggggtaaacaaacctcttatgaaaaagaaagccatgcattaaaattataaaggcacatgaaatattacaggaaagaatgagaggaagtaaagaaaactaacattcttctgttttactgctttcagggaagagttttatgaacagtttccaaaagtgttcttaagcggttgtaggttttattttgctttacaatttgacagtattttaagattctgtatttattctctttttgagctgaattatgcaggactaaacagatatcttttgtaaaaccttttatttccctgacagttaggagaaatatgaagtaggaaattctttggtaattgttggaggttggtatagtgcagtagataatgtccctttactgaatttattatcaaaatacacaagtcagagggaaggagatcaaaatatagcttctatttggtgatatactggtaaatgtttaattttcttccttttagaagagaggagactgatttatagtgttgacatatttttacggtataaatactccctccctggtgaaattcaagatgccaatgggatgtcactgaacttgaaattgggcagaggttcatatatttggctcttgcaagccagtgcaaacagtcttgggacagcactgcctgagtgcatcactcgtaaaggctgtgttagagagtgtggcctagatctcatagattagcagacttgttttaatacatcacttcagaatcagtcaaccttcaaccacaggtcttttcttctttggatgcctgtaccggtaaaactttcagcaagaaggagcaaagcaaaaagtgtgcttaccacaggcaggctggcagccaggagagttagtcgtctcccagactctaccaatctgatgaattcacaatctgaatcaagctggggaggccaggcatgtcactcagatggaaggaaacaacgaaagtgagaaataaatgttaactcttagcagcatcagaattcagaatgattcttagaaaaatgttacagggtttgtgtcaacaagaaggtcagaggcagaactgtattttaaatatccaacattttggcatatagctattctagcaaaagcatctttgaggctgtcatgtggcaagaattgtggttatcagaaaaaaaaataggagtttttaggttacacttaaaatataaagaccttaatagacctttattttatagaaagatatggaagaataaatttatattcagttccttcaaattaaattattttttcaactgggtgtaactgaaataaatagggcagccatagtaattttacttaagcaacttcattgcctcagagagcagatgatgaactattttagtgaatatatgaaatgatatctggcaagagaaaaatacttgatcatctcacttccttctagttgatgttcaagagtccctgcatccagatttacagctctttgcttacacatccatcattgttaatatgccaataccctgacgaagcaagcctggtattggctgcatgagtcagtttttcctggtagagagtggtttattattcttgttgctgctgttgtagtattaacatctgacaatttgataattaacaatgattataaattagcttattactataatgacatgagtctaagtggacatttgatatagcttatttttgagtgtaaaaattctggttctaagtcaggtgtctggaagtgttttgttattatcaccgtgctagaagataaaatctgagttctgaatcaacctactttcttattctgttgcctgtgacattgaatctcatgttcatatgttcatgtgttttatgttcatatgtttttacatttgcttccctttgttagaatttctggttaggtgtgacccaaaactcttaagtcaggtggaggagcattttaggactggctctgccatttaacttaaataataagttattaagttattataacttaaataataagttaatgaatctttccaaatctgagctttctcatatataaaataagaatgctaatgcatctacctcctaggcaccagtaaagattaagtggaatcatgtatatagtgtgtaacacattttgtgtgtgtgtggttagtttctttttttttttttgagtttgttttaatttttagctttctcaaataagagaacatgtgaagtttgtctttctgtgcctggcttatttcacttaacataatgacccccagttccatccatattgatgcaaatgacagaatctcattcatttttatggctgaatagtactccattgtatacatgtatcatacggttttttttactattatactttaagttttagggtacacatgcacaacgtgcaggtttgttacatatgtatacatgtgccatgttggtgtgctgcacccattaactcatcatttacatgaggtatatctcctaatgctatccctcacctcttcccctaccccacaacaggccccggtgtgtgatgttccccttcctctgtccaagagttctcattgttcaattcctacctatgagtgagaacatgcggtgtttggttttttgtccttgtgatagtttactgagaatgatatcatacattctttattcattcatctgttgatggacacatagtttgcaggggtacatgtgcaggtttgttgcatagctaaatatgtgttatgggagtttgttgtcagattatttcatcacccaggtattaagcctagtacccattagttatacagtaatttcttaatacatattataacatttgttaattgtataagttaaaaattttattactataatatttgttaattttataaattttgtatgataaaatacgtgtattacattcaatgcatggctacaattagtccacgtttaaggactgactcactttctagaatttggcaatactatgtctctcaaagttttcctaatgaaataagctatttatctttccaacccacagctcttcaggttcacatctatttctttgctttctcactgccctgacttctacccttccctttttgtctccctagtacccaaagtcctcttccccactgcacctgccattcttctccaggtgaaagtctgatttaggaaaagtgtatgagaaactctcataataaagagtgcatttgtattcttaaagcattacagcagagctaaagcctaagagtataatttcaatattcaggctgtgggtaagagaggtatttgctcagccgtagattccttttgatgcctctgaaatcactgtcatatctgtaactatctattgtacagtccatatggcaacctttaattatacctgttggaataatccacttagccaaagtcaagcatcctctgattacgtgttctcttgttatttcctagttgtcatatatccttggcagctgtcatcagccgaatttggtgtttctaatttttagtagctgtcatcctgtcccaagtttctgtaacacatgcttcggccttgccaaacatgatttgctttaacagttagtcataattttttgggccttaccttggcgggctagtggtcacattttactgtaggtgatctttacaagtgacttcagctccctcttctagctttacctttttttttaattgcacaaaattctatgtagcatgtcaatcgataggcaaaaaaagatctgttagcctccattacccaagagtgggccatatttcagtggtaggtaaatttggtccaatagttatgtttgaaatgccaacaatgaataaattaaattaaaatttattgagcacctacagtgttatagttatttgcttgctaatttgattttaagtgtgtgtataagtatatgcatgtgtgtgagtgtgtataatagaggctattcttttcaaggtcatacagctactaagtggaaaagctatgaattaaatgaaaagtttcctggctaagaagtccttgctttgtcctcaaaataggtttttgctaagcctacattagttagaatgggaaatatatatagagatatatgggctgggcacggtggctcacacctgtaatcccagcaatttgggaggccaaggtgggtggatcacgaggtcaagaaatcgagaccatccagggaatattgtcactgaggtggagtaaattaagcgtatataaaaatacaggttgagtaaggttatgatagctactgagtaaggttatgatagctggccaacatggtgaaaccccgtctctactaaaaatacaaaaattagctgagtgtggtggcacacacctgtagtcccagctactcgggaggctggggcaggagaatcacttgaacctgggaggccgaggttgcagtgatccgagatcacgctgctgcactccagcttggggacagagcgagactgcatctcaaaaaaaaaaaaacatacaaaaaaggtatatatgactatagccctttttcttcataaggtttatagtcttcaacgatagagtgacttttatgtttttctaccagaagattcgaagttttgtagagacaaatgtttatgacattattactttggtaaagttcagtaaagcaaacaaacaagatgaaaacctgcctgctgagggttggttaatctcttctgaaaaaggtacactttggtataatgattcataaaaagcatgtggacactttacagctttacatttagaataaaacctgtaatcccaatgcctgttctatgtgttatacctgtgttttcctgaattatatgtctgtgtacctcctctttatacagtgtttcatctaaaagggtggcatttactgctagaatttgagatcatgaaaaggaatgattttagcacaaaaaaaactaaacctgttttctatcaaattctaagaacccagaggcaatgaatgctactgtcaaaaataatttgaagaaagtgtatctgacagtatttttcaaatttagctacaattttggttttactttggggtattgctccagtggagattcgttcatgattgtataccttcctagaatatacagatttttcttattaggcattctaaggagagcttgttactgacattctgcagaactttacagtcatagtatttcatctgtaatattatcttatagaatataaagattttcctgtaaaaatggaagtgtccccaagcctgtgtttctagtcatgtttcaatcactaagtagctttctgacctggtcaagccactttaccatctttctgggtcttctttcctcattggtaccaagaaagggtcagagtatttgaaccttaatgtctcttcttagttccaccatgttgctatgcacaaccctcatccactgcttatgactgctgtgtaaaacactccaacctcagtatgcctacaggcattccacaggaggtctatgaagcttttcacagttgcaaagtcatttttcccctttggaaactggacttcaataccattttggttcaacatgtgttttcttacactgataacaagaatgggggctcctaaaagcatagatgttctttatgacatcaacctcgaaaatgtaaaggatatattcaaaatataactcctctaaagtaagtaaccatttatccaaaaatttagagggtatattcaaaatataactccccaaaaataagtaaccatttataaagtaactaatgtaaatacttctggattctaaaatgtatattgggttcttgggaacttgaaatagcaattattttataaatcctttgtaatagtcaatagcaaagtaagatcattgatgtgtgtttactccttgttgtctcttcttatacgtttttccagaggatgaagttcagtacagtaataaagtaaaattaaaaaaaagctaatgtatttgtagacttctaaagtcttcaaatatttattctgccctgttgagtgtcttatggataggtaatattatctttaaaggtgatgctcaactttcatgctgttttatttgtttttttcttgagacagagtctcagtcattctgttgcccaggccggagtgcaatggtgtgatcttggctttctgcaacctctgcctcccaggttcaagtgattctcctgccttggcctcccgagtagctgggattacaggcgtgtgtcacaatgccaagctaatttttgtatttttgtagaaacatggtttcaccatgttggccaggctggcctcaaactcctcacctcaagtaatctgcctgcctcagcctcccaaagtgctgggattacaggcacgagacaccacacctggcctgtgctgtactatttatttttttatcccatggttacatatgttatgcaatgaaaatgttttcatgctacacatcaagtataaaactcttcaggccagactcctatacagattaagatggcatatatgaattgttttttttttctttctcccaaaggcataggttaggcatatttactgtctttgccaggccttttctcactttttaagacatccgaatgtgtagatttccttccttttcaacatttacattggaagatgaacatatttagaatgagccaaaagaaaaaatgctgcataaagcagtgttgaaggaagttattctggcagtcttagggttgaaattcgcaatccattacaagcatggaagctgtagagccttggatgaggctctacaaggattgggatttgtagaaatttgatgcgtccaaactctgtaattaccttaaagaaatccaagctttctgcaattaaaaatgtgtaattaaaaagtcatccagtgtgtgtgtgtttgtgtgtgcgtgtaatttatatccataaatatgcatctactatgtgaaacatctcttaagggatatgaatgtatgctgaaataattcagctagtgtaaagagggaaggaaaaaataatttatattactgggggaaggcagtcagatgaatataaatggggaagcaccatccccagcagagataataggttgagaaggagctataaatagggaaaatctgggtgtgtatggaaaaagtgacttcaacatatgattaattagaggtggtggggaaaacaatcaaagaaatatcaatgtgtagtaagtaaaaaatgtggaagggtggtgggtagaggagcaaagtatagtggaggttactgaatgcacagaaaaataattaaactcttaggttatacccttatccaagattctgaattagtttcttctactcagcttttccggggatggttagggcttctacagataggaagtagaatgctgtgaaaagaaggtacacttacgaaggaaagtttctgaaaataaaccagaaaactaatttgctaggggagttccctagtggcagagagtttacaccatgtgttgccctttctctctgcacttccaggaattccatctgcagaaggtgagtgacaggccggtggtgctggtaaagtctgtgctgaggcagtaggagagctgatgtcaatgacaaggcaacccttgactgcagccctgacacctgtctggggaatttagactttagtgacaatccttgacctgccatgcaaatctggagctataccattgaattattgcccgtgattgggtgtggaaatggagagctttgtgggccaggaagcaggcagtttgtaatgtgtggatttttagcccggcaagctagatgttctaccttcactagagtaattttaattcattctcttctgaagaaagaggtaaagatgaaggttgtctagggaggaggaatctcaatatttttcttcattaggacagttataatgttgagaccaaaaagatgtaagtaaaggtaattaacaaagggcaatctacttcctttggagcttataaattcctcaactacttagaaatgctactctgtctcaccctgacatttgatctttgtacttcagataggatttgacgtacgtttaagttctcagtggactcaggtttccggaggacttttttgttaactgctgattgaacctttattctgctccacatgattcctttgccagcttgtttgaagtgtttgttcctggtggaaccacaacaaatatgtgagctcattttctttctattaggtaaggtctttagagtttgggatttcaagtattcagtgtttcatgccttcagtgttcttttagaaatctgtatgtattcctacatttttcacaggcagtaatccagagaatctgatatggtttggctgtatcccccacccaaatctcacctcaaattgtaatccctgttatccctatgtgtcaagggcaggaccaggtggaggtaattaaatcacaggggggcggtttcccccatgctgttctcatcatagtgagttctcacaaaatctgatggttttataagtgtctggcatttcccctgtttgcaatcactttattctgccaccccatgaataaggtgcctgcttctcttttgccttccaccatgattgtaagtttcctgaggcctccccagccttgaggaactatgagtcaattaaacctctctcctttgtaaattacccagtcttgggtactccttcatagcggtgtgagaatggaccaacactggatcaaatctggcttatgtaaatctggaataaagagtaataaaaccaaccagatgctaataatatgacgccacctcttttctcccatccaagatgtgattctctagattttccagtctgatgatgttgtggagctcgcagttgacctgtatcttcttgatataagttccatgtggttgagcttggcgtttataacagaacagcaaaaaatgggatccctttcatcagaattcccctctttgcccccacactttgtagcaattccctgtttgccactttcaactctttgttgatctaattattggtatgtctacccaagaaaatcttaagcttatttggggactgtggtcttgttatatatatcatctcccgagatactagaatagcttaagtacccaattattattcagtaagtgcctgtttactgttggactttcttgaaaattcatatagaataccttcattttcttcacactttggtctgtaaacagtgtggaagtagtgaagaagacacaaagtcactttagacatgtttattactctcacttttatcctctcccctccatcagtgaagactcctacttgccatctttcctctaaagatccttagtccctgagaagcaagagctactgaagattatatcctaataagtttctaaaactcaaaagttttggtaggaaagaacatgtaggcttaattcctttctctttgacagtttggcccaattggatgctcaggtgtaatatgctattattagccctgagatgaaaatttcagggccaaaattattagtaaaacacttaacatttattaaatttttacagagtatttaatgtgtaaatatttactgcactgggtaccttatatgcattgttacatttaattctcattataatgatttattagctattacataggtatttttactatcatccttatctatacggagagtgaggcttgatgggatcaagtaatttgccagtgtctactagctcttagatagtaaattcagcattcaagttcatgcttaaattctaccctctatgccctccatcttatataaaccttaactccaggaaaaacttacctgtcttgtactaactgtcatatatttggtaggagaggcaaggagacatttttctaatcacattctttcagtatgtgttgggataaatttcaggggttggaatttccatcaagtgcacatgtacacctcttagaattgtcactttaggttatgacaactaggatgcattttttaaataaaagaagtgtattttgtatatgtattatatactgtattcttacaataaagtgagctaaagaaaagaaaatgttattaagaaaatattaggaaatattaagaaaatgttattaagaaagagaaaatatatttactattattacctgaaagtggatcatcataaaggtcttcatcatcattgtcttcatgttgagcaggttgaggaggaggaagagagaagttagtcttgctgtctcaggcatggcagaggtggaagatatggaggaggtggaaggagaggcgaaggaggcagtatattcagtgtgagctttattgaaaaaaatacacatatgagtggacctacacagctcaaatgcatgttattcaggggtcgactgtaccttgataataacatcactgccattaccgtattctgagttggtggtataaatggcatttttctaggtgatcgttatatatgtgtatcatgtatattaccaggtatagtcctgtaatagttccacctttctgcataaaagtcttcacaaagctaaactgagagttatagtaactgtaattatggaaggtaatcacaacaggaaatatgttatatgaaatacaacttttacaagttgttttacagtttgtgttatatgaaataacaattataggctttgttattctgaacattaatttgcattagccaaacaggagattcattttaggaatatttgtatctgtctactctttctattatctatatataccaataaacattgacaaacatttaagcattagaatttttgtctcaattgaatgaagctttcaaagatgctttttcttttttcttggaatcctgttgaatttccttgaaaaataaataagagttcacaccttctcagagtttcctctgaggtgttttgatactgttaacatgagcatcaaagtaataccaactcttaaaacacacataattacttaactatcagtgtatttctaagaaccctgtcatatgcacccttcttattttatgctcatgttgtaaatagacatacatgatgctgtgctgtcatagagaaaccatccatgttcactgcttaaagaagtgagtgtgagtttgagtgtgagtctgtgatgtatgtttagtctgtaataacaattctattaattcaatactgttttaaacatgcactcacatcctgtcatcagtaaaaccaagtgtcagttatccacacaattaatcaagttctcactcaggctttctagtaattcaactagtttcccatttccttatttcttctaggtgacatagttgcttctccatctgtaaagccagtataggatattttaattatttagttagcaatgtttttattaggcactcttttaggcactgacgatattaaagtgaacaagacagataagtccctgtttccatgtgaactagagtttacattccagttgtactagtaaacaactaaaacctctacataaggcagtttaatattgaagaatgtcctgaggaatatgaatcagaacaatgtggtagtggtgtggtatacacatactatttacttagggagacctttctagttggtgacttgaacttacacatgaatgagaagtagctagtcacaagaatatctataacaagattgttataaatagcaaagatagatagatagatagatagataaatagatagatagatggaaaaagccctaaagtatgaatgagcttggcagatttgaaaaatagattgactagtagagagtggatatttgcgaagatttattactaatgatagatctttaaatatccacatagctttaagggagcagtaaatttagcttaaggttagtaaaatgttcagtaccagcaggatatccctataagattttttaggattacagaacttggataaatggtaaattggatcaacatcatgccaattaaatttgttgtatggtctgttttattaaatctctaattcgtatttatataatgtataattataacttgctgcttatacagaatggttacccgtttagtattttatctgttcaacaaccatttactaatgtcctatcatatgcaagatagagtactaggggctgagtatacaaaaataaataagaccactctgtcatgaaaacatgtacaaaaaagtagataacacaggatttaaatatatttagtgggaaatatgttttctcagtttaaacatataaaaattataaagtggaatttcagatgagagtggcattgatagatataagtaggcatagctgatgcagagaatgttaaaatataattttgcaggtctgaaaaaccatttgacatttccttgtaattctggattaatgcttatatgattatctctgccacagtggaaaagtttataaatttaaattaatggaaattgctgttgatgaaaccctctagaggataatacatttctgatatgcctatagggctccgtatttaagctaaactcctgcccaagatgcaggatgatgaagtcctttatttcggccatcagacctattaaaaccacgagtatccctgtgagtccacaagtcaggctacaatacaacatcctcaatctgacaagaaaatcaactgatttactgaatttatatgaaccaattcttatatgcatgacagccaaaaaagttccaaaaagaaaacaaattttgcattagtatgagattttgaggttaggagcctacgtttagaggtttatcagttcagcccccgtatggagctatccagggtgctgaacgtgctctgcaactcagtccccttagtctctgggcttgacctattttttccattgttgtttcttatcttcaccttttattccctacccatactgcctgctctgattgctctttgtatgatctcatcaatcatatgtgacagatttttgtcccgacccttgctatgccctacattctaacctagtacattcttcaacccatgtttagccaaatttcaattaaaatttatacctacagccttcccaacaagtgccttgactctcaattttgtttcttgaagcaatgagatcattgatttgatctctaattataaagtaattaaaaacaattttatttcagtccacaaatacataaatattctaaaaaggagcctttaattcatttaataatccataaaaataaactgaaaaatcaagcgtggacttctttgtcactttcctctttttcattgtgaccttctctctcctcccacttctccttcctcctcatcatcattataaattcaatgagtcagaatggtttaattgaaattcttcatttaaaaagtaggatcttggtaaaatgtaggttcaaagacaattttacaatagtttaaccttagtagatgaaaaatagtaaaagtataaacaactcctgtgaacatattgtctttgaaattggtaaaataaataaaattgagatcacttcttactgtacatctccagcttattttaggatgtatctcttcctttctgactggaagactcaaaatacatttagagagttggagctggtgttgacagtcaatgattagggcaaaagttttgcatgtacttcacctctgtatttctccctaatttcatccattgtaatttaagaagaaggacatgcctgaattgaaaagttcaacaagtgaacttttgaataaacagtgtagatttttatcttaggtccaccaatccctaaccatgtaatcttgggtaaatctttaactctatggatctatattttttaaatttgcaaattgagaataataaaacatcctcacactgaagattcctgccagaattatatgagataatgcatatccaaagtttagggcagaaactgaaacctagccaacattttaaaaatgtgaattattgtcattaacttatcctttcggtgcttcacctctccatacattttaagatactctggtcattatgagtacttgccacaagtatataggagataaaagatttattttcccacccattattaggttcatagctgaggtatcctgtaataagagacagattaacaggaaaaaaagcatacaaattaatataatttttatgtgacattggagcctttgaagggaagacccaaagaaacagggaatcctgtgtattttagactttggtttcataaagagtggacagtcttggggaagtatggctggacaaaagtgggcatggcctgatggtaataagctgggggaaacttagcaaggcctattgttcagattcttcctggtgtctctgtgtgttcagctgctttcctctagttctagagagaatacctctgaatgaaggtctttatgatttgctttagatgaaagtcagaggattattttatggtctgcttcaggggagaagagtgagagaaagtcaaagagatctttctgcttctgctgctttctcaaatgccaagttgctgtattttggggtagtatgtcctgaaccccatcaggtacttgacatttcatgaaggtaagctgatcaatctttcatccatggcactcattaatgtctcaatttgaaatgttgtgagctatgaaaaaaagacaaggaaggtagtgcttatctactcatgaacaaccattattaactcactattaatcattgattacaattgatctattggccatggtattgttgtgaactttgaaatatattgtattaacatttctatgaaaatggtggttgaaattctgcaggcagataatgcagtgttaacataataagtaaaataattaatgatagtgaagttgtaaaagtaagaaggttcaatgtgcttgaaagtcacagaattttgaaaaatgcaagagataaggaaaactgatgaacaaaatgtgacaacttgagactggctatgcatactgaaatgaaccagtgacttttaaactagaattcttagagtgtacagcctacagaaatgtaaatatggctaatacaggtaactttctaatttaaatacctatcaaagcttctgttggaagaaaactagatttatacattgtgacatgctcaaaatccttgtcttctccaacaccatctccagtaaaatactcctagcataaaatttattaaagtgaatatctctgaaattaggttcttttggaattaaacaaaagagaccatggttttccaggcattgttgtagatgtcactttataataagacagataaggcagtcagtatacagaggtttggttttatggccagaactaacatttattcaatcaatgagagagatcaattagagcagcattacttctacagtgggaaaatttcagagcccctgaaatagaacattattgttaaattatcaaatatgttacagttgttgctagtataatgaccctttctctttatcagaatcagggaagaaaaaagccaaatggtgactaatttatcaccaggttcataactaagttaccaaaagactgaaactaatcaggtctgattttcaaaataagcaataacatttaaagcatatttgaatatacagatgtttggatcactgatatcctaagaattctatagtctctgctgattttaaagtcgagattagattgttcttgtatacccagagaagcatagctctaaagggaaggtgttctggggaaagaaaagaaaaaaatgacgttttcatcatcacactgaaaaagtgccaacaaatcctaagtaattttgtgttgattatactaaattagaatagtgatggctataatcatttgatccctgaggcattaatgaaaaatcagcattattttgtgtggaatatgtattattatccttgagcttaggaatgattattagtaagtctgattaaatctggaagcagtgacacaagctatctttaacccaccaatgacagggctatattgtaaatttatgatgaatgaacacagtttagcatttttagcacttgttggggaaaataagaagtctgcattcattttcttgattagactgcaaagtagtacagagaagctcataaaaaattcttcataatgaaatagtgttcctactgatagattaacctatcatagcttccaaaattcacaggactggttatccttgtatgatcaaagatattattcagcaacattctggagatcatgaattcctagatacagaagtataaacaataaaaatactaccatgttgcatgcatgtattaccttcatctttttttttttttttttttttgagatggagtcttgctttgttgcccaggctggagtacagtggcacggtctcggctcgttgtaacctccgcctcccaggttcaagcgattctcctgcttcagcctcccaagcagctgagactacaggcacacaccaccatgcccggctaattttttgtatttttagtagagatggggtttcaccatgttggccaggatggtctcgatctcttgaccttgtgatccacctgcctcagcctctcaaagtcctgggattacaggcgtgggccaccgcacctggcagtattacccttatatttttaaatgctttcacatttactttatggtattcttatcatagtaacttaagtgagttagactttttaccacctgctctatcagtaagaaaactgtagcacaatccagtggaggtatttgctaaaatcacacaggttgtcagaaataccagtattggaaccccagggtcttggtttcaagtctaatatattttctgggcctcagtttagccattaattttataattacagacaatgtttttgctaacatcttgaattctttctttttaaaaagatgtctattctgtattcatagaaaatattagagattcttactgatcaaatggatcacagcaattgtttaattttaattttcagtgctaggtaatggagctcagaacacactgactcaaaatttggcatttgaggaatcagcagaaggaggccgtagaaacttgaaaggaatctacttgccccttcttccctgaagcagtcatgaaagctaactgaattttcccagaaaataggtcataagactattatatcagaggcgttcttcctgtacctggaggaaaagaatgtccttatctctgaaaacatagggacactgaaaagaatctgaacaagtaggccttgccgtgttacccccagtttattaacattagattgtactcttttgtcctccaattatacttccatgcacgactgtccactctttatcaaacctaagcataaaaatacccagatttccctgtgtcttcgggccttcatttctgaaggctcctgtgtataagttttatataaataaatatatgcttctttatgaatgaatataaattttacttaatataaatttatgtaaatttaatatttttataattataaaattacaaaaatgattgtaattttaaatcatatataaatttattataaatttatatataaattttaatataaaatatacttaattttacttaatataaatttacttaatataaattattaagtaaatttgttttctcttataaatctgtctttattacaggagccttatccaggaaccttgtgatgtatgagtaatctttctcccctgtataggcaaaattgtttctaaaatccccatataatttagggcaagttctgatccttgcatagtagcatctgacactcagtagtaacttgattaaatattagttccttttttcctaattcccaccccaaatgctgtgaccctctctgcactcaaaagacaaaatctttaaaattcttagttgatctgaaatttgtgttgatggcctacattattttattgttaaaactatgattacaggtgactagtcagtaacaaaacataaaaattgtgaaagtacagccaaaccctgttttaaatgctagatggagttagtgttttgtttccatcaaagccacaatatttctacttgaaacataggccagggcagtggctcacgtctgtaatctcagcactttgggaggccgaggtgggtggatcacctgaggtcaggagtttgagaccagcctgaccaacatggagaaaccccatctctactaaaaatacaaaaaattagccaggcatgttggtgcatgcctgtaatcccagctactcaggagcctaaggcaggagaatcacttgaacctgggaggaggaggttgtggtgagccgagattgcaccattgcactccagccagggcaaaaaaagcgaaactccatctcaaaaaaataaaataaaataaaataaaataaaaaagaaacatagctttgcaactgaatggcatcccattcacttagcatcataatggaattctgttgaatagcttaaatttagggcaatcagagccaaagactcagttacggagtaactgtaggtcccgcttggcatgtgacagattagattccttggagaagttaaatccagaaatgagtcattttaataaagcaaaacacataatataaagggtatggataagaagctatgaaaatgcctaggatagacaaaaagaaagatatcctgggatagggaaagggacatttgaacatcaaattaagcaaagccatgaagtttggaatttttcttggcattttcttcccgtaccctgcaaatattaaatcaattgtcaatcaattgtcaattttacctttaaccatttctcttcttcatgtctttctccacacgatcactgatctagggtgagctcttactatctttacttataataggctagtttattcgctatttctatttccaggcatatcactctcaaaaccatcatccagattatttaaaaccttaaatctaatcacatctcccacttgcttgaaaccattcaaagtcttctagttgcctacaagataagatctaaacttatgtttctctgtggtctggcttctccttacctgtgccacctcctctcatgatgagccattctgtgatggtgcttcagcctgtaaaattgtttgtggtttcaaaaatattgcacttcatttcatgcctccataccttttcctcttcttgtaatgccttttcatattcatctccaacagggtaagttctgcacataattcagtgtcccttttccagtttgatgttgcagctcttccttcatctcaaatatccactggattaggtacatctgtgtgtacttcatcttatccatcctgttaaagaaaaaattatagaaggacaattgttaaagcatggtagggaaagttttatttaggaccatcatgataaatatatgggccactgcaatggaattgtttgcagtgtaggagagagaatgggctcaactctgtatatagcatgaacaagtgagaatttttaaccaaggaacagagtagaggtcagcagacagacaatgactaagaggtaacatcaggagtaatgggaattctggctaaactgacctaacagaattcttgctgaagacaaaccaatgtgatcaggtatcacctgggagttggtggagaatgaagaacttaatcaggtatcaagagtaatcagatatctaaagtggggcagttcttactaaactgacttagcacacttcttgctaaaaccagattttacaaggaagtgcacagatgagcctaggagaaggtagaggggtctgactaaagttttgatcaagtaaaaaagtctttatcaatcttggtatttcccgttaagcacaatgcttggaacataatagttgctcaacaaatgttggctgatctgattataagaataacatggatagatcatcctttgtaatctataagttttttaaaagtttatttttaattattatgaatacattccagttgtacatatttatggggtatatgtgatattttgatacaaacctgccatgtgtaatgatcaaatcagggtaattggggtatccatcacctcaagcatttatcattttttttgtgttaggaacattatacttctgctcttttagttattttgaaatatacaaataaattattgttaactgttattaccctgtaggtgttactgaacgctagatcttattccttctatctaactgtgttttcgtgccttttaacaatccccctttttatgttcccctcccccactacccatcccagtctctggtagccatcattctactctccatctccatgagttcaatattatttttagctcccacatattattgagagtatgcaatatttgtatttctgtgcctggcttacttcttaacataatgtgcttcattccattatttcttaacataatatgctttaattccatctacgttgttccaaatgacaggatttcagtttcttagtagctgaataatatttcattttgtatatgtactttattttctttatccattcatctactgatggattcttgggttgatttcatatcttgtctattgtaaatagtgctgtaataaacatgggagtgcagatatctctttgatatactgatttcctttcttttggatatatacccagaagtggcattactagatcatatggtagttctatttttagttttctgaggaatactccgtgctgttctctatagtggctgtactaatttattcccaccagcacactagagttcctctttttccgtatcctcatcagcattcattattgcctgtcttttggataaaagccattttaactggggtgagatgacgtcttatcgtagttttgatttgcatttctctgatgacaatctacaagttaatatgtctgaaaatctctcagtcatcctatcatgtttctactcttcaatgggaaaaattaatttatcaagccagattgtcatcttttcttaaaaaattacatgatatgaaattcacagctttcctattcaagtgagtttttcttatgtccagctagaatcccctttgggttaatataagtctttagtgtacgaatttgaatctttgcctgaggtgctacactgttggttctcttaaaaatttgtggcattatttaattcagtaaaatttgtgtggattgatttgtatcctttgaatagttagtattatataaatatctcagtctataagactcatccaaaactttggaattggaagtccaatctcctctccattagaagtcttgtcttggacatccagtctctatttaatccaatgatatgctccctgatttatctactcagactttttattgttagttaggtttattctttattttaaactgagatccgtcatcacaaaagccattcccatttacctgttgtcctttggctgtattgccctggttatatattactgggttttgctaaatgtttcctatcttttctttcaagttaaatctttatgtctctgttagattatcacatataaatgtgtaaaaacatagatattcctgcaaagcttacaaggaaacaataaaacagaaaagacttgatctaactcctccccacctcaatccagagctattactttcactcttttagttgtttcttctgattttacttccatatttccaaacaatgtggttatggtgctatttttattttgatgtctttacattcaatacatcaatgttgattttaggttttattttataaatatcctcaattttatcttccaattcttttgttgaataaatctttgctaataaatatgtatatacatatatttattatatatgtatatatatttacatataaataaatatatatacatattttaatatatatattttattttctaagggctttatgttgtattatttcttattttgatagcattcagattgcagtttttaaaagatacaaatcatttcttttatcatattaatgatgaggcttttaaaatcagttttctattctctgcattgtatctcttttttattccattttctttctttcttttctcctatgtaccttagtctcttgtttcatatttctattagagcctatcctacattgtctagttaatcttggctgtttgttgtcacttaataataaaactctaacaaaccattagaaactgtataattatagcaattttcaaaattattattagtgggtgaaattcactaaatctaaataggtggggatctacccattttattaagagaccaccctccaaaatgtcagatcttttctctcaagtcatttttttttagtaattcagtttctgaagtcttagttttctctctgtgcgttttctgcatttaggtggatagcatcttcataacagaggagaaaagggagtctgttaggcagattggtctcaggggtcagtatataaatttacacataatcctactatttttcttataacttcgcactgctgtcacagcctgagcctcttcaagtcagattccaatgctcttcttaaacagattctctgagtgtgtttgctgatttttgctgcagtggagagggtatttctcagttgatgtgatccttatataggcttttagtcactccatctgttttcagccccactgctggctctgccttcagaaatatgtgatgcctccaagttctctaactttatagggttctacagcaaaatatccttgtttactactggcttctttctctgtaaaaacttagctttccacttttttctgtcctactgtcaattaccacacatctatacacttttcatcttccaaatcttgttgacatttctcctctgctattgtcttttcatccagtctcttttgctactgcgaactatacagcctttatttttttcacaaccattttagtaggattttgaaagaaaatacagatagaaagcttgtgtttagtccaccatacttagtgagaagttgccataacatttttgaagattgaatgtacagtatggaatatgttcattatctcagtaccatgtttgggctcataaaaataaaaatagcagacatgagtgtggcctttattcatttgttcaacaggcttttactgcttgcctatcatgggaatggcaagaaacatcatttcagttaactgaaaggacaaatacaatattcttagtgatctccttccttcagttccccacaggaaatttgaggttgataaaacagcagcaaaagcatatttttagaagataaagagatggttcgtatgatgtacagaagtctacttgctactcaaagtgtgatcagtggtctagcagcatgcatccctgggagcttattggaagtacagattcttagtctcctctctgacctactggaacacaatctacgttttaatgaggtccccagggtagtcttaaaattggtccaagggaaaggattttattagaaaaaaagtgaaccttcttttatcccacctagggttaatgcataggaattttatctgtagtcaagatcataggcaccatgtgaagtgattttcttttctttctttttttttttttttgagacaatgtctcactgtgacccaggctgaagtgcagtggcacgatctcagctcactgcaacctctgcctcccaggttcaagtggttctcctgcctcagcctcgtgagtagctgggattacaggaatgcaccaccatgtccggctaatttttgtatttttagtagagataggatatcaccatgttggccaggctggtcttgaactcttgacctcaagtgatccacttgccttggactcccgaagttctgggattacaggcgtgagccactgtgcctggcatgaagtgattttcaaacatagttgatcataagaaccttgaaggggattatttgtttaaatgtagattcttctttcttttacattgtcgtaagtaatgtaatcaatgtggaatagggctgtaaacctattttaagggcttctgagatgctaatcagtcagatttgggaactatcagggaaaattttcaacccttttcatcatgatgtctcagggaccaaatatcttccatttgctacccaccacttcctgcaactcctaccagccatcactacagatgtatcatatcagatcctattttcttcatctttgccttctcctcaaatcatgtatagtcttgagactcatctgttcagttggcagagtgtcttccttctcccaagacaacatcctcgttttcatttttcccattcactctgtgccactgcttacctccatgcccaaatctccagctctctctttgctggcaggtgtcatgttctgacactgatttggggtcaagtctggggttctgaatcaggagcctgtgtttgatggggagtagatgccagaaggcattgacaagtggcaccatgcaggcgaataatgcaagaagagtcaccttgtgggaaaattgatgcctgataatctgtcccaccagggtgtcaagtccgagagtgagaatccatcaattaaactgtgggacggactttagagaggacagacttgagcacaggggtgtggagaattggttatggaagaaattcccaagcgaaatgaatatagttggaggaaatgtgaagagggtggggagtttcctgggcctctgctggaagagcagaatgtaagagttgagaatgttaaaccagcttgcataacgttttgctgaacagtttaattcagaagccaattgagatatctgttattcctgacaaactttaaaaggttctagaactggcaaaacaactaggtctgagcaaagtgaaaagacatagtgtgaccagctgggacaggaacgctgcaaacttgctaattagtctggaggaagccaattgcccacatttttatgtactgctaattactaaagtagcagcttgctataaagacaaaaataacagcatgatagtttcttgaatataggataaagtggcctttgggatgtaggctccatcaactttaaaaatattctgtagtttttaaacttaaagcatacagtgccgtaataaaaatacactttggaagtcagttattcacttttttccataggctgttagatgagaaattatagaatatatggtaccctgttgggaatttatactaaaggattttgttttaaagataccaactctccatttgaataccatttctcagctcattttaaacatttacccaattaaaaaagctaaataagtgattttaaaatgtgttttattttaaatacacagtgtttttttctgaaaatgctttctcaacccagttatatctgtgaaaagagaatgtcctttaggaatttaccaacttttcacgcagttgtagcattcattgtgggtgttcagtaaatatttgcagaaagaatgagtgaatgagcaaaggaataaatacacaaaaccttgtgtgcatgagaacgataggatttcacacttctaaggaacaactgagaacaactactccccttgtattcttttgaggatgaggaaatttaggcagaggacaagtaactcctctggggcctcacagctggttaggggcaaaactgggtctgggccccatttcttatgtctatcagcccagcagtcttttcattttaagcttatttgtattccctttaagagaataatgagttatttctgcagggctaattctgacctgaatcatattaaatcagcaaagcctggttttcttacactttcaaatgcagaatgacaaaagtaaagcatcttttaaaacaaaacaaagccaaagcaattggagtatttggttttattgaggagtgatgttttcaaaggcagagaagggagaaaaatggaaactctgtgccatggacttaacttgaaagctaaatgtcagacttgatgtaaaggaggaaaaccagccctgaggacctataactgcataaaagaaaaaaagcagatttctattgattgcagcaaatcaatagaagttcatgtatttgcggatttatttattgcttgcattggtcactgaaacctctaattagattcatagtgtacttagtgtattgtaattatatgtggcagagcacgtttgatgaaggtggatataagtagatgaatatttagacccagcaataccactaatgactcacatgccaggtaacatttctttacttgtaggacttattaagaagtggctgtgaattgtcttcttaattaaaggtttggttacatgaccaaagagttgttaataatggtgcagtcacttatcaaatgtgtgatcccacctaacttatttataattctgaacctagtgtttctcatatgtacagataggttcctaatgacacttaccacatggggttgttgtgaggattaaataagagcatgcaagtaaggttttacatagtgcattccacataaaaagcactcaataaatgttagctattattactgttttcagtcactccaggcgagctatattgtaaaaaaccatacttccattgcttcttcactagagcctagcaaatcattgttttctactggtctactatttgtggatatttctaccccaagatcctttcccaagaggacaatgcaatatagttgaaagattcttcttcacttggtgttcagaatatttcattcaaattcaacattcacaagtgcaatttgtactcgatattgtagactttccagaaaggtgaggttcattcattcaattgcttcttggctgagcaaatttatattctcttaaatcttgataagtcagttaatcttctctaaaattgaggaagttatactcattccactggggtgctatgaggatcggatgaaggtatatagcaaaagtgcttatttgtaaacatcatgttgttgaatgaatattggttattgatattttctgaaggtccccattccatgcctttttcagggccccgtgtaaagccatcccttctctgaagctttccctgacttctctaccttccatctagatgtcaactctcctccttttcactctcactccatttcagttgatcttccttggaattcaaaatacatactgccttgtagagcagtgatttgtatttatttcattccttcttctacactttcagaaggaagtgtctacatctcattgacctcattgtcccacacagtgcataacacagtatcttgcctgtaataatgctcaacaaatatttgattaatgaatagacaggcttttatgaatccatgtgtaatgttaagttctatgaattatgtagaaatagtaaaagcaaataaagactcaattacaattttaactcttcaacaagatgatcaaatccttgaggattagaaattaattaaaaatgaactcatcctttattcattcatcccattatttaataaataaacataaatcgagcaccttccaggtgccagatactatgttggattcgaggaatttaatgcaattaaaataaatagtttcatcccatagaggttgcagtttgtaagtaataagaaataaggaaataattccaaacttgcttttgcaggatgaatatttagaactttctttattaaaagaggtcagtaaaacattcttaactgctttttctatccattattaattccaataatttggtcactgttcattagtgagattaaatttggctactgagagtaggtcatgcaaatcatctttctggttaaaaaaaggcctgtagctactgggtgaaatttgctttgaattatttttcataatcacaagtaattgggcatgtcgtactcagttataaataaatatacaaaagtacactgatctactttccttaataatgagtttgaaaaccatcgctatgttacttaaacttacttttcttcactatttaaaaagtccagagggcacaagtaaccttcagagaatctttccacattacaaggcaaaattatttaataaaatttctgaacatacattttaattgaaaagtcataagcaattctacactgatggggaaccagccaatgtgatgcaaaatgaatttctcagtaactgttttgtgtgtaggtaattttaagtgaaagaaattttttttctattgtacaaaccaagactaatttattcattgttgttccaaagcagcagaagccaccagaatgtcacattttatttttaattcacaaaattaaatatacttatggtgtacaatattgagttttgaaatatgtatacactagaatagtggactcaagctaacatatgtattacctcaaatactgatttttttgttgtgagaacaattaaactctctctttgcaattttcaagtataaaatacattgttattaactgtagtcattatattgtacaatggatttcttgaacttattgttccatctaactggaattttgtaccctttggtcaaacatctctctaatcccacccgcctacaccacctcagcacctggtaaccaccattctactctctcctgctatgagtttgttttttttttagatttcatatataagcgaggtcgtgcagtatttgtcttcctgagcatggcttattttacttaacataatatcctcaagatttgtccatgttgttacaaattaggagatttttatctttttaaaggctcaataatattggttgtgtacatataccatgttttctttttccatttccatttatgtgtcgatgaacacttaggttgattccgtatgtttagccaaggtgaataatgctgcagtgaatgttggactgcagatatctctttgtcattctgaattcttttcctttggatatataccctgtatcaggatcactggatcgtatggtaattctattttaattttttgaggaacttccatactatttttcataatggctacatgatatatccccaacagcagtataccagggttcccttttctctacatccttgctaatacttatcttttatctttatgataacaactaatctatagtaatagctaatctatagctaggtataaggtgatatttcgttgtggttttaatttgcatttccctgataattagtgatgttgaacattttttaatgtacttgttagccgtctgtatgtctccctgtaggaaatgtctatttagatcctttgcttattttttaattgggttatttgtttacttgctatgaagttgtttgaattctttatatattttagatattaaccccttatcatagaatgacgcattttaagacaaggaatgaatcttgtgaaagcttaattccctgtcctaattcctcaccctttacacctccttgcactagacacactcatttacaaactctatacttctactgtattcctatgactggagggtgtttatgagaaaagcaggtgagccttagagtaccagtatatcaatttttttccacagtaggttaagggattcatggagggaccccccctgccccccaaattgatttgccttttgcattagtcaaggttctggcaggaaaactggtgacactctcaaatgggggtaataatataagaattgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaagaattgacccatttacaatagtataggcagggtaagtctgttgtcagggaagccaataaaggatggagaagcacctttttacccattacctctcttaggcttgaagggggaaagggagtgaatatttattggaacaaagagccagagatgtggctgtaactgggagagggcctcccaataggatctgaaaagttcagtagtgaaatgcaagcactgcaacccgaggcctggcagggaggagaccaaagaaactgatatcccaatctcacttttcccactccctggctttctgccaatgactcccatttgatgcagtccagaaagatgggcttcctagagagcagagtagggtggaaaatggattcagagggccatgaagagtatcagagtatcaagaatacctgttacattataaggaatatatatgtatatatgtatttattcatatggtacatgtgcttacaagcaggaagctattgtgtatatataagtgttatgtatttacgcatatggtacatgtgcctacaagcagaaagctattaatcctttcaagaacctttacaggcattattcatttaatattgataaaaccatttcaaatgagctgataatggtttggctgtgtccccacccaaatcacatcttgaattatagttcccataatccccatgtatcatgggagggacccagtgagaagtaattaaatcacgggggcaattacccttatgctgttctcatgatagtgagtgagttctcacaagatttgatggtttcataaggggattttcccccttttgcttggcatttctccttcctgctgtcatgtgaagaaggatgtgtttgcttccccttccaccatgattgtaagtttcctgaggcctccccagtcatgtgaaactgtaagtcagttaaacctcttgctttataaattacccagtcctgggtatttcttcatgtcaggctgagaatggactaatacagtaaattggcaccaggtagtgggatactgctgtaaagatgcctgaaaatgtagaagcacctttggaactgggtaacatacagaggatggaacagtttggagggctcagaagaagagaggaagatggggaaagtttggaacttcctggatacttgttgaatggctttgaccaaaatgctgatactgacatggacaatgaagtccaaactgaggtggtctcagatggagatgaggaacttgttgggaactggagtaaaggtgactcttgctatgctctaaaaaagagactggtggcattttgcccctgctctagagatctgtggaactttgaacttgagagagatgatttagggtatctagtagaagaaatttctaagcagcaaagtgttcaagacgtgacttgggtgctgtaaaaagcattcaattttatatattcacaaagatagaatttggaattggaaattgtttaaatgagaagcagagcataaaagtttggaaaatttgtagcttgctgatgtgccagaaaagaaaaacccattttctgaagagaaattcaagccagctgcagaaatttgcataagtaatgaaccaaatgttaatcaccatgataatggggaaaatgtctccagggcatgtcagagaccacaacagtccctcccatcacaaacctggaggcctaggagggaaaaatggtttcctgggccaggtccagggctcccctgctgtgtgcaacttgagtcccagctgctccagccatggctaaaatgtgccaaggtacagctcaggatattgtttcaaaaggtgtaagcccccattcttggcagcttccacatagtgttgggcctgtgattgtatagaagacaagaattgagtttggtgaacttctgcctagatttcagaggatgtatggaaacacctggatgtccaggcagaagtctgctgcaggggcagagccctcatggagaagctctactagggcagtgcagaagggaaatgtggggttggagcccccacacggagtccctactggggtactgactagtagaactgtgagaagagggccactgtcctccagaacccagaatggtagatccactgacagcttgcattatgtggctggaaaagctgcagacactcaacagcagccatgaaagcagccaggaggggcactgtaccctacaaagccacaggggcagtgctgtccaagccatgggagcccacctcttgcatcagcatgccctggatgtgagacatgtagtctaaggagatagttttggaactttaaggtttaatgactgccctattggattacttgcatgaggcctgtagcctctttgttttggccaatttctcccatttggaatgggtatatttacccaatgcctatacccccattttatctaggaagtaactaacttcttttattttacagtctcataggtggaaaggacttgccttgtctcggatgagactttggacttggacttttgagttaatgctggaataagttaagaatttgggggactgttgaaagggcgtgatcatgttttgaattgtgagggcatgagatttgtgaggggccaggggcagaataatatggtttggctatgtttgcacctaaatctcatcttgaattttagttcccataatccccatgtgttatgggagggacccagtgggaggtacttgaatcatgggagtggttaccctcatgctgttctcatgatagtgagtgagttctcacaagagctgatgattttataaggaggttttcccccttttgctcagcacttctccctggtgccaccatgtgaagaaggacatgtttgcttccccttctgccatgattgtaagtttcctgaggcctttccagccctggtgaactggagtccatgaaagatctttcctttataaattacccagtctcaggtatttcttcatagcagtgtgagaataaactaatatataagccttattattctcatgtgatataacaaaatatattaatgtagatgtgtttacagacatcttctttattccagctcaacagcccaaattcttttcaccttctgtaaagaagagtgactggaagagagactaagttaattgagataattaataagtgagtgagagaataaatgaattatagaggaggaaccaaaagcacagagctggaagtggaacaggaggttctcagcaattttaaaagtgaaggcaccgtagcagtggaagtatataaagggagtaaagtcaggctgggaaaacagaaggcaaaaatagtgttcatctagactgtgtgtcagattacttctaatatccttcaaggtacttgagtgaggaataatttcctcttatgtttctattggtattgggttgtccttttggatgaggctcagctcagagactgaaccatgtgatgtctgtgtattttagggttgcactcactttgcattaattttaactgagagttaaaggggttaagtgccttgcctaagatcacatactcagaaaatgcagagagcttactccagcccaggtttgttcatttcagatacattagtctcaattcagctttggttgaagtcacctgtgatgaatttgttgcatgatatagttttctgggggaaagatttcttttaatacatggtaagtatatagtaccccttttatagttggatagattagttctttaaatttcttttgtaaagaggatagattagtaatggtcaagtgtcattgagtgattcagacgaatagttccatgattaaatcttgtttcctttactttttgtataatgctaatgtatcccttaaaataaaaactccatttagttttcttcagttcatttaatcatggcattgttactgtaagaaagttcttctcctaatggtttctaattgctcttaaaatcttgtttgaatcccagaacaaatctctgtgttatatgtcaccagtgacccacccttactttctctcatttactgcctttcataagcagaaagcatttattttttgggtatttttgcttattttttaaaaataaataacattgatttttaatcctgggatatggaagatagtttaaagaaaacagcagtgtcggtggatagcaattaccaccaacaaaatatcttctgggtatttgatctatgaactttgtttgcactcctgcccacatcagtttttgtaacccttccaacttcctcctaagggcaaactcactgacatttccacaactgttcacctttctgatcctgataggattactatatattttgtttaggtttctagatatgataagactatctacctatccaacttggatctgtggcactttattttcctattaattttaaattcaggatttaaaaaagatacttacatagtgataaaatgagttgactcacaccctgcattattctaaaccaaaattaagttatattaatacattctctttaatcaagggtaaattcacatgccccattgtggttagtgaagtggtgaagggaaagttgaagccaaacagcctatgtcttaattctaactcagccactaactagctgtgcaatcttggacaaggccctgaaactctctgggtctcagttttctcatttctactaaaaggacaataatagtacctattacctagagttaggaagatgaagttaacaaagtgatagtgtattaaagcgtacctgacacataggaaacattcagtatatattgtctgctattattaaagctcctacacttattaggtaggtgaacttaatcagattatttgactttaataaacagcaatgatcatatttataaagtagggattgtaaaatataatgcagtgagtttacaagtgtcataatgtgaaatatataaatataaattacatatataaaatatataaatataaattacatatgtaaaatatataaatatacattatataaattatgtatgtaaaatatataaatataaattacatatgtaaaaagtacatagccatgttttgactcataaagagcattcattaaatgtggttacaatttttagaagacattatcagtaatattatcagtaatagaataagacctacaaaaaagggtaggggagagagtttcatgttgtataaggggagtgttgatttaaaagccttagattaaaatctgcaaatgaaactaaattaaaggtgttttgaagtgattttaaccgccaaacaaattgcatttaatacataataattactttattctcccattaaaataattatttttaagtgaataacagcttctttgaccaccctacctgtagttgcagtaacagtctaccagttgtctttccaaatttgtatgatgtcatcagcagcttaatagagcattagatgagaatgtctgagcattactatgctgactttgtaaaattgtaatccaaaagcaaagaatcttgacagcttagacagttggtttgatcttattattaatgaacagaagatatatcttaggctattttaaaagtgaatttataataagatttctacttcctatgttagctagagtaaacactagctaataaaccaccctcctaaacctcagcaaactagcccaagaaaagagtttaattttggtattagtattgctcactcacataaagcccaagcaattaggagcagaggaagggatgtgagggtttgctctatagagtcatagaggatccaaggtgacagagcctctgtcatcttccacacaggccttccaagatggttctagccaaatccagctagccaacatctctggaaatgacaagcatcacttttggtcatatttcattggtcagaagttagtcagagggtacctagttgcaagggaagctgggaaatgtagtctggctggcattgctttgttgcactaactcagtcctgtggaaaaggagcacaaatatttggtggacagtaaatgatctgtgtcatatccttattactcagatccatagtaataatgtctgtttttatctccttttctaattcctagtaaagaagcaatcaaataaaaagaaataaaaacactgaacagtatgtgttcatttgtctcatccattattgtatatagtgcctgatacagagttcagtatatattcagtatatatagtacctgatacagagttcatgatattcaataaatatcatgagtgatcaaacacatattctctgccttcttctcttcctcccttccttttttctctttttcttgcttcttttatatctctttctttttttctgatcccaaacactttagagtctttaatttgagctagattctatgataagtgattgaagaatcaaagacatatttaaccttggggaaagtcataatgggaataaaggaaaaaacattaatataaagtattagtaaacatttctaaattactgatttcattaaaatatttaacagtcttatgaaagactaaagaatcattttgagttcatctactaggcatggacaagccacttcaggaagtttaatatccttctttgtgcctttgggtttaatctgtgctagtgataccccagccttgacagaattgctgccccaatggcccaggctgtgggattctgcacaggaaagaccacttcatggtgaaaattctctaaagttttgctgtgaatcataccataacctaagatctgtgttatggtaaactggatactgtagtggtggaggatgtctaacttcgttttgtgtttcacagagtttcaagagttttcctgtaagcctctttagtctttgtatatttaatgtgctccaatcctacttacatctcaactgtgttctttctgatggcgatggtgatgatagtgccaatcatttatttagcactaacaactgtgtgctcgacactgtaccaatattattagaactattatttcttttactcatcacatcagccctattagatatttagagatttggaaaattatgttcagatagatttggtaacttgtctaaggtcagacatgttaggaaaaggcagagctagaattcaaatacagttttgactgagctcaaagcttgtgtaatcaccacttaggctgatgatttgtttaggctattgagagagaaagattattttatctttctttttttttctggaaagagggatgtatacagatcttttagtagtaaaattttgccactacattcagtgacaaaaacaggagttacttttgcaccaacctgataactcttcaaaatgtttggtgaggctggactcaaacataagtgcatggatgcctgatttttttcccccagtattcaagaacctcagggttttcctgaatgtgctatagacattccagggacctcctaagttttgaacattgcattattatgaagattaggtccataagttttatcagattttctaaaatacgagtaaacattttttaaacccaaggtttgctgccaacttctctcctctacagatcctggaaagaagaaagaaatggcttctaacaaaaagaaggggaggatttccagctcatttctaattcaggctcattggagaaggaagtggcatgggtgacgataagcagcagtttttatgtctgaaggaaactgaaaacagcatctcactggggtggccaggagctcttctgctgaagtctctgtgtatccagaatgcctgggattggattcttgtcctgttgcctctgacttcctagaagtggcctctgggccgtctttatttattaaatcatctgggtatgatctggctctgatattttggcattcgggagtggcagaccaagctcaaattgcaatagtcctttaaaaagatgtttctaaaagccagatatgcactgacatttcagaaagaacatttgtgcctaatttccagctgccaagttatagttcatcattcagcttcatattggaggccttcaggctttgatttatttaggaaacattggtgaacaatgggatcatgatctgcaacatgacagatgtaggaagtccatgtcccctaaaggaggttttctggagactcctaacaattaagagaatctgttctgtttctaagttgacagcaaattattgaattctgagtatccagaatgagtttggggagtaagagttgtgaagggcagacattaactgcttatttaagacataatacctgtcctttggaaacttatggtttgttagggggtagtgtcctagaaacaatgtaagacaatttgttaccaaatgataaatagaactttaaaacaaaaattttcctactgtcagggaaactaagttttccttttctttgaaggcatggagaagtgccgagcagtgtgttacttttcctctattccctggttcgttcctcacccacgtcagtttttcttcatatttgtctttattggaacccacaaagtttattcaaagttattatcagtttcttcccttttgtgaagaaaattcaatttttatgaattagatttttaagatggcttgtaatgtacccatacagccaggtataagaaattacctggtagcttcactgatgcagatgacagatacctgtggggacttacagtctagttgggagagtaatcacacacatacacacacacacacacacacacaccccagatttggcatgagaagaacaacgctgaagtcgatatctgcctattttgtttataatggtgtgaccttgggcaagtcacttaatttttcaatgtattttctcatctataagatgggagatatcttatatcctaaggctattgattatgtcagatggaatctcatctgagaaaataccttagaaattgtacagtatgataaaaatattgacttttattttctaaatcatacatagcaagatgcaggactagtttaattgttgtcacttttagaatccgattttcacatcatcattccatttcttatgatatttaacatgacaagcaaaagaccttgttcaaaggggaagaacaaataagattaattctctgtaaatcctttaaaattttattatccatctcttcactggggaaatgtctagatacattttcctaagtggttccatctttctgtaaatggctattgacctgctgagtgcagttttgctttcagagaagcattgcacttggtgtgtgatttgagtttgggatcatgaccttatttcctttgcacttgattgctttacttcaccaactgcatccctgattttgatattatctgtggctagctcctttcatgattttgggaatggctacctctcagttttctgaatattttttagtacttgctgttacaatgtagacattgcaataatgttctaaaattatatgtacatttacttactcaacacaaatttaaagagtacctgataagagctggtactctgagtactgagcactgagtacctggtagaatcattaatacagaagacaaagctctggcctcaaggattctgcagtacagcagcagggaggtaaaacacacataccacatttgtttactgcaagtgtgggaggtagataggtgtcccctaaaaacatgtgttcccagaacctgtgacgtgaccttacttggaaaaagggtctttgcagatgtttaagttaataatcttgtgatgagatcatcctggattgtacaggtgggccctaaatccagtgaaaactatctttgtaagagacagatgaggagaagacgtagagacttgtgaaacagaaggccatgtgaagacagaggcagagattggagggatataaccagaaagaatgcccataggcagcagaaattggaagaggtaagaattggattgttgcctaaagccttcagaaggagtgtgaccctgtcagcatttggatctccgactctggcctttaaaactgagagagaaaaaaatttctgttgttttaagccagtgagtttgtggtaattttttaatggcagccatgagaaacgaatacaacaaggaacaggataatctacaaaatacatgaattatacaagagcatcagaagtttgtggaaatttagtataaaaaacacctcttattgaaagtgtgattgttactatacagtcagtccagaagcactgaattatgaaaatatcattgcctggtatgtgtcagttatgtttataataatataaataatctaagcacacattgtgtcctgtaattttaattttactctaacatcccatgcaaaggtttaactgtaggtggccatttcatgaaacaaatgccaatttctcatggaccaatgttctcccagcagaggaaatatatcttcctgcccacactgggctacaacatcactaaaattacaagcagaaaggaggtctgcatttctatagcctcttcttttcttatctagtagtaaatggttataaacttgacattttccagttacaaacataagtaataatattgtaataacaaaagggaaggtccaatcctatagatcccactgatggtgatagagtaaatcaaggaatttggaagaagtggtatctagtttcacaagttgaaaaaccagaattatcttcaggcattcataatttcagtgtcatgggttaaggtgtttgggggcaaaatgagtttctggctgtgggatggatttgagtggtgttagcaatcattcaataacagaagccactgaagcagccttcgtctccctaatcaaaatgctgccatcataccattttgctcccaaaatatgctaaaagtaaggcaccaacggtaataagtagtataggtaatttttaagtaccataaaagtttacaatattaacagttacatttgttaattttgtctggcttagttggtggtgacttcagatggtaactgggtggaataagacttctaagcccacataagacaggatggtgtgatctttctgggagggtgccacgtctgtccaatattgatacaatagtgcaccagtggcagcttcttggttgggccaagtaagccttctcaatgtatttactccttcagtatttataacaatcaggaagctgtaattattgtccatattttactaatgaagtaactaaaacttagagaagataagcaatttgtctgaggtcatgctctagtagtgagcagagccagaatctgaactctggcatgatgactatagcgtctgtgtttttatgcattactgataggtatgggtggtatactggagacttagtgagtatttaggtgtgagtaacgtctacagtgacgtcagggagctcactgtacatccatgacatgagaaataaaattcccacgcttccctgtcttgaagctgaggcaatatattacatgggttaactgacaattcagacagagtgagagattcattatattcaccacaaatgaacacagatggacactcttcaaataaagcttcctattgaattttaatagtgctcttctgcagaacacatttgaaaaatggatcatagcatattcatattttcctttagcttgccaaatgtgagatgattaagaaacctgcttaaactttaaatattcttaccatacacatgcatttttcaaatgtatgcgtctgcaataaatatttgttaaatgaatatgaatgtatatacacaaacatacatgaagcaataggcgcacacacatttaatttgataaatatttgttgagtatctactgaatataaacttgggctgaagagttatggaaatacaaagacagaattcttttctgttcccaagaagctttataaggggaagtgagacatgctcagtcttgttctggtggcagctctcaaagtgtggtctctggctcggcagtgttggcatcacttggggacttgttagaaatggaaatgcttgtgccccaccatacacctgctaaatgagaaactgtggctgggggtctagcaatttatggttgtaaaagtcctccagggaactctgatgcacgttaaaatttcagaaccactgggcacaggaacgctttaatgtgctaaaggatgctaaatattactttcacgtggagacatctgagaaggcttgaagaaagagattgtatttgagcagagtcttggagaacaggtagattttggctgatagaaacagagaagggaaataaagtcaaagagaagagaggaagtcaacttagctcgtttgagttggcagataggctgcccatggatgaaaacccagattaaaatcaggcagtggaaatccctgagcaacacgcttgtgagtttagacattgttctgaaagacattggcagtcattgaaggtttctgagtggggaagaagtgtgatcaaaactaccttccttttttttttttcttacccagtgaatgtaattcagcacttgtactgagttcatattaacagaacttgatggttgtaaatcagtcttttcttcctcattaaaatcacttcaccattaagaattatctataggttatggctggaatcatgttatctctgctctttcttgactattctgacacagcaggcaacttaatttcaacaactcggtaatgcccccatcttctgtgtgtgtgtgtgtgtgtgtgtgtgtgtgtgtgtgtggtgtttgctaagaaggagtcacacggctgcttttgaattcagctgggctttaggaagctgcataaaaacaaagaaaaaatgttgctgcttgctagtgcattctttgttatgtagcaatcagaaggatgactgtgctctgaagtggtgcaggtggcctcttctgatactaattccagcgtctcaactagttcagcatcaaaagggagttctctggaagggaaataattctgtccctacccctgattgctcctatttgcccagcattgtgggcacctgcttggccacccaccttccttttctttgccatccacttgcgtcatctttctcttcccctgggtcagcctgtatatttcaatctatccacaccctgcgcaagctcattcattcatgggctttctctctgcaattttcattgtgcctccctttgttggcataattgattccctgctttgcaagagcaggtggatgagttggtttattcctttaaaaaattcctcctcttttctctttcattgctctgatctttagtcaatctttggttcagccagcttgttctccttctattgactaatctctctctgtatctttcataatggtggtgggagagtccatgccgaatctcctgttggttgaagaaggtgaaagtcaattggtaaagtcactgtgatttataatgttcaaactggggagggattgagtcgtgaagaccagaagtactgataatcatttagcttatttgctggaaggctccactagaccctaatgaaacaatctcatttatcttccccacatcctaatggaattgcagaattaatagtaaaaccattaagccttcttgagcatgtctcatctaacactccaggatctttgttacacatttttatttttctcaattttggattttttgagggtgcgaatttacttagctgagaaatttagaagtcctttattcagtctagtataaagtgtccagataaaaacataccttagagatattgtgggtgcagttccagaccaccacaataaagcagataccacaataaagcaagcatataaattgtttggtttcccagtgcatataaaagttatttttactctatagtctattaagtatgcaatagaatgatgtctaaaataaaatgtacataccctaattataagtattgtgttgctaaaaattgctgatgataatctgagcatacagtgggtcataatcttcttacttgtgaagggtcttgccttgatattgacggctgctcactgatcagggtagtggttgctgaaggaggttagggtggctgtagcaatttcctaaaataagacaacaatgaagtttgctttatcaattaactcttgcttttatgaaagatatctttgtagcatacgatgctgtttgatagcattttacccacagtagaacttctttcaaaattagaatgaattcactcaaaacttgcaggtgctttatcaactgaatttatggaatattctaaatcctttgtagtcatttcaacaatgttcacagcatctttaccaggagaaaattccattttaagaaactactttctttgctcatctatagaagcaactcttaaaatccattccagttttatcatgagatggcagcaattcagtcacagcttcagtttctacctctagttctagttctcttgctacttccaccacatctgcatctactttctccactgatgttttgaacccttcagccatccatgaagattggaatcttttccaaactcctgttaatgttgatatttcaaacttctcccatgaatcacgaatgttctttatggcatttacaatgttaaatcattttcaaaaaattttccatttgctttatccatatctatcagaggaatcaccatgtcagttctagccttacaaagtgtattttttaaataataagacttgaaagttgaaattattccttgattcatgggctagagaatggatgttacgttagcagacatgaaagccacattaatcttcttgtactcccatcaaagttctggagtgactaggtgcattgtcaatgaatagtaacattttgaaaaaaaaaaaaatcttttttttttccttagcagtagttctcaatagtaggcttaaagtattcagtaaaccattttgtaaatagatgtactgtcatccaggctttgttgttccatttacagagcacaggcagagtagattttgctaaattctggggccctaggattttttgaatggtatataagcattggcttcaacttaaagtcaccagctgccttagcccccaacaatatagtcagcccgccctttgaagtcaggtattgatgtctcctctgtagctataaaggtcctaggtggcatctttttcctatataaagctgtttcatctacagtaaaaatctcttgcttggtgtagtcaccttcatcaattatcttagctggatgtaacggataacttgctgcagcgtctacataagcacttgccgctttaccttgtgcttttatgttatagagatgatttctctccttaaacctcatgaaccaatatcttctagctttaaacttttttctgcatcttcctcacctctcttagccttcatagaattggaaatagtttgggccttgctctgggttaggctttggcttaagggaatgttgtggctggtttgatcttcaatccagaccactacaactttctccatataagcaataagcttgtttaactttcttatcatctgtgtgttcactggagtagcacttttaatttccttcaagaacttttcctttgcattcacaactaggttaactgtttggcacaagaagcctagatctcagcctatctcagttttcaacatgcctcactgagcttaatcatttctagcttttgatttgaagttagagatatgagactcttcctttcatttgaatacttaggcctttgtgggagtattaattggcctaatttctatattattgtgtctcagggaatagggaggcccaaggagaggaagaaaaatgtgagaatggccagtaagttgagcggtcagaagacacacaacatttattaagttggccatcttatatggacatgatttgtgttgccttcaaagaattacaataatgacatcaaagatcactcatcaaagatcaccatctcagatataataataatgaaaaagttttacgtgttgagagaattaccaaaatgtgatgtagtgacatgaatcaggcacatgcagttagaaaaatggtgtggattgacttgctcaaccaacggttgccccaaaccatcaatttgtttttaaaaatgcaattgttgtaaaatgcaaaaaagtgaagcacaaaaaaactaggtatgcttgtgataggtttctctcctattctttgaagaggcttttaaatagagttgattgcatggcattgcctagtaaaatcattttaaactaatatgaaattatataagctctgaacagggcatttgatgtccactagggaaagtaaaacatattttttatttcagcataagaagcttatctcttccatcttgtaaaataatataataataatagaattagttaaacatggtgattactattacgtattttatgattccaataattcaagcacagacactatcttgaatgcgtcctagtatattcagctccacaatgatgcctagggtttcatgttgaaggctgtgaagttaacaaaggaaaatggagatctgattactagcttccagagattggttgagaattgagggagaagagagatcaacattatatatttcacatggcagagggtaataggagcttttatagagaggcaaaatgcattggtagaaagagaagagagagcctaattccacttgctaaaaatctatggaagccacctaaaggaagaatgaaaaattgaatgtttatcaataagttggaaagaggagaggaacattatgggcagagcaaacagcatagaaatagaataatacatggagtatttgttagcattcagagggaatggagatgacgggaaatggtagaacatagttagaaaagtaaattgggcagaattggtgacaggggattcaatttggtaagcagtgggtaaccattcatggctttgagcagagtttggcaaactatgatttgtggaccaaatccatcccattgtctgatcttgtaaagaaagttttatttaaatacagtcatactcattcacttatgtattgtctgtggctgctttcatgctacaatggcagcattgaatagtggtgacagagactgcctacaagctgaaaatatttgatatatgactttttacagaaattttaccgatgtcaggattcactttaataaagtgtttcataaagtgtttgtttgtgccgtgatgggccatccaagattgtaatgggcgatcattggaaacaaagatgcttatagagcagcatcttgcatgtcacaaatatttgaatgaatgaaaaaatgcatatttctgttaagacatcacagtaacagtaggagatattgctttttttttctttctttttttttgacaagaccaatgtgaaaataatcagagagtggttctctggaccacatcctgttcttcaggggagagacattgaaaaacatcaggaaaagcttatccctagaattgattcagaggacaaagctacagttatgagaaaggccactttggagaaatgttggataagatgtccagtgaggcacagaatggggtgacactgggagtgacaggatcttgatggactctggccatggcacttctcaaacgtttttggcagtcctatttctattttcacagactcctccacctccactctgtcctggccagcacccagttctcaagcattacacatttatcccaagtaatgcgtagggagcttcctttcttgcacctataaattattcactagtttcagattggggtgaaaagaggaaaacataattaatccagaattatttcacatgtataaattccttgcttggttttgtttcatcatcagggcttccttggccttccatggatggcatataccttattaatttatgcttagcaatcttttgaaaataatttttacatgggtaactcactgaaacatcatggcatttatctcacatcatgtagttttgtcagttttgatgttagagaacgtattctgccttacttttatgtagcaatgtgaccaggaaatctcatgtaaaatctatgcctccctaatatgcaaaaatactgaaaatgagcacctcttctcccttccttcttttttaataaatctagtaataatagctggaataatcacaggatttctaaatggagtcagcatggcaaaggaaaatgttggtgatatatttattaagtccatagaagttaaacttccggagagctcccaagctaattggtaccccttgttcaggactggggactattaactgagagaattcattgggtgttttaatatctagccttttaaaatctattttaaacaaggactttgaaggatgactgaaatgtggttaaatttccacagagaacttacaactccagcaatgggaactccccaggtacagtgatgatacgaattgtgttggatttcttgaatttcatcttcaaagcacaagaatgagaaaagaaaggagacaggaaccatttacattaagcagagatgcataagtttcttaagtggtgctttccagagcacagctgggtttcgtgtgtgtgtgtgtgtgtgtgtgtgtgtgtgtgtgtgtgtgtgtgtgtctgatatatcaagctgtcggttatattccatagattcatagtattttcctcctctctatattccatctctactttttgtttataacaagttatttactttgcccatctatcttttaagcaaattatcttgattggaaataactggaatgcttgataattatataagaaacttaaatacttggcctattcatttatcctagagttttagggaacatcttggtctagcataggcattctcaaccatcatattgaaaaaaattgtggagcattatagcacaaatgattttacaaaataaaatgattgttaaaaattagaataggttcatagtagcctcacgctctgggttccatcatgcttcttgggagagagagaaagagcagactggctggtcagaaccctggctttgactgaagaacacattctgcctgtaagcataatttctcagctctgagccagagaaaagcagtgggactcttttctctaggaaatacagtctgcatagatagaatgaagcagaattggagacacataggaaaacaattatccctttgtattagtttatctaatcctctgctttgggaaaacaggaagagagaaaaagaagagggaggagagggagggagctaaaaacaaaggaaaacacttcacaagggtttgccctcccccaaaaattcaagacatgaaatagaatctatcacatatgattgggagccttgtgttctggttttctccaatcctaagcccaagaatttgttcctcctgatgctgtagatagtttcacctgagaagattttactcacctctgcgtcccattatgagatgggaaacctggcttctgccacgtgggcacagagtagatacccactagattttgttgttttgtgtgtatggttgccagggatgatcagtgccccaatattcttgccccatcaatattcttcttagtgagatttgcaaccttttaagcattgggaacttaagggttattatgaatacctgtcattttaagctaatatacattctttacagaataaatgcaaaatgttcacattcatgagaaaaaggaagaaacttttagctgacacataccattttgcatgttatataaatgtattctgctcagtacaaacatttttgtgaacttaaaaaaaatctcttaaatgtttctataaaagtactacttcttgaagtttatatttgaatgaaaatacctcaaattcttttctaccctgacttagaactatataactttaactctctttttcatttttaaagatgtgatattcctctgatgagataacgtggagctttcctctaaaattttcttgtgttcagaccttttttttctcttccttctggtcttcaaaaagctataggaatctgacctaggaacactgtttcctcaataattggcattttctattttcactttggttttccccaacttaattgatgagatatataatctttctccatccaaagaaactacaatgactgacactaacatttttgaacccatctatgcccatttccatttttagttctacaaatgttctgacaccattttttaaaaaatcacaacaccccaaacagtgggttctatttttttttctattgttatagatgagtaaactgacacctaaagagggcccttagcttgtggctggcatctcaggaccaaaatgcctgcgtttgaagcccctgggaatttggcctttggagcctttagcagcttctaagcctagtgagtttgtggcttcaggtcctgtttaggtcctgtttctcatttgtggagaggttggtcttgttttgaaggcagcaacctccttcattttttttcttttttttttttcactatctatcattactacgtttggtgccaagttggggcctcaaattttgaacttaaaacatgacatgcctggaaatccttttctctctcttcttctgaagggtgtccataaagtctgggatgcagacaaatatatgtaatgtcattaaaatttttacaaatctgtaaaaaataaaatagtattatcaatgttttcataccttacagatgcccttcactttaaataaagatttcctgagaactaaaaataaaaataccatgtcctcaagtttggattagtccagggagtagggagaagggctgagaaagagaagggtaaaattatctattcttgacatcactgtaataaattgattgaactgtactgcatattgaatgcttgctcttactagggtctcttcataaatcatctcattattcctcaaaataagtcagcctgctaggtttgatgagcccatttgacagatacacaagtccaaggacatcaaatgactcgcccaacatcactagggcatgtgggctgaatgaggatgttcagtctggtcacatcaaaagccctagctcttttccctataagctagaaataatattccatcccttttctcacctacctcccagcaaaaacaaatgacataaaaatatttttttctatctgcttctgctcatgatacctttaaaatgccttattcatcaattcattccccatctcaggctcaggtaacccttgatgggggatttgtatctaattttctctgtatttcttgaaccatttttttttccatgtgtccatctctatggatccaacctcatgatttcctggaccatttaaattgtcttttattctttcttttttctctatcacatatcttggctctaactcacctgctttccctttgtatttctcttttaatattttacatgtatgtattaccccaactagacagtgttttcaagggagaacttaggaatttttcatttctttccaccatgacatcagacatctttctgatgtcatagcttatgaaataaaagtctataagtatgtgacctgggtaaaacataatcattttgagacttaatgatatgatctctatcaaagttattgtcaactgcagttcattctgctgttatttttatatttgatgataattcagaatttcatgtccccttctataatacctcacatgccaaacaaattaattgtgttaatgacaggtaaggaagctcctggtcactttccttccttgcttcagacccagcttcaaggtgggccagatggggcacaggctgcctcctctgtctgggttcgagttacttgtaaccatgtctgactgtcctggggtgcctcttagctccagttaatttctgaatcctcagcaagttttaaaagtctgagcaagaatttcctttcttactctgttgcttcatctttttcctttcttctctcaaatattcaggatggaggagaaacggcaggctgagccagcaatccatcttacttgaaacctatttgaaggttgtcgggtatgcaagggggctggaaatagggactgagagtttgattccagcatgaaggccaggcatcagtaccgatctaccttgtagtgtggtaaatagactttggcatcagctaaattatttctgtgagactgaagtattttgatcgaaatagacaagtgagcaaagggatttgcaaaagaattctgttttctggcacaggcatctcaatgaggccttgtgcagaatctcacatccgagcgccccctgatggcaacatatagacacgcctcactttctgtggccaaattactccatgaaaggaatagtttctatatttgactttaagaccttatttctaatttatgttttaacctgggatgtgtttggtcaccacttatgtatttgtttttcatatttgtttgatttcaaattatctgtgataacagtattagattataaagtgcattttatgaagctattttaaaataaggtattttcaaatgtcatttaatgttttcttggaaagattcaaagtagtagagtgcttgaggagaaataaaagcagaggaggaataaaaggagatgaaggaggaggaaggggaggaggagaagttataaataaagattagcccctaattctaaaacattttttcttgatctaaatatatgaacaacgaagtccaaattatttaatgtttcccattgactataggatgaaatttaatactttagcctgatgtacaaggctcttaaagatctatccttgtctaactgagtccagagccaaccctacagctgcccaccttgaattttatgctctggaaatactaaatgattacaattacctaaatataacatagttatattcaggaaatacatatattaaatattatatatatatgtataatatgtaactatgttgctcatggatctgtgactgtgcacaccatagttccctctgtctggaacatatgtactgcctcttatcctcctgcaaatctcatccttttcaaggtaattctttcatttcagataaaatgttattctctctgtgaagcttggccgtgatttccctcaactcctgctctccacaagtttccactttgtactgagctcttacattgccttggtcattccctttctcttctccctacctatgttctgaggaaataaacaatgaagtttcatcttctttttttttttttttttctgagacagagtcttgatctttcacccaggttggattgcagtggtgtgattatagctcactgcagccttgatgtcctgggctcaagagatcctcccgcctcagtctcctgagtagttgggactataggctcatgccaccacagctggttattttctttgtagagatagggtttcgccacattgcccaggctggtctcaaactcttgggctcaagggatctgcctgcctcagtctcccaaagtgcttggattacaggtgtgagccactgcgtctgactgaagtttcatctttctagtccagcttagcacaatacttggtgcaggtgcgtaagacatatgtgttaaattgcatacttcccatttcctgaatggaggtgaaataaaggaaacaaaagttaaatacatttttcaggagatacagaaatttgtaactcgctgaaaaagtagctttttattaggactttgccttttaaatcattacacactttagtctttcctcttaaactaaattactatttattattgactttacagaagaagaaactcgtgtcatacttatatgactttttggaccctggtgacatgtgactaataggtaaaaagaacatacaatgctgggagcaatttgtccagtggcccaattttatatgatgcctcaaatgaagtgctgtttatgcaatgaagtgcgtttcttgctttgttagtagtcattgagcctctgcacacgtaaatgtgtagggaatgaccattgagagacaaagtgtttgtgatgttacccatttatagggtatatcaatagttcacatttacggcacactcctttgaggccaggcactttacacacactgtcacaccttatcctcaccatcacagtatgacattaggacaattatgtctatttgcagatgaaactgtgactcatagagatcaggcgatatgtcaagattattcagatagtaaaaggcaggcttgggttcaaaatcaggcagtctggtttacagagcctggccattttttagggcagttgttctcaaccaggggcaatttttcttcttgggatatttggtaatatcagaagacatcattttgattgtcacaactgggagagagggtgttgctggcatctagtggtagagtccaaggatgctgctaaatatctcagagtacacaagacagtcaccacaactgagaattgtccagcccaacatgtcaataatgccgaggttgaaaagacctgttttatgataataagccaggtagaattcatgacaattgagtttatacaccaaccagtccttagcctttgctgttttccgcctgttgcatttctttaagtgtcatttattttcatggctttgactattaactctatagagatgatttccaaaaatcaaatacagatgatttctagagagaacctcaacctctccctcgaattctagcttcttattttcaactctcaggaggccatttttatttgaatgatttgctgaccgttccagtaaattcaaagtaactgttgctcctaatttctccctctgtggctttgtcctttttatcctagatactgttattcttttcgttagccaggaatgaaactctgatttatttcctcttctcttttccatagttctcctgacttcctcgtctccaatcagttactgaatatgaatgacctttccctacacggcttttcatagtatattcctattttcccttccacaatgctgacctaggtctttttcacctaccatgtggtattactgtaatcatgttccagctaatcttctgactccattattttcctctttcaacatgatcctgcacaaccacccagttaatctcctgaactaactctttggccatgtatccttttgtagtgcctttctgccattgagttcagtgtggattgcatcttgtgtttaatattcttcaggatttggcctgcaccctgtcatcttcagttgagccaactccttgcattctctgaagtgtactgtgcctatttctgcctcctttcctttgcccagcctgtgttctacagaggatcaccctagctactccacacctacacaaaaatatcatattcttaagacctgatcttgaccatttaccttcactttagttcttcctgtttactgcgccattcaccctggtcctaagtcatatgttctttctttgtatttttatttgaatattttataggaacatactttgtcatcccaactggacagttagtttttgcaaaggataactaatacattttcattttctttctcagcacctgatatcataacttttttgaataaaagtctaactgtttgatcttggtaaatgtaatcattttgagagtttatcatgtataaaatgataaaagttgtaatgttgctgttctacaaagcctattaatattttaccaatttgcaaaggagaactaatacatttttcattttctttcccagcacctaatgtcatagcttttttgaataaaagtctaactgtttgatcttggtaaggtaaaatgtaatcattttgatggtttataatgtataaaatgataaaaaatgttatgttactcttctacaaagcatattaatattttcccaatttgaaagataatccataatctgtcgagtttctagagaatacatgaaaatactaaaactaaagtggatagagtttatgtgagtattatattcagaatcagtattaggggattaccaaaatcgttacttaaaccaagataaacaaaattaaagaacatacgatttggtggaatagaaaattgtaagtttaagggcagtggctaaaactggaataatttatgttctataaggggaatggctaaataaaattaaaaacacatttttaatgttattgatagaaaattaacccataaaaattggtgcattggtcattatttagactaatctgttaaagttgattatcgcacaatcatattttctcttagataaaagatttatgatacttagtaaaaatggagcagagatttcaccattatattatataattataatttcagtgaatcaactgcaaattcatcaaaggctatttacattctgcttcacttaaattttccagttttattttccagaatttttctttacactgtgccctgcactccaactagactgaatgaactaccactactttcttcccatgatttcccatatctacttcctctgttatttcttctacccagactgcccttcccaatagttttctctgtgtctacacaccttcctgacaccactcaaatatcatctccaccaccaacttgccttgatccctagaaataatcagacccttttctgaacacccttaaccatttattactattttgtggcacttatttcactcccacatccaatctgtgtgaatgggcatgacataacttttctaccaaacaatatttctttggggaaagaattgtctccagttatctttttttccctgatcctaggcaagcaaggccattgcaattgccgcacaaagggtggaaattgagctggtttcaaagaccagattcggaaacttgaattcattttctctgtttggtttcttctttcatacttgcttttcccacttggctggagctggggcctaggtagattcaggcttacatatagccatatgaacagaagggaaagaaaaggttttttttttctgccaaaacttttctattttagaaaaatagggaagggctttgttaactgtgacttggggcatgtgctcatttctggagcaataactgcagccaacagaatatggtaaaataattcgctcaatctgggctgagatacactccttaaagtcaaggactcctgtctgttaccgaagtagggaaaacagtgctgggcagacaaagaaactaccccataaaagtagaagatatctttcagagtctcaacacatataattattggcagtttctttaattatttttttctatttatttactattgaaattggattgcatattaaattttggatttagttttcttacttatcattatagtcagctttgttgcatggtcttatacattcttcttaacatgtgtggtgctcttcataaacatatgaggtgctttggaatagtatctcctgaacacgtcaagatatcaccaggaaacaaatttgactttaggtcacatggccacttttctgtctccatcacaccggttttctagctggtcagagtggggatagagtctaaaggggaaattaagtatcatgtgagctttgaattatgtaatgttaacaaatgtttaacattactattttctagagtggatttttgtaggaacactttccaacttgtatgcatgtttcccattccacatagagttcaaaatgtgactacttacagactgctttccagttagtatatttaagataaagaagcctacattacacaccttaagaatgtaggccatgtctacataataagaagaacatattttttaacttttaagtccaggggcataagtgtaagtttgttatgtaggtaaacttgtgtcatgggggtttgttgtaccgattattttatcacccagatattaagcctaatacccattaattattttttctgattctcttcctcctcccaccctccaccctctgaaaggacccagtgtgtgttcttcccctctatgtgtccatgcgttctcatcatttaactcccacttataagagagaacatgtggtatttggttttctgttcctgcattagtttgctaaggataatggcctccagctccacccatgtccctgcaaaagacaagatcttgttctttttttatggctgcatagtattccatggtgtatatgtaccacattttccttatccattctatcattgatggacatttaggttgattccatgtctttgttattgtgaacagtgctgcagtgaacgtaagtgtgcatctgtcttttgataagaaataacatcatacatgcaaacagctgctagcatgtctttgttaacactttttgtggcttaacatctttactaatatttatgattaaattcaatcctcttatttatttcccattatagaaacaagtagtgtagagttgtacgagactcctgaatttatttagtccaatgtttcaagcttttcagaggtttattttacaaacccatagtagtcagtcatgatactttggtttaaatacatctgatcctatcttcatcttgctatggggaactttctgtctcaccagtcagctttttccattgttaggtatttctgattgttggaacttcctcctcccaccagtctttttcagaatctactgtcaaatctgttctcatagcaattataatttttctttcagaattataattttaaaaatttgcacatttctgagaggtcttcaaaaagttcctggaaaatgtgcattatgaaaaaaactgggcatcacttaaaaaaatttcaccaagataaacttgtactaacttcttgtaacatgtctgaacaggatctagtttgagacactaagaaggataagacattggtttgaatagaggccctatcagagcaacatgaattctattaaaattgcagcaagaacaaacatcaaatttatggtgaggcttgggtagaagaatggtgagatcattgattctttatgaaaagaatggggacaatgccccaaagaaattagcagtttataagtagaaaactcattttaaggaggaacaagaagatcttaaagatgaagcctactatggcagaccatccacatccacttgtgaagaaaacattcatcttgttcatttcctaattgaaaagcctaggttattaacagcggaaacagtagctaacaccacagacatctcaactggttcagcctacacaattcttactgaaaaatttaagttgagcacactttctagttgatgggtgccaaaaccgtcgtacctagatcagctgcagacaaaagcagaactttcaatgaaaattttaaacaagcgggatcaaaatcctaaaacatttcttagaagagttgtgacaggagatgaaacatggctttaccagcatgtaccatcctgaagacaaagtacaatcaaagcaatggctaccaagagcaggaagtggtccaatcaaagcaaaagcagactggtcaagagcaaaggtcattgcaacagttttttgggctgctcaaggcattttgcttgttgactttctgaacgtccaaataagaatagcatctgctaatttagtacagtgttttgagaaagccaaatttttagcagaaaaatgcccaagaaagcttcaatagcaagatctttttcattatgacaatgttccttcttgttcttctcatcaaacaagggcaattatgtgagagttttggtggcaaattattaagcattcaccttgccatcctgatttgacttcttctgacttcttattgtttccttgtcttaaaaaaatctttaaagggaatccatttttttcaattaataatgtagaagagattacattgatatggttaaattcccaggaccctcaattctttagggatagactaaatggctggtatcatctctgacaaaagtgtcttgcacttgatggaacttatgttgagaacaaagtgtgtatttttaatttttatctacttgcccatgaagttcatggagtgcttttagatctgtctttttctctgtctgtttatctatctatttatctgtcaatctgtctacacacccatgcatctactatccacctacctaccaatcatttattcatataaatttgtttaaacacctggaaaaatgattatatctccctcttgccttctctttacgtattgctaactatactcagatatttgagtcattcttagtatgatagttttcttactgttgtccattcctgtcttattttttaatgttctggttcttttagaaatatgttatccaaagtaaacccactgttcttgctgtaggagagagttcactgggcctttccatgctgtggtgtggacttttacttccattgtagatatagcagaaagagctcagtgaccgagagcctgactgcttggatttatactctgcctccacctctcactggcaatgtagctttgggcaagtcacatatcctctgtatataatttttctcatttgtggggtgcagatataagtggtggctatcttggagggttgcaaagaagagcacttccttggccaatagtgtgccctctgtcatgaatatttccctgctatcattgtaacttaacttttgttgctattttaacaaccaaatcatgactatttgttatcacttctgggcctttaaagttgctgcttttcccacctagagcattttcccccaagatagtcacagggctggcaacctctaatcttttagcagcttgaatgtcattcctcaaaaaagcctccctgactgctggttctgcccttgccctggtcactctctagccctgggctttatttcattttctttatggatcctatcaccatctgaaattcttcactaatttgcttgattattagctttctccctctgctgaaatgtaacacatgtgagaccagagcctccttagtctcatttaccaatgttaacagcaaccagaatcgtgcctagcatatagcaagtgcaccagaaactttgttgaaaaaatgttttgggtccatgaaaacttccaaacatgtttcagatgttcagatgactttttctttttaacttgctctcctccaccccatatcaatgcaatggatatttgaaaactaaatccagaacctgaatttatcctcaataaatttgacttttcatattccattcagagttctggtattcctatattgttttcaatttaatgctagactttatattaattaagataattttatggtaacaataacattatgcatgcattgagtgtttgctacatatgaagcacttataaatttttacatataatctcatttaatttttaaaacaaccctatgaaatacataacatttttattcccatttttataaatgagaaagctgaggtacaatgagggctggtaattgggcaaagtcccacagctagtaagttatagagttgggatttgaacccaggccttcagatatcatcaactgaataattcatcagtgtcatgaggaattttctgaactttgtatgacttgaaactttgtgatgttttgtctgtatctatatacaagtcatgataagatgcctcataataataccaagcctctgtgatattccagtactttttattctggttactactgaaccaagaattattatattttagtcatattgtcaatgagttcactacccacagagctgaggacataaggctgctgtggaaaagggagtaaacacttattaaaagccaggataggcaatgtggcattcctgtaaagcactaattagtattttcagcagaaatatgttttaccaaacctattttgctgtcatttgaaagcatgttattttctgcatgttcacatttcaccttgcttcccagagtgtttacagcaacttgccacagtaacacatactaaaataatggtatgatacacaagtaagaataaaaaatgtgatctagagaaaaataagagttaaacacaagaccctagggtggaggatggtctgagagagagataaatatttaggccttaaggaaccacacacagttcccctggttgagccacaaattggtatgtttttttccttatgtacaggttttttttttattatactttaagttttagggtacatgtgcacaacgtgcaggtttgttacatatgtatacatgtgccatgttggtgtgctgcacccattaactcgtcatttagcattaggtatatctcctaatgctatccctccccctgccccccatcccacaacagtccccggtgtgtgatgttccccttcctgtgtccatgtgttctcattgttcaattcccacctatgagtgagaacatgtggtgtttggttttttgttcttgcgatagtttgctgagaatgatggtttccagcttcatccatgtccctacaaaggacatgaactcatctctattcttttattagccaccaggaagctttaaaaaaaatacccagaacaaattggtatttttttttaaagcttcctggtggctaacaaaagaatagagaagcaatcagttcttactgtcagttagaaaaagctatcccagttattcaagagaaacacagtatagcttgagactatatgtctccataggcctttttgtaagaagtattcagtgatataatttcccctatagcagacctacaatgaactgcttagtttcatgtcactgctgctcatattgtcctttgctaaaagctgagaatatgacactaaaacgagattcaaggaaagaaaatctgtaaaggatggaaaacgcagatagtatgttcaaaaggttagatagaacttggaggatcatttattcttcttacatcctccataaatacatagcttacctgggattttgaataaatgtgggcagcagaccattcaaagtaagattatctggaaagtgcttggagtttctgagtggtttgctgttggatccatttgttttagaaaatgaatgagaatacatggaggattatagccttttctggaaattaaggacctaaccaagttttttgttttttgaattaaagggccctgtccatatctatatataagtgagaaactgactttattggatgtctctagtgtttattcattccttgttccttcgtttattccttcaacaaatatttattcagcccctactatgccctagatacctaagctatagcagtgaaaaagacaggtatgatctctccttcaatagagtatacattttaagaggcaaggcaaacactaaacaagatactaattatacagttacaatcttgataagatctactaaagacaagtacaggtcggaaagtaagcacaaaaatgagaaactcaattccatttttacagcttccttacattatagatgatgttacctctaagatttttttcttttttcttttcctttcttttctttctttctttctttctttctttcttttttttttttttttttttttttgagacagagtcttgctgtgttgctaggctggagtgtagtggcgcaatctcagtccactgcaacctccacctcccgggtttaagcgattctcctgcctcagcctcctgagtagctgagactacaggtgtgcaccaccatgcccagctaatttttgtatttttagtagagatggggtttcaccacgttggccaggatggtctcgatctcttgactttgtgatctgcctgcctcggcctcccaaagtgctgggattatagatgtgagccaccgcggccggccacctctaagatattaacagccttctaatcactaaatccaatgtcctcttctaatctttagaaatgttcatattcgttggcatgggaatataaccatgaggtttaaagtttctgcttgtgcctttgtttgtagcagataaaatcttttgtttaaaagaaataaagcctacttgaagtccataaagagaaaacagatgaaatctggactgctttgtttggagatgcctcatgggaaggtgggagctctggctttccccacacttggtaatctcaggatcgtcttttcttgatccccatggtgctagtttggaagccactattctagaattctcattattatcagctatttatgtattggctccctggcagccctaaagactctgcctggactgacacatcccagtcctattcccagttctgtgccggagtctctgaacacttcttgaactgatctgagccaagaaagaaacttggacatctttggatttgtgaaatccaaactggaccctcttcatttgctgtgatttcccacccatgattacagttcacactctacttactaccaggtctccaaccaacacctcatttattagtccatctcctgtgtgtgcatggattggtgagggaaattagaaggaaaggaagatgattgcatccatcaattgaatcaatgtattctgggctccaaatatgtgctaagcattgtccaaggaagctgagggtataactatgaacaaaagaaacaaaaatacctgcactcttggaacatacattctaatggaggatatagacagtaaatacatcagaaattaaaattgtataacaggtggtgataagttcgttggggagaaaataaccaaagaaaaaggatagggtatgtcagggtgaggaggaccaaggtttactactttaacgaatgatgtaaaagattgcctgagtgagaaggtggcatttgaggaaagatgggtaggaatgagtgatacaggtgtctgcaggaaaagcattgcaaacagaggaagcagaaagtataatggagcttagttaggagcctggtatgtttgagaaacaacaaagaggtcgtgtggctaaagcaaagtaagagatgagactagaaaagtggcagaggagcagatcctgaattgtcctgtaggccattttgaggactttgggttctactctcaggaataactgggaagaagagtgacacgatctgtcttcagttttgaaaagatcaccctggctactgtgtggaaaatggaatgaagggggcaacgggaggtgcaggaacatcatttgggagtggttgacacaaaacaagcaagcaataaggggaaggaggggggataatttgttcaagtaagcctctttctctgttccatttgattggaacaaatggtacaacttagcagaatgtccagtaatagaggagaaagcaaataaaaattcaaagatattgagatagtacctgagtggtaatttaattaatggaaaaggaaatctcagaaagagatgtttttgcctaagggctagttgtgaaagatgaccctgaggctcaataaattgccttccattgtcagtggtatgtgcgtgtgtagataattaaagaggtgagaataaaaatagagggaaaagtcaaggattgagttttcaattttagagtttctatatatggagtactgtgtggtttataaaacactggtatttaatatattttattactatataaatgaatgaactacgtttcccaaacatctttctacgtgtgaagcaaaaaaaaaaaaaaaaaaaaaaaaaaaccacacagaaaaaaaacaagcaagcaaacaaaaacagagggaacaagagtttagagaagtcaaagaaatagtattcaattttctgtttagtaccatttattcagtgttcagtgtcaatgaggttatgagaaatattctagatactggagatacaaatataaatgaaacacagttcttgcccttaagaagcccacagtcaaatggaaaatatatagaaataaatagcactgtaatgtgataggcagacaggattgcttaattctcactgaaagattcagatcagagttaccctctgtgcagcttcttgatggatgatggggagggccagcatctggggttggagaaaagaaaggtgggtctcagggaagaaattccatgtgccaagatacagaggggtaaaattatgtggccttttcagtatatgaaagcagtgattcacagaacttagatgatacaccttgacaagatactcaagactcccaagacaagacactcaagagagtgtcttgaaaatagagtctttaaggagtaattcaattaaaattatggcattagtgcagactgtaattcaatacgactggtgtctttgtaagaagagaatgtccctataagaagatactcaagaattccaagataagacactcttgtgtcttgggagaaattctcatcttgggagtcttgagtgtcttgtccaggtgtatcatctagtacagaaaatagctcaaaaattgtgatagccttgagaatatattttacattacttactgtcgaaactgggactgtttttatcacaaaaaggggcactattaataattacactggaatgggtataaattaaagcagtctggggaaacccaaacatatggtcaacctaatgatacctgttttcctgcataaaggggttataattgtactaatttatggtgcaaactgggtgctaaagctagtgatgagtttctctgctagaaaaatgttccaaagaaataaaccaagacagttaatgcagagttttggtagaagggataactacttttagatggtaggtcacagaagcttgtccgaggtgaggactttgggctgagtcctgaatacaaacagccagctatgggaagctccatggcaggagtgctccagggagagggaatcccaaaagccctttgtgggagtccttctgttagagaagacctgtttggatggagaatacaaaaccaggggggcttgggagatgaggtccgagacataaggagaggctagttcatgttcagccatgtacatgtggtggggaatttgagttttattctaattggtggaagcacagcaggtgatagagcatacctcacgtactagtttacaagggctgccttcacaaagtaccctggactgggtgacttaaacaatagaaatttatttcctcgcagttctgcagggtggacctcccaaatcaaggtcctggctgagttggtgccttttgagggctgtgagagaaggatctgttccagaactttcttcttggcttttagatggctgtcttctccctgtttctttacattgtcttcctgctgaacatgtctgtgtccaagtttcctcttcttataaggacgccagtcatattggactagggtccgccctcatgccataattttaattgaattacttcttaaagaccctatcttcaaatatggtaagcctctgtggtattggggtttagatttcaacatacgagtgtttggagggacagaattcagcccacaacacctcattaagcctggaagagaccgtaagaatattcgattaactggataagaagcacttaaacccaatttctaagaaaagagggataaaaaggtatactgtttccaggtatagtatgaaggtcatgatataaaacagaaagaagctttttagaagggaacaaaaaacactggggcttacttcaggagggatggtagaaggagaaagaggagcagaaaaaataactattggatactagggttattaccttggtgattaactgatctgtgcaacaaatcctatgataggagttcacctatacaacagacctgcacatgtacccttaaaccgaaaattaaagttaaaaaaaggaaagaagccttatacagaggactatatatagccttatataaaggactatattaagaattcttgtgagaagtcattatttaggtgtcaggcatctatagccatttaaacagagtctgtgtgtaacagtcttgagctgctgatgaaagaaggtgtagaagagtgttggtgccaagatctggagtggagtggtaggatcctgacctggagcacccaggaatgactgtcctttgtgcacaggtgatagacaaaactgggggaatgaggagttgaacatggaggtatatgaggaaggctcatccgctcttcagaaatccagaaacctaagtgtgaaaacacagatttgagggcctccacctgacttggtgggatgctcttcataggagatattctcctaatgtacattacaaagtcaatctaggagtaatgtaaaagtgatagttatcttaaacaacctgaatattttctagatatgtgattttgcaaaaataaaaaaaataaaaaaataaaaaaatgaaaaaaaaaaaaaaaggccaggcatggtagctcacgcctgtaatcccagcactttgggaggccaaggcaggcagatcacctgaggtggagagttcaagacaagcctgacaaacatggagaaacctcgtctctactaaaaatacaaaattagccgggcgtggtggcgcatgcccgtaatcccagctattcaggaggctgaggcgggagaatcgcttgaacctgggaggcagaggttgcagtaggccgagatcacgccattgcactccagcgtgggcaacaagagcgaaactccatctcaaaaaaaaaaaaaaaaaaaaaagagagagagagagaaaagaaatatctgtgttaggaaaaaagctaggaaaagctaaattctggtcatttcataataaaacgaataatgaaacaaacagaaaaatattttatgtggaagaacagaacagagaccttgggcagaagtaaccatgacacgttggggtttgtataagtaataaacgctgagatatatgccttaaactttagactgtctgagatcagtttaaggcaaagatagaatattatgactaaagagcgtaaaatgaactgctgagcatgcaagtaccataaaaaggcccttccttcagaattgagctgatccatattttttctcttgatttcattttctacttaggaactcagttcttgacaggccacatatacaatgaatgtcccaaagattgcaatactgtatttttactgtatattttttatgtgtaggtacacaaatatttactattgtgtaacagttgcctgcagtattcagtacaatcacaagctgcacaggtttgtagcctaggagcataccatatagttcaggtgtgtagaggttacaccatccaggtttgtgtaagtatgctctataatgttcacacaaagatgaaatcacccaatgatgcatttcttagaatatttcctcatcgttacgtgaagcatgactatgtaagcattgagaatatgaatacacatgatttccaccaagagaaagcatgtgatcccaaatataattggtaaactagtattaaaattttttatatgtctttctcaatatctgttatatgagacacacttgtttcacatagaacagatgaactatttgttttccatcactagaatatttttcttctaaaacttttgacctatttgggattgaaataaatgacttctaaatttccatccattgctaatatctgtaattctgtgtattacagataattggctaattacctgagtatggtgttgcttttttcaatttataacagtttagaccttttaggatacagttgttgaaatatggcaccaaaacactaagcatcttatattgatcgtgtgtcaatttacctaaccttggcaattattttcaatatctattttccaaggaaagaaatgagtagttattatcaaattacacaagtggagaagaattggagtttaggtaaatattttgttctaaaatatcaaatggtcatttaagctgaattgggataaaacaacccctatgaattttgctggatggacaccataaatgacagcaaccctgttcttctgttttcatcatagtcaaaaaatgctttagagtttactacttctacatatctcatttagttttcataatggagattttctaatgcatgttttatagatgagcaaacaaattgaagatgttaagtgacttgttcaaagtcatatatgtgaacacatattgaacataacttatttggccttattactataatggtcattagaatatctttaaaaatataattttttaatcaattgacattacacaatttttatttgaagctttcaaaattaacagtaataatgttattttattaagcacttattatatttcagtcacagtgctaagcacgtcacagtcatcatctaatttactcaatctgaaggtatgccattctctgaaaatggcaatatacgcttacaattatttgtagcatagcattctacactaaaaagatgaaataaagaagttgaaattttctttatcaattaggatagctaatgatcttctgtggcaacaatcagcatgtcttacagcttaaaacaacaacgtttacttctcatccaccttacatcctatctttggtgtacctggagctctgtctcatgtcgtccccactcagagactcacgctgatggagcagccacaatctagagcctggcctgccacagtggtagaggaaaagacagactggtgaactgtgcagtgatccctaacacttctgcccagaggtgatgccagtcaccttgatcgaagcaagtcaatggctacatcaaatatcaaaaaagtgggaagtgaaatcttaaaacaccccggaaaatactggaaatttttattttagttttacttgaaaaaagtataaattttgattttctgtattaaatcacttattcaaacaatgatttattcaacagaaagcattgaacactgtatttcttttctgacaaccacttctccaattctctgacaccaactgggtgcccaacaattttattcaattctgatactacctggagttagcacagatcccccaggttaaggactcagtctcacaagacttctgctactctagacaccagacactgtacatggagtgctcgggctacccacagttttgtgcagctgaccacaaattgggggttctcatgaccccctccacccctcagtttccataattcagtagagccactcacagaaccacgacatgttctttatttgcaattattggtttattataaaggattcaacttaggaacagccaaattgaagagatgtattggacaaaacatgaggaagaggacccagagcatagatgccctctcctggcacactgccctgccagcatgatgatatgttcaccaatctggaagatcctcaaaccccatcttttagagttttgtgtccaggattcattaaggtagacatgattgattatacattgcccattggtgattgaactcaatctccagcccttctctccaacccagatgtcagggacggggaccttcagttctgttcctctaatccagtagtttttaatgtaatcagtcctcatcctaaagcaaaaagctacccttttctcccccatgagttatttcattagggatcttaaatagaagactattccttcagaagattttaggagctttgtgccaggaagctgggagaaagatttttttgttgttgttacactacacacagccatatgctgagcttggtgcaaggcacgggggatacagtggttaatggagcagacacagtccttgtcctcatgaaacttcaagttaggcaaactcattgaaatgaagatcagtctagagaagttagtaaaactgaaacaaagataaataaaacatgaacttgattcacagaaacacttacctccatatatgaataacatcaattagtaaactgggaggaggaaggaggtgctgggtgtggaatggacgggaaaaatggagaagtcaacactgaatttctaatcacctaaatcactttaagtctcatctttttgacatggtgatggtcaaagattggcacattattcttatcaaagcacaggatagggtgctaggtggaggaaccaggaaagattagtcagagaagatgccttgaaattctatgttagattgtcatctaggttatacagctcatggacaaaaatacatgcataaaatgatgcccacatggattaatggatacatgaaattttaaattcctagacaaacatataaatcaatgaattattaagtttatactagttgtatatgggactatttgatattgcttactttgttctttgaattttgcatttaggagatttgtagtatgagtttcttgcagaaatcttaacatttccttaaaaaaccacttccctaaaataatccttgaggaaacatatttgtcagaaatgttcacatcatattccttttgttctggtttatctcatcctccttgacttctccacatctctaagtaggaagttatttattgctgctgaagttgtaaccctggtgatttcgctatcaacttacaaatcacttcctttccatatgactacagcatgtaagaatgctgaggttttcttttctccaaataaggcagaatgcttcaagaatattttatcgtcctatatggatattctatacctttagagtgaacactttcctctattaaaacattaacagtcataatgagattcagtccaactggaccgagcttgtgaataaaacaagatgctccagtctgtggttcaaacattttgaacttcccagaatataattaggtatagaatatagttcttatctttctttgagaactttttgaattattgttatagtttctaaaatatcttttctattttgagggtaaggtcacaaaacagaaaaaaatgtgtatcagagtatgttgaatatggctgtttgtcagatcaagtttacgctgtgtatgggccttcgtccaatttagatgcagatggtataagggactttgaatatgctatattattattcagctgacttctccagtaaataatagtgttcttcaggaacagaaaaccaaacgccacatgttctcactcataaatgggagctgaacaatgagaacacatggacacagggaggggaacatcacatacactggggcctgtaggtggaggggagcagggggagggagagcatcaggataaatagctaatgcatgtggggcttaatacctaggtgatgggttgataggtgcagcacatcaccatggcacatgtttacctatgtaacaaacctgcatgtcctgtacatgtatcccagaccccaaaataaaattaaaaaaataataatagtgttctttagcgtctttcatgtgaatggaagttttgcagacattgtcacagcagcattttttcccgtgggtttccactaagtggtgccttcgccttgggggaaaggtgtctcagtcttattccagtctgcttcatttactgttgatgtgatgattgctgcctatgtagtatgtgactttctagggacaggcggtcaggtttttctggacccctctttctctgaggatctcttcaaaggaatagcctttggccttgagtgctgcctcgagcccacaagcaccttctcatggttgagcacaccctattgcttgactcagtgaaatacattgaatatcctgccaacactttttgttgtacatctctttgccctcaggctagctacagaaagaaaaagagagagagaatacatttttacatttcctgttcttcatgttgaatgaggcagtttatcttctgaacagctgctttgaaggtttgagtatgttcgatgcactaaacataacagcatagaaatgaaaaaaggaggttggcaaactaccttcttatcttcttttaaggcttttgaaggatttaagttgtttcaccttttagtggcatcacagagaggttgagatttcacttagagagaatggctttgatgtgctattttgtatattagtgaacaggttcacaaagatgccattctctaatcaatgctcctgctcccacaagacagaagagaattgaggaattaaggaaatgccaagaggtagaacatccagtatctttggtggagatcttgctttgctatgtttccttccttcaagttatttgatctgtgcgtgtgcctgagcatttattgtacaacagatactgtgctaaggcttttataagctttgtattgcttaatgttcatggcagccttgggaagaaggtactgttagagtaggaatgctactataatcttccaactgggttgacattaattccttaacctgctctttttgacttttcttcttcaacccattgataatctaattgtcctatatttctgtaaggttattctaaggtattttttgagattccttattaagaccattaatacggctgggcatggtggctcatgcctataatcccagcactttgggaggctgaggcgggtggatcacctgaggccaggagttcgagaccagcctgaccaatatggtgaaacaccatctctaccaaatacaaaaaattagcagggcgtggtggcacacgcctataatcccagctacttgggaggctgaggcaggagaatcacttgaaccctggaggtggaggttgcagtgagccgagatcgtgccattgcactccagcctgggcactctgtctcaaaaaacaaacaaacaaaaaaactttaatacgtgtgagtatagtagtgaacaattattatgggcttagtaagtgccaggttttatcttaagtagtttatgtgcaaacccgataacacccaaacaaccatgtaaaatagatatcataagccctattgtattttaaatgaagaagagatgataagagacatccctaagctcccactgacataaaatacagacaccaggatttgaactgggcccatcttactacagagcctcaggatttaacccccactcttccagttttcttcatggcctattgtcagagtagaaacattatttctattctgaacatgggctgtgctcaataaattattgcttcatctccttgatgataacaaaccattgcctttcttaaaagtcttttctaaaaaattttagcctagtaatttcaaaaaaaagtaaagcagtaaaatacgtcatcctgtaaagtctaaagatttgaaatttaaaagttttcaggctagagaacagaacttgatgtaatttctagaagtgaaataactcttgttaaaatcagatgctgctggtacgcaatccaaaagggattgtttagaccctagaagcttcaaataaattgagtctcagaaataggggggaattgagtcacacagttctgattgtttttgtcaacctactgaagaggaacaggagcacccttccgaaagagttcagagctgagtgtgagtattcacaagcaagaacctctggcacatcttcatctttataattccaatagcaatggcaaacaagaagactcaatgtttaacttcagatttcattagacggagagccgtgtttacaatcagctgactcatttgagcgttctgacaagctctcaatcctatctggatctgttaggttgtcttttaaaagaggaaatatttcaacagagataatattcctataagctgtgaaagtctgtctagaaatcaattgttaagcaacctatagagtttagagcagaaaaagctacaaaatgaagtaaatttttatagtggtttctagtgagaaacaatgtatgccctaggtgcagtgggccatggagaacatttattacattcttcttgtatgaacactgatatacgaagaaaataaaagctcagcttttgccttataacactacacttgccatggtacacttcaaaattcacacatgcatagggagattatttacacatgtgcaaaactaggaaaataaaataatgtgaaaacatactagttaaatgtgattgtgcagctcttttacttctattctggattggtgtttttgccaaaccctccctatgtcaacacaggtgacccctctgaaaggaacgtgccaattatagttgacaaaggggcttggtgcactgaatcttgagaaatgatcttgaatgacctccaggatttaaatatagttattgaaaggggccgaaccaatgagatgattcacagcttccgcatggagccatctctatatgctaagtacgaggccagtcctcataaaaacccgccaaggagggcagtagcaccattgttaccagcacagactcctccctttcctagctgtgtgaccttaaggagaaatatacactccagaaatctgctgcttcttctctgaaaagggcacaacaatagtcgcccattgtagagaggattaatgggataattatattatgtaaaactcactgaagtattttgtttacatagggactattcaataaacataaaaattataattattacagttgttataattccccttttacagctgaggaaactcccaagaccacagaataagtggaaaagttgaaattggaacctacctctttttgactccaaatgaagtgttctttttaataggtacagtagttcccacctattcatgagagataccttccaagacccccagtggaagcctgaaaccacagccagcaccaaaccctatatacactgtgtttttcctacatatacctatgataaagtttaatttataaattaggcagagtaagagttcaacaacagtaattaaaaaaatagaacaactgtaaaaataatcctgtaatgaaagttatgtgaatgtggtctttctctcttatatatttctggaatattccatttaatatttttggactgaaactgtggaaagcaaaacagtgaataaatactgtaattagtgttcattgataacataattttggccaagtgcagtggctcacacctgtaatgccagcactttgagaggccaaggtaggttcatcacttgagcccaagagttcaagaccagcctgggcaacatggtgaaaccttgtctctaaaaataaaataaaatacaaaattatatatatatatataatgtatatttatatataatatatatttatatataatatatatatttattatatatataattatatattatgtaatatatataaaatatatattatatattatataattatatataatataaaatatatattatatattatatatatattatatatattatatatataaaatatattatatattatatatttatatatattatatattatatataatttatataaatatataatatattatatatataatatatatataatatataatatatttatatatatatataatatatataatatatatataatatataatatatttatatatatatataatatatataatatatatataatatataatatatttttatatatatatataatatatatatgccaaatgtggtgatgcactcctgtagtctcagctactctggaggctgaagtgggaggatctcttgagcccaggaggttgaggcttcagtgagtcgtgattgtgccactgcactccggcctaagtgttggagtgagaccctcaaaaaaaaaaaaaaagtttttttcagaattccgactatatgccaagcactctgttgggtgctgatcaacaaggtagactaagtctttccttatggagcccacattccagctgcctctgacaatgcttttccccatggcactcagaatcctgattcctgagtcctacagaacattctgtaacttggtaattctgaggctgccttggggaacaagcgtaaggaggagggtttcctcagagcagaaaggagggaatgtttttcctgcaattagagagtgcagtgacagtggcaaccacagtagcctcatagagcaccagggatgacagggaagaaagtgaatgctgacctcggctgaaacagcgctggcagcttcagcagatatattacatggtacttaccattacttcatacagtgttgagagttttggctcttgagcagaatttctgggtctgtattttacctatgctgctcatgcattttatgatcctatgtgggttatttaagctttttgtgcctcatctataagattgagaccattatgatattgatttcataggtactttgcaggcaggattacctatctgagagaaacttgatttatttctttgatgcatgcaaacttaagcttgccaatgctcatatttgtgcatttttccccacacaggacagtgcagtcgttaaggcaccatggttagtgtcatctctacatgcctcagcctatctcaaggtctcctttggacagtttgcaaatgagtgcctgcctgagtctctatatctgagggagtcctctgcctgggggagcttatctgcccatgctcaagacatgagggctagaatttgtagataaatacaacagcttccttgtcccttggagatgattctcagacatattccacaatctctcagaggctccctggtggtaccaaatcccagttgtccacagcaatagtggggttgttaaccagctttcctcccttctctgtctcactgccccacttcctcaatttgctctctgggatcttcccccaaataaatgacatgctcccaaatccttgtctcaaggtcttgttttaggaggaaccccaggcaaaggtagttacagattttagagcaggacttcctcctgcaaattctgacttcattacttacagggattttttttttaatactttaagttttagggtacatgtgcacaatgtgcaggtttgttacatatgtatacatgtgccatgttggtgtgccgcacccagtaactcgtcatttaacattaggtatatctcctaattctatccctcccccttactcccaccccacaacaggccctggtgtgtgatgttccccttcctgtgtccatgtgttctcattgttcaattccaacctgtgagtgagaacatgcggtgtttggttttttgtccttgcgatagtttgctcagaatgatggtttccagcttcatccatgtccctacaaaggacatgaactcatccttttttatggctgcatagtattccatggtgtttgtgtgccacattttctgaatccagtctatcattgttggacatttgggttggttccaagtctttgctattgtgaattagtgcctcaataaacatacgtgtgcatgtgtctttatagtagcatgatttataatcctttgggtatatacccagtaatgggattgctgggtcaaatggtatttttagttctagattgaggaattgccacactgtcttccacaatggttgaactagtttacactcccaccaacagtgtaaaagcattcctatctctccacatcctctccagcatctgttatttcctgaatttttaatgatctccattctaactggtatgagatggtatctcactgtggtcttgatttgcatttctctgatgcccagtgatgacgagcattttttcatgtgttttttggctgcataaatgtcttcttttgagaagtgtctgttcatatccttcgcccactttttgaagtggttgtttgattttttcttgtaaatttgtttaagttctttgtagattctggatattagccctttatttaatttttattttgagttcaggggtacatgtgcatgttttttatatagataaacttatgtcatggaggtttgttatacagattatttcatcacccaataattaagcctagtacccattagttatttttcctgatcctcttcctcctcccaccctctaccctccaaaaggccccagtgtgtgttgttcccctctatttattcatatgttcacataatttagctcccacttataagtgagaacatgcagtattcagttttctgttcctgcattagtttgctaaggataatggcctctagctccatccatgatcctgtaaaggacacgatctcattcttttttatggctgcatagtattccatggtgcatatgctttatcaagtctatcgttaatgggcatttgggttgattccatgactttgctatcgtacagtgcttcagtgaacatacacatgcatgtgtctttataataggatgatttatattcctttgggtatatatccagtaatgggattgctagatcaaatggtattcagacaagcaaatgctaaggaaatttgttaccacaagaccttccttataagggaagcattaaatatggagagaaaagaccattatttacagtttttaaattaaggaaatgattaaacacttcattatttcaattttctcatgtctaaggaaggtatgatgataaaagctacatgatattttttgtgaagcttagctgaaacagtacctgtcaagtgcttctagaccattgcaagttttcaataaatgttagcttttattattattattattaatgtcagcctaccttaaaacttctttaaatagatggcatgaacagctgtagataactgcagggtgtaaaaattctggcagctttttttatacctgtttaaactctttgagcttaacgctcttcaagttccctgctggcctgtaagtaatagaccaatgtcagtggaggagacatgtagatgttaagaatgaactaagtttgtaaggtaaaaagccaggcttcctatatgcctcagcagatggtctgataaggacgctgagagagagtatcatgaaatagaagtgaagtggattaacaagaaaatccatgttcctggcacactaaggtgataagtaaatggttttctgtggctttgctaaaattttgaaaaattcagttagcagcaccgttgcctaaacatagtatggtatgttaagaaggaggattctaacaagcacttgttaagtgcctattgtaattaagacaaatatgatttggtttgtgctctcaagtctggtgggagagataggcatgtaaacagatgaattacagcacgaagtgctactgctgcaccaagacaggcaaataattcacttaagctaaggcagggaagaaagaaggaaggggatttttatatacttttatctgcgctgaaggtggctttacagatgaggaacccgaaactcaaagaatgtatgtcaattcattaaggcatgcagctgctaagtggggagccagcatttgaatcaaactttctttccccaaggttgtctccatcatgccaggctgtagtggtgacaggtggaaaggtgtagtgagccatcttctaggtatatctatccctgagagcaacaaatcctggtggttctctctgtatatagtcacagagctccagggcatgtagtacttagaattttgtttttgctcattgcacaggaaatggtatgaaactgaggtaattcatacacacataatttgaatataaagaagaaaatgatagaggcatctggatgacctgatatttaatatagtaaaaggaaaatgttttcctaagcaaaatgagtggtatacaatgaataagttgtggtcaggaaccatgtccccagagttttggcttttatcctttcattgattcacaacatgaatttttttttcctaaatatccttcactagaaggcagaattaatcaacctttgtaatttaacagattatttggatacaaaactaatgatatttttattcaaacatgtcaagaccttggggatatagcatgggatttggggagcaggttggttgttgggggcagtcgtctaaagaatcagtaacatttgagtgcctaaaatattaattattgtcctaccagcaatactgttctctgtccttaatgatgaattaagagattagaaaatagtaaaaaaataaaaacaaggacataatttccatgcgataatgataggactttgtgatatcacatttaaaaagtaggtgacttttatgagagaggaagtgaggaaaagaagccagcatttattgaatgcttgctgcaggcttctgtgccatgggtattaatagtcccattttacagatgaggaccctgagaatcatatatttagtgtcaaatgctttacctaaaagggcaaaagtataactagaacaaaagttcaatgcttaactctgaaaaaatctgttctctttgctacagaccatgccatcttggtgaaaatatcccaaaagatctggggttgagttacagtgccaaaggggagaggaatgtaatattgcaattagatgatgagagattgtcttaggaacactgaagtacactggcaaattttgggaagcagagataaattatgttgctaaaagccaaggaaggctgggcgcggtggctcacacctgtaatcccattactttgagaggccgaggcaggtggatcacctgagatcaggagttcgagaccagtccggccaacgtggcaaaaccctgtctctactacaaaattagctgggcatggtggcaggcacccataatcccagctactcaggaggctgaggcaggagaatctcttgaacccgggagatggaggttgcagtaagccaagattgcgccattgcactccagcctgggagacagagcaagactccatctctaaattaattaattaattaattaatttttttaaaaagccaaggaaatcatttggctagagagtgtgagcttgagaattggatagaagtaggggaagttaggctctgtggcactgggtggtggaaagtctgcagtcagcactttgatcaggtcaaacccagtaatatttttgaactcttatttttctctgtcaggtgccagcaagcaaaactgagtaaggaaataatagtttatggccttatattttagttagtttgagtacctgttgacaggtggtccaatttttgtgtttaatttagaagaaattctgaaggatgaggtttaataatcacaattgaagtagtggatatgggatcagagtctgattgcattggatacaatattccaagatcactgaatgatacaactcctgcaaaaaggatgctatgacaatataagcataaagccgcagggaagtggacagaggtcttaagggttggaaaaaggagtgggcacatttgtgaaatgtagcagagctatgggatttggactttgcaatgtacttgtacagtaggactaaagcagacaagcatagaatgcatgccattaattcttagccttgaggcataccttctcaataattaggagaatgaaaagaggtgttttttatatatccttccacctttatatatattttttattgttcaatgaagtagaaccctgtataaagaggagttcagggaatctattaaaaatccagggtaccttctatgtcctagtcagagttcttggagttgttgaattataaaaatatgacatcccaacacacactgtagggatcaaaacctaggtgtgtggcaggaagatagctcataggcaattccaatatttgcagttgaaatttggcatgaaacactgacaatttgcatcgtctgtccatccttcatgagctgatgatgcccaatgcttgtctcacatggcaggtctcacttcgtactgaaatgatgaagttacttctctgcctccaacactagattgtgtgttgcctgagggcaggagcaatgtcatcctttttgactttctggcacttaaaacagaatgtggctcatagttggaggtcagtacatatttgaatggaagaatgcatgaaaatataaacgttagactcttcccttatggttattgttttagtttataaagtagatgtaaatatagcccaagataacatagcaatttggcaattctccatgaattttctgtaatagaatatttcagtaagcacagtatacttcctgttttaactttgtggctaactgatctttagttatttgacagatatttttctggcaggcaatgcgctaaacattgggggttctctgcaactgttttttattttaagtggtaaagttgctcttttaattcaaatttgttttttaattgacttataaacttgtatgtatttatagtgtacaacatgatgcttcgaagtgtcaataatcaaatggttaaatctagctaatttaatcataatttaaatagctagatctaaccattttgttattgacacttcaaaacacacaaacacacataatgaaatggtcaaatctagctaattaacaaatacattacctcacatagttatcatctttatggtgagaacatttcacatccactctctgagcatttttgaaaaatacagtatatcatcattaactatagtctctagactgtataatagatctcttgaaattatttctcctaactaactgaaaatatgtatgccttggaccaacatctccccactccccacccccaaccaccccagcttctggtacccacccatcttcagctgtttgtaaatacctacggttgatgaggaaatgcatttgttgaaatatactgaagcctgtggattattgtaataatccttttatgctatcaaagatttactgctctttgagcttaccttagttgggtcttgtaaattgagtgttatttgagaacagaacacaggagggcaccagaggacaagaaaacgacaaccaaaaaaaaaaaaaaaaaaaccccaaaaccaaagcactgaacttctggctctagaatagagaccctgctaaatgtatcatctctcagcagtccatttctattaagtcttattctttaaaggccatgaggtatttgtaaacacgagagctttccaaactttcattaaaggaaagtgtccctttcccagacaatgcttccagctcagtcagatgcccaagcatgaccagaaggagacatggatgaagagaacccagggggtgtctttgcacacatgatgctctaaagcattttcagatctcctctatgggcccagcaagagtgctgtttctgaggaagaaggcagattgctggacggattcacaaaccacggcagctccaactctcctaccgatgcctttactccaggtgcctcagccagtagcaacaggtctccctgttggtgatacccaagggcaccatttaagaagaaataaaaaatgatgagttcatgtcctttgtagggacatggatgaagctagaaaccatcattctcagcaaactatcacaaggagaaaaaaccaaacactgcatgttctcactcataggtgggaattgaacagtgagaacacatggacacaggaaggggaacatcacacactgggcactgttgtggggtggggggagtggggagggatagcattaggagatatacctaatgctaaatgatgagttaatgggtgcagcacaccaacatggcacatgtatacatatgtaacagacctacacgttgtgcacatgtaccctaaaacttaaagtgtaataataataataataataataataaaagaagaaatagacaatgggcttaagtgttcactcacctcctgtgcttccctgggcctacggttatggctcctaggcatatgggagaggttgagtcagtcactgtggcttagaggctgcagtgccttatcaatttctggcattgaattatgactagaatttgaaaaacatcaaacatggcttccatgacatcatagtctcagctcagtatgtcactgagaggttgtagtagtttgcagatgacagtgatcaatgaaaacccaatttatttgactcaaagggctgtggatatatgtacgtgaaaatgtattctacagccctaacctgctgcatctggctctggaattccaggtccacatttctgagtatctgctagtcatttccatgtatagagccatcccttggtatctccaggggactggttccagaacttcaaaggaactcaaatttgaggatgctcaaatccctgacaaaatggcatagtatttgcatgtaacctatgcccaccctctcacatactgtaaaatcatctctagattacttgtaataaataatacaatgaaaatgctatgtacacagttgttactgtttcgagaatattgacaaggaaaaagttctgcgtgtgtttagtacagaggcaaggttttgagaatattttaaatccagagctggtcgaatccacagatgtggacccctcagatatgaaggatcatctgtttatcccaccatctcatactcaggatgtttaaaatagagctaatagctgtttctttctcaaacccagctcttcttttctttgtttcatctaaattaagtagcaagaccaagttttccaggctggaaaagtgtaagtgatcctcaactttgtccccccaccttccattcctatcattcagggggtcacctcaaccatctcttctatttatacctttcattcatttcactctgctatagagcattttgaattcaggatttatttacctcctttctaagtaagttgaatggcctttctgtgctttttctgttctggtcttcacgtaatccgcttcacattctttttaaattcacctttcccaagattcatcattgcttacaggacaatgtccaattccttagcattacatgcagtccatctatctttcctaccttagctctcacttcacagctcataatccctctcctccccaatgtacacaaacacacccacctttccactgtggttcatcttctggctattggttatattttgccttcaattacctctgctggatatggaatagcatagaagttatgcacatgggccctagaactaaactaggggtctgcaaactacaatcagcaggacaaatattccccaccacctcttttcataaataaccatttattggaactcaccaaggaactatggagaaacaaggaagaatttcactataaaagacgccagaggaaaaaagagtacatattgtatggttacatttatataaatctaaaaaatgcaaactaatctctagtgacagaaaacagaaccctggctgctagaggagcagggagaggaagggagtacaaagagccatgagaaaacttttgaggataatgtatatgttgcttatcttgattgtgttgatgttttaatgggtctactcatatatcaaaacttataaaattgtacaccttaaatatgtgcagtgtatcatgtgtccattatacttcaatttaaaagaaaacatggaaaacattcagcatccagtgtccccatagcctcagccacagttagcccgaagagttgcttgtgtcttgatagagagaccactgaagtaatttccacagttcagggttatcattccattgctagttctaagaatcttacccttttcatgcctttggtctctcatcaaagatgtaggatggctggacttactaatcttcaaggcacttttcaaatttctagagtctctctgtggggcaaagtggctcacgcctgtaatcccagcactttgggaggctgaggtgggtggatgacctgagatcaggagttggaaactagcctggccaacatagtgaaaccccgtctttactaaaaatacaaaaaattagccaggtgtggtggcaggcacccgtaatcccagctactcgggaggctgaggcaggagaatcacttgaacccaagaggcgtaggttgcagtaagtccagatcgtgccattgaaaaaaaaaaaaaaaaagaaacaaagaaaagaaaagaaaaagaaaaaaatttctagtctctctgatctccatttaacatgttcagtctacaagtattttggtggtacctaaacttattcaggcagtatgtctgtggtctataaatgtacataccccacctttgctgtagttgatgcctctgctgctgaaatttgtttcttttctaagtgttgcatccctctttgaaacagcaggggctcacctggcaaaacagtcctgtaagcagtagtggagaaacttggctgctcactgttcctgttttgagtaaattacccttcttaattgaacattatatgatttggcttcccaaatttgtgttcttcttttcaaaaatctaacagtaatagagtgtatttagttaggttcaaaatcatattttttaaaaagaaatgcaggaaaaaattcaaaggatgtttaatgagaatatgatagactttgaaatggaagatatcaccaggaaattctccatttcttaggactatataagtgacactgacttcacacagtggttttaaggttgagtgtactgttacaggaatatgtaagctgcttaaaacatttcacaactcatggtcagacaatgttcctttgagaggaaaattcactggcgtttctcaaaaacctgactgcttaaaatccaagtgacccaatgctggccttgcttatttctagggaaagttgccttagcaacctactagcattaagttgcttaaaggaatgtgtgtttaacattgttataagccagaaacagagaaaacagttaacatttagacaagtgattattactggcatccaggtaggctgttggaataaccaggatatgagttgctaatcgttcatttattaatcttcatggaattaaatacagaaaggatgaatacagaggagatcctgtgctggacacattctctgtgttagttcatttattcgtcaccatatccccttgattaaagtgatgatgagtctttccattttgtaacttggagagactgaggctgagagatgtttagatgtttgtccaaggtcacacagctagtacctgctggagcagaaatttgaagccatgtctggctcattcaaaatcctatgttctttctcacaccctgctggctcactacttattgtgaggcatttgaatgatcattcagctatttcctttacctgatgtttttagtttgctggcttcagtttcttagaggcaccctattgggccacatgagagattatagaattatgttgtgatcatggtgggctattatctctgcaaactctcctgacaccatcagtgcaccaggaaggttggataatcctacgtggatgtggagaaatctcaacctttttttatttgacattaggatttttttttccctctaggtggtgttttcactgactttgtggattgcaaaaagttgagtttattttagtttaacagtcaagaatgtggttctttaggacattttctctttagtgtgcctggagcttctaaatcttatttaaaccttctttttgaaatagatgttgcatatctttggctgtaagaggaagtcaggacttgttctctctgcttccagacccactccccagccatgtagactttatatttgaaggtccagagtgatttttcttttttttttttttttgagatggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccagagtgatttttctaaggcaataatctgaccctgtcattcccagcagcatgtagaaaatcaccttgacactccaggtacattcaagtgggctgccccagaggtcatggaacaaaaagcctcctagaccaagctaagatgtgaaattataaattgtttattaaatcaatttaaggtacactttaagcataaatcaaggggaaagtgattggttcaataaacacaggagagtgtgcaagtgggatagaaagactaccatatctcaatccttggttacacaatgttcatctaccttggttccctctctgccatattagtcttccctgctgatgaagtagttacaagaaccagagttgagattaagaaagggatacaacagctgggaaacactggtcctgttacaccattgccctcctggggagacacaagggcaagtatatctggccatagctatcacttgccaattagcctggtgactagatatatgttttatctctatgtatcaaccagagcaaatgtggggccagaatgggaccaaaatggatgtcaccaatgggttgaccagtttagggatgaaggagtcaacagagattgtctgagcttcataaatatttaaggtttactctgtactttcatccctttctatggggaagtaactctcttatttcatcctttttatctttgttcagcacacacgtgctctttttattttctctatgtctcacagctctcagagattatcaatttgctccctacgctttaatccattctataagttccatccaactttttgttgcttgctatgacaaaatcgaataatcttaaataatgcagcaaacacacgttgcagcctgtttaagatattttaagagttctttttgatctaggagataaaacacaaagttttcagtacagcaggttcttgtaagcaggttcttaaaatctcctcctggctacatctttagactcatttcctacctctcataaaaatgccctccactaccctacgacacggaagtactcgacatttgctgaacttgcatgctctcttaatctctatacgtggcagtttttaaaatctcttgtctacctggagcactagttctgcacattcattaaaaagcataagctttgctttctctaacaagtattacttgaacaccactatcttcttaaccccaaactcagacccaaatgtgcatgtatatatgcacacacacactcccaatagcttctctctttccctgtgttccttaggtataatgcaaagaactcatagtagtattaaagcacttaaaacattgtattacatttttatatcactctctactccattagactgtaagtaactttgatccagggatcaaaatatatttctccttttatctccagccactagtcaatgtccagtgtgttataaataagcagtaaatatttgatgagttgttgagttaatgagtaataacaaataaatgttattgtacaacaagttggcagatatttgttccttgaatagaatgatttttataattgtcatttacaaattcagtttagatgggatatttttctcttatttcttcccttgaacgttttcccccaactaccgtgtactcccattactagatttttttataaatcacttaaatatgtttttgtaaattattaatagcagcaagtagtgctgatctgttgggcacctaatgtgtatcaagctgtgaattagaacttgtcttccactggtcccaagagagctggatcagttcacaaccctgcataaatggtagctaggattatgattcagtaggagcatatgtagcctcaagcaggataattagttgtaataagcacataaccacattttctccctgtttctgtgttaggggatggcagtcaattcacactttgaatttcaatgtccataagctgcatttaaatacattcatataaatgcatgtcaagtaactaccatgtctaggccttggactagattctgaaaaaaataggcacaatcactggcctcgtggagttcatagccagcatcaccttaaaatcaatgagaagtagaaagtcaggttattgagaccaggatgatctacgctgcatctaactgggggatattaagttctcacagacattacaagcttatcccagtcaatataagctcactgtataatcaactacctccatatacaaatgtcccctcctccagtggcatgatctagggctggcagggattcacctttccttacccgtggtgcttctcaaaattcccctgctgcctcacccagccacccccattctcacccagtctaagtatcagttccaagaagcatttctagttcctctacccctttgttttccgcaaaccttcacatctgctccctcagaagcaccattggttatggaggtctgatctgaagttctacccatcactcacacattcatcatccatccagaaggcagttttatataaacccagataagcttggctttgcatctacttagtagctatttacccttggctgagataacttaacatccctgtttcttactgctgtcatctgtaaaatgggataaaaatgcttacttcccagtattctggggattaaatattaagctccagtacaaagtgtaacaatgactttatgcgtcattatccccgctggtctcccatagctgttctctagcacccctgtgccatctttgggattgtcgagttagccctgaagtggcaaggaccctatttcagtgctcatatttaaaaagcaccaccatcagcaaaaggggtgtagagaggaggcaccatttagaatcttggaaaatctgaaaaaacttgcttctaggccagagagtagagagaactgtgagattgtgtgctagccacagtagaccaatgttggattggagatgataggtcgtcttaatggaaagtgtgatggggagccaatgtggcacagtagctcagagtgtgggctctggagccaacataagaagagttaccctaacagaatatagaccacagagttcttcccttcaagtatggattcatcatacatccttcaaacctgccaagtacttcactttctttctctctaccaacctgcttcttaccaaccttctaaagtcctgttcttgattcaccctaggctcacctataaccttcagaagccctgtctctgactcttaactcttcctgtcttaacactgagcctctactttcagctttgggagccacaatgagtgtttcagagctgaagaatatctggagcccatatgtcagacatgaaagatttggaaaaacagaaataaaaaagttccttgaagtatttgaaatgatttattcaagtagggttgggacctaaaaatttgccaaatatatcataatgggggagtagtaccaggaacgtagagaaaggaagagaaaaattgatctcatagaaataaaacgtagaacagaggatactagaggctgaaaacaggagggggaaaatgggagacacagagagatttgataaaagacacaaaattacagctagatagaaaaaataagtgctagtgttccagagagctgcaggatacaacaatatacagtttcaaacagctagaaggagcatactacatattaaatgttccccaaacaactaatgataaatatttgagatgatggatatgctaatcaccctgatctgatcaatatatattatatgtatcaaaacatcactatgtaccctgtaaaaatgtacaattatttttcagttaaaaaaggaaaagaaacaaaaaaataaatattctgagaagatgaccttaagagagatgttggaagagagggagggttgggaaaatgggagatgtctgagaaataccctagaggaaatttgaaatagaaaaacagagctgaggaaagaaataaagatgaatcaaaaattaaattggagttatatgatggttcagggagcaacacatgtgtagagaaggaaatgagaggctggaactttggggaatcccagagttaagtaatagacaggggaagaggcagggaggggaggttgctcatgaaagttcatacatgtgggaaaaccatggacagccatgtcactgaagatgggagtggctgctgaagcctaatggtgatgaagaagactagaaaatgttccttatgcttggcgatttgcagattattagtaaccagatagaacagcagagaaaataactagctgccaaaaggttggtggggagggcttggagggcagaggaacctgggctcagcagcagtcaagggggattctgtgaagtctggggggagaagcaccctggtgggacactctaaaatgtcaaggtgaatggagaaagcaagggaaagaggcagggttatgaggagggcttctgtgagtggagtgaaatttaaggtgcctaaagaaagctaacaggaaaagtctgaaggttgagaaaagaagcaagatcactgttaaaaaaaaaaaatatatatatatatatatatatatatatatatatatatatatatatatatatatatatctcaaagaatctagaaaaaggataggaagtggagtcagaggagagtttagtcttggacaaggtggcagggtccttactctaataacagaagcaaaactgtggattaagcttataaggaagggatttcatttatttactcaacaagcatctgagtgtgtagatgcagacatgggcattttagacctggttttcaaggtgcctccaatctggttggggatatggataactgaagaattagtttgcaacagcatgagataaaccatgagggatgctgactggggtgttgaagggtgagaggatggcaggtggtgagagagacattccagagtttccttgtgagttacaggtttggttaggagggaagtggagctaactgttgaagaatagagattggccaaatctctggaatttcagaagcatcaactttgggaaacggaatttgctaatggagtggagtctgatgcagttcttcacttattttcttctggtatgcagaccaaaattatctgagaatgatcttttcacttctggctacaaaaatgcaagccaccagtagaaccacaggcaccagtttacagtgtagagagcactggactgggagtcagatctgggttgtacttatgtggtcatgggaaattccttcccctaggtgcagggactcaggattcgctttagtaaaatgaagggttattctttattgttctcagaaaggtggtttgagaatcacctgtgtggtgggctaagtattgtttcctaaaaatttgatgtctacccggaacctcagcattgtgacctgatttgtaaatagtgtctttgcacatgcaattagttaagatgaggtcacactggattatggtgctccctgattcctatgatggtgtcctcatcagaagagggtacacagagatgaagcccatgtgaagacaaacagagagtgaagtgatgcttctgtaagccaaggaatatcaaggattgcaggaaacccccagaaactaggaagggacaaaaatgattctcccctggagcctttatgacctgctcacaacttgattttagacttctcaccagaactgaaagataacatattttcgttgaaagctactaagtttgtgataatttgctacagcatccctaggaaagtaataccacctgcatccggaatatcaggaatcttattaaaatgccacttcatagtatccatcccagatcttctgaatcagaaatactgagactagagccctgagatttaaactattaacattatttatgtttcttatgaagttttaaatgtgagaaccactggcctaaatgatgccttaacagctctgaacaatctgaaagttaaaatgacaggactattttatgcatatagacgacatctcccccggtgaagtgtgttacttcccatcctataggtatcacaaacagaagtatttattttattaaatacaaaaagaaccagatcgcttccaaactacatgcttctaaacactttcataggttttgtgttctggcagcattttaaagataaaactattaagggttttattttttctggagaggtatttgtctctgagcagtttgatgaatatttaaatttcttttaatctgtgttctcccatcattttctgtatatgtttctttcttatctcattttatctggccttattttttttctctgcttttattcattttctgtgtactcagaaattaaaggcatatccattgtatgtttttatttaatagttttttactctttatcctgtacggcctgtggaaaatatttcactatgaggattagtcattgcatctctgaaccatccctgatgcatctcttggctaatggaggctgtatagtgtagtagttaaggacaaaatggaacgaggctacccaggtttagttccagcaattaggttatgcaacattgggcaattgactgaacttctttctgtgtcagttttctcaagggtaaaatgtggttgttaatgggacccatgtgttagtccgctctgctcagttatgctgcagtaacagatgcctccctggaatcctagtgacttaaatgagcagagctttatttcccaccggcattaatattcatcctagttctgctgcagtgcttcttcatgcctcttcatttctggaccctgcctgaagaggcagctctgatttgtcgcatcctggatttgtggccaagggaagagagctagcagagccatgtggtggccctcagaccttctaagtggttcacactatttctgctcacattttcttggctgtgaagcacataaggcaaaatgcctgacataagaggcagaaaatgtaaccctccagaaagggtggacctattcggaagaggctggtaggaaaagacagcaaatattgtcaaaaataatgtaatcaaccacagcaactttatgggattgacgtgagtattaagtaagttaacataggtaaagcacttagaatagtgtcttatgactattgtctggtggtctattattaacggggtcttgtgcaagtatgtgaagacattaattctttatttgagaatccaatgtaccttccaaggaaagtgctatttagagttgagaaagatacagaaatacaggtcttggtctatgccttatggaatctgtatactcctccatgaagaatgtgaagaggaacagacagttgatgacttccagatggcctgagtgcccaccagcagggtatctagtggacacctctgtacctgttcttccacatgattggtgtttatttgttcaactcccccagcagactctaagctcctttagaacagtgagtgtatctttttcatcttcgcaccccagaaactttcacaacacctgtctagtaggtcatcaacttttaaattaaacccctccttctttatacagtctgaaagtggggtggtaatttcactctcttaggtaagaacagttttcttctgcttgatgccccatgttaatgaggaactcagggtgcatggaggaggcagtcagcagtttgaagtttacatccatactgtgcccaaactgttgcacagaagtatgaagacagcgcatggaaattagtcctgtttgccaacatagtcggttttgcatgcgtcatacatggccaggcttgctgtattaagagccagctgcatttaagtcttacttaaggggaaacaaatacatttgaattgaaatacacttgatttatttttgttgatgttctagttttaattattttctctatgtgcatgtcttgcaagttttatttttgtggggactataaggatatgatatttccagggagacgaagagctataatttctcaacttttcaaacctacatacatattattttaggaaggacaaatctcatcatcttagttaacaagaaccagaatagagtgatagttctgctaatctggcctcctgggtcttgcagttgcatacaccagatgctaagaggataagacagattagccaggagtaagaccattctgtgtggcagctacctctgtccacagtgggtgatcagctaatgccatcaagctcataagctgataggccttgtaattaccatgccaaagaggctgcaaatatccctcttttcccaattttaccttatatttagtactttctattgtaggaaggagatgctgcaaacaccatggaggttgatctgaaaataccgtattcccagaactctttgtcttgggatacttctaaaatccaatgactgtatcttcatatctatacataaagtcccccatccagatgggatattcatccagaatatggcagatagaacctgaagggtctttgggtatcaagagcatatcacttagcttcttacttgaatagacttacgctatttaagaatgatcgtaacctcattcttggcagtagagtgaattagacaaattaacaaattagagttcccaaaagtcctccatggttcagagtgaagagctatgtgattgtgcttagagacctgtgctacttcctcacaaccccaggagtctggtcagtttttggtaatttacaaccatggtccctcagcctgccctgagtgctgacagcagactactgccttctgtactctgtgggcttcatggactctaggtgggtatttaggttaatgggaagtgatctatctgtggagtcaggacaggcagctatctaggttaatgggaagcaatctatctgtggaatcagaaagactggattctttatttaatttcacaattcaatagcttgtgagcttgtgcaggtcacttaacctcttaatctcatcctaggtaattgacgttacctacctcatgcggttgctgtaacatttgagttactgcatgggacatgattgagtgctatgtaggttttatcttagtttgagttcccttgagagcaaagcctgagacaaagacttgggtgagatagtttttctggagtggtccccaaaagcagaagtgaaggagcagggagagtaagcagtgcagaaagaaacaccagtatgagtgtccactgtcaagattcctgctctaagcactgcataggtgggagagatgaaggtgttgccatgaatgcctcccaggattttctgcttaaaacataggaggttggagtatttattcattggctcccttcccctccccattctttgatatttacccctagggtattcttgccctcactcccatttcttggttgctctttcttgcaggcagggcaggcaccctagctttagagaaggcccaagggctggccatgcttgaagtgggggaccatcaaactgtctgagctcacaataactgtcacctgctgcagtggctgaaatctgacattggctgagggaatatgatgccaggcggcacgtgatgcagggtctgctggaagcgcatacaaatatgatatttttcatactcactttcatttacaatatacacatttaacttttttttttttttttttttttttgctttattaataggttctgtatgctaggcctgtaccctggtcttacaaatactttaaagaaagcccaggttatactcttcattatcctcctagaattagattttctgtttcataattagcaatagtctcccatatcctccatgccctttacccagcctcaccctagtcctctttcagtcctgagacaggacaactcagggatgtaaacatggagaaactgtgagaacaaaccagagaggaaggatttttcagacaggctgactagggtttgagtcccacagctgtatgaccttgacaggtcacagagctttgctctgtctcttgattcctaaagctggggtatagtagatcagctgcatgctacaaaactaaatgagaccacgtatgcaaagcaactggtacttctttatatatggtactttcattcccctatcacttccccaaaaagctgcattttttctggccaggaagaatatatattaaaaggaaaagtagtgacttcatttatatctatctgctgcctgatatctttcagctccaaatttgtcaaattcactctactgccaagttccttctgctcctcttccttctccccctctaccctccataaatttactctcctttaatttattcatccatttctatgtattcacttattaattcaattatatgtatttactactatatggaatgctttcctgaatcggttcaatctgtcctattgctaaaatacagtctgcagctctcttcagctccccctccatttcttctctccccctcaacccatccactcatttgtttatttaatttattcagttttatttatttgctcactagtttttttccaatacattgaacaccctcttggtgcaatgtgccatgcttagttgttggggattacaaaggtagaatattctacctcaaagggcatagaagtgaatttttttttttaaaaaaaaactacaatacaaggaatagagtggtcatttgcaaaataaaatttttattgaattgctgaagcagtaaactctcagctgggagggtcagggaaggctgaggagggatggctgcagatagaaaggttataaaagtaatagagggagacaaatgtaagctgtattttgcattccttgattcctatttaaagcaaaatattaattaatattaatgtactagacctttaaattcataattggatatatatttttttctgcatgctagggcaaaaaggtcaattcacaagaatacagacttaaattagaaatgtattaggggatggtaggcagcaggtcttatggcatatcctcgttagaatctctttagctcaatcacattcagcttcaaaatctgtgactttagtgataaacagtaagatcacacgatcagactcaaaagcactataatacctaaaaatcattgtaagaaatctaatttgtattaatcataccattagaaaagtggagaaagtttcagtatctgttataaagtttttttaaaaacaagagtagaatcaatatccacaaaaggatcttcctgcctatccctgagaaaattgcccttatctcttgaaaagtggtttcatggagagagattatcgcaagaaagcttgagcctgtccccagcttaccactgctgagcactgctgtaaatttatggcttgaggtagaggtttggcaatacattggggacaatattctttttcatcttctgaggagccatttgtttctttggaggtatatctgctccagattcattccatttcaaaattgagatgctccattctctcagccaagatgaatgggttcattttacactgtgatcacaatttagagatgctattgaatgggctgccagtgtttgctttgtaatgttaggggcactcttttttctagtcttaaggcataggttacagcacataacagaaaccatgcaggaaagacaaaaagaagaaagagagggagggaaggaaggaaggaagaaaaaagaaggaaagaaggaaggaaggaaaaaaggaaggaaggaagggaacgagggaggtgggtgggcaaatagcaacacccaacaatcctgtatcatcaatagatagttgtggcctgaggtataaattaacactattctaagaaaaatcaggcaagcagtgaactttgattcatacgtctcagcagcaggaagctgccgggagctggttatcaagtgtgactcataggagagacacaataccagaagtagccttctctggctagtaggatcaatcatgtcttacttttttctggaatctttcccttttcagtgaggctgttttcatctacccagtttgtcagagcaaaccctaggaatcaacactgatttctctctttacttctcctactaccaattcacctcccaaaccaatctccaagtcctgttgactccacctctaaaatacatcccaaattttacaactttcatttctactgtctcctagttttagcctaaatcattttcatctcttttctttaatagcttcctaatagatcttgtttccattatttcacttttggtctaatatacctacagcaaccagagtgattctcaaaatttaattgagattatataatctccttacttaaaaccttccaagagcttccagtatgtgttgaagagctttcaggtttgtaccatgtcattaggacttcatgtgatctggactctgcctacatcaccagctttgcatgattggctccttcctaaatgcaccttctcagagaagccttctctgatcatctcatttagtatctttctacccaaccaactgctcaggacaagagtagagaagtcacctcaaagaggccttcctggaacattctacaaagtagccagtcctcagtcctcactccctacccccaactgcttttcatcgtattaccctgccttattttagatagggttgacagaactcaaccctatctaaaattatctcatgttccttaatttgtgtattgtctatcagattttctcaccccaaagtagactgtaaaccatgtaaggcaggacccgttctgtcttgtttatctttttatcctccacaatgaggatcagaatgagcatcagaatgtgaccacagtgcctggttgccttctgatgctcaattagcatttgtgaaagatgtgaatagatagtcttgcaaaaccttggcagaagtgagtaacagtattctattaataccctgggaggctgaagtagaggatgaggcacggagaaagaggtgagtagtccatcgttgaacttgttatatgtggcagtctcaatggtatgtttgcttattaaatcctgataaatattggtggcatttttagtaggttttaactagaagcaggggctcctggagggtgctcaggctgaatagctgggtcacttgtctttctcacacctccctgggagacttctctgtagaagacttcaagaaaaatccctgcaccttccacacctgttgtaggaggtatggcagctattcctgagccttaagtactccagtaagaatgaaatgaactatttgaggtgttctgccaaacgggctctaaaaataattatgatttaaaatgttttttttttccagtgaatatgaacgctttaaaactaagtttgtaaaaacaaaacaaaacaaacaaaacacctcctcaatctctgttgggttagacacccaaagaaagcaaccagaagctgaaattttgtggacagaacataaaacgcctttttcctacttctctgtcctcctcttcttccttcagtcctgttctttttccttatcatccctgcttttacttgcctgatctgttttgtctggggaggatgcctaatacaatgtgtgatgctatgggcttagtgaaatgcttgtcacagctcagctagcctagccaaaggggctggtggaagcaaaggtaagttttcttttttgacatatctttggtttccttcaaatctaacacagtccatcattttgagcatttattaaccatatcatttagatgtataattataggcatctttcactacgcctttctaaagagggtaattttcatatattttatgcattgtagaaattttggttcatgtgaaacatagtttgaagggaaatcaagttactgtttcatttacctctttgaataaatagaaagatgttcaggtaaaaccaagtgattatgatacagatctcaccccctccctccccaacctccacccaagcaaaagtttccaatggttccccatacacttttggaaacagagctttgtggcatatggaaggaatttctaccccctgcgtatgagcaaacccatctggtttagttggtttggccaggtcttagaaatacattgacaaacacgtgtatgtcaggggtaacttgtagtcttgctgcttatattgctcctggggggaataagaaattcatgtaatatgaacagtctagtttttaagaaaactgaaataaattaaaaataattaaaatccaaagttcaccttatgaaggtgtgtgcctttaataatgctcaaatatagatttttaacatacactctgattttctgtctgccaaaagagggaaaaatctgataatagctgagtgtcatcttcctccaagcaatcagcaatgcattatttcctaatattgctgtttgatttcattattggttctggcttcttaaagaaataagggttccatagggttactgtaggataggtcaagaaaaacaatctagtcagtgtatttcatccatgatatcttattccgtattccccattcaacagagaattaggccatcttctgtgaagcaaagccttacctcaaagagatggtgctaaatgagttttcaatgaggatagcttgtgtgagcatttgggtggtattattacccaagggattcattaaaggctctctgttctacaatagtaaacaattaaacactctatttttacaaagttctgcatcccagaaatcttttgcatctttattccaggcatgagtgtcattacctgggaaattcaactgaggagtgttaggtaatttattaacattctctacttagatccagcagtgatagtttaagcagcctcaagagaatcaaaggatttttttttgtgatcaatatttattacttaaactataaaagagggaaaaatacatgtaatacatacaactaatatgtacccagttgcagatcataactttcctagttattaaaaatgcaggaaagttaatggttttgagacgtttcttaagttctcactagtttcattttaaatttcagtgttttcttctttttgtctgaaccatcctttacttacgtgaatcactctttacattcattgcttcactgatgctacttcactgggtttttgcttgaataggccagaaaaagtcatccctagactacatcatcaagaacagttttgtatatttcaaccttcagcttgtgtctgcatcttgcattacttatcaattcacttttatgcctgggctacttattaggtttgtttctcctctctctttgccttgatttcccgctgagtgtaaacatcacttttcctctgtagaatgagttgaccttttgacttgattaaggataaatgccattgactctccacttctggaggccaagggttttacaaaatcccactgggacttatttatttattgtttgaaaatgaatatcaaatactattccatatcattttaatgagatggatgtgaatctttttttttctactttaagaataataagaattgttactgttggaggtatcaaatgtaactaaatagtagggcatgagaagcttcagttttttgggggttttttgagatggagtctcgctctgtcatccaggctggagggcagtggcgcaatctcagctcactgcaacctctgcctccctggttcactccattctcctgcctcagtctcccgagtagctgggactacaggcgcctgccaccatgcccggctagtttttttgtatttttagtagagacggggtttcactgtgttagccaggatagtctcgatctcctgacctcgtgatctgcccgcctcggcctcccaaagttctgggattacaggcgtgagccactgcacctggcctggtttttttttttttttttttttttacatttttattcattggccatcacattccaaagttttacagtcaaatggacagttaaatatttgtgtttgaatctgaccactgtgaatatctcaaggataccataagagctgatggacctccaaacgttagcatcactggactgagagaaagctcgttttatatctctataggtactgtcataccaatgaagcaatgttcccaaactactatgtttgtgttagtcattttccgcttatcttgtccccaatcataaaaattaagcgatgtacaaaaattgcctaaagaacagatgccaccttatagaagatgttttaaatagcccgtacttgtagcagttctgccttcatagctaatattctccacgtctttcttcacttttttctttcttattgaagcatttgcatgtagaataaagaggataaaaacataaaaaaacaaagacagatttgttttttctgagaacatctgttcttgttataaagaatccacatgatgtggtccattttctttcaatgccctcactgttggctgttgtgatggcaactgttacatcaatcttagacctgaacttaataagataatgaagagtagtatctaatcagttgaaaatacagggaaattctgttgtaatacatacattttatgtaatattgagacaaacatacaaagcaagataagctgagatgtaatctaaaatggtttattgtagaattactttattcctaagattcattgctctcatggcatcactacctaattttgagtgcatttggtcctttaggtttccttactaaatgttcaagattcttgtaaatttgggttgcccttgagctttgggtgcattctgaaaattattaaatataagtcatttgctgtgtacattgtaattaaaagaaaatttttcactttgaaactctgtttatttttcaagaggagagttcctccaaacttgaactactaccatagctcttataaccagcagaaaataggaatactaattactcaaaattaaaaggtgtagtttgaaattacctagagatttatattcccctgtataaaatgtcttcagtcttggagaggagggaggagtgtagctagtgacagttacataataaagctttcaaaattacttagataaaatatattgactctaattgatggttaccatagaaacagacttatatagacattgattattcaagcactcattaaagctcctactatgtacttggccctgtgctcagtatatgttggagccaagtatatggttttccaaactatttcacatatatccatagggatatattagccacttatatgttatatcattttatttcctagtcattttcaggaatggggctttccacatatagattgactaatccaaaaatatttaatcagcgtctttcttcatgagctcagctatcctcctacaaagagcaaacttggtctgtcttctgcttctatgtaatcttctttgtcttttaaatttgcatttcagatcaataacgatatacatcctaaaagaatgtgatattttcttcctttattaactggatcattttaatgcctctttgtctctcttgccatctttttcccctaagtacaattcctgttacccctgattctttatagggttcacttgaaccttagcttgagcatctggagcatggatctcttgagacaacttggtttattcctctatttagtggcactttatattagtcatgcttttgtcctgaaaagtttcagttttggaactttacatcatttcagtttttaggtatttggatccttttggaggatgatgaacaatgggaaaattctgggggccctcacattcccttcaggagcattatttatgatggggtttaaaacttgacagtattactattgtaatgcttactattgtgatttctatggtcgtgaatcctagtaggaccctgtgttaatggaaatgtcaagttaaggcatatgtgttgcaaagttcttttctcgtcctattggtggatactctctaaaagccagactggtgtatcatgccaaatggccaaattattctatagaaaaaatactatggtaaatttcctatatcttaaaggaattcgtctggattctaaaactttgagagattaatgactgctaactacagcttcctgtaaatgattgcttactgccattggcatttgaaaaccttatatctaagataaaagaaggcactatttttttcattactgtaccattatcctttatgtttgaattgagacttttgcatttggggactcctacagagaatccactggatcagtaaaattcgaatggactttgggtggaatataattccttgaatgctgctgggtcatgtgcaccagtgtggttttgacaaccctgatgcatgagcactactttcagaattgattctaactttggcacttactaccatccttaggcaaaggaccagagaccttgtatgcagggcagaagctcaatgacaacgagtggcacaccgttcgggtggtgcggagaggaaaaagccttaagttaaccgtggatgatgatgtggctgagggtgagtatgactatggtgaaattcgtctgtcttttctctcagtcctctcagtcactgagtgagcaaacagtgttttgcaaaaccttttattttgcatagtagaagtcacaaatcatgttttctgttgacaaactcaggcaaggctaagaaggtcttcctctgtattttacaataccttttcatcaatgtgcgttatggaaattacctactaactataactacatatttatgggtctctctccttaggcgtagagtatgtgtctggagaacagatgtagggttctacagatccttttattattcaatcattcaaaaatcacatgtcaatcatcctcccatatgccagttccttccatcagtgagtgaatcactctctagtagaagagatgggcaaaccagaaattcagaacattacaggtaaaagtaagtactaaaacagtgcatgatacttagaaggtgctgaataaggtttggtttaattaattacttatttaatcattattaattatctattctgcactacacaccattttacaaggcactgataatacagtggtgaacaaacaagcaaatctttggcctggtgggatttacatttagaatgtggaaagaaacattcagagctccacacaatcaataagtatttcctaagagtctgttctatgtcagcagtatgctagaattgcagaagataaaatggaaacagatgagattacctgtttcctcaaataatgaaccaattaagcagatcagataggactctggtatttgaaaacaggaccaaaatatataatgagattctaattttgatgggtgagattacaatttgtcaatcagaagagagaattacccatttgggctggagaaatcaggagtggtttataaacgtagatcttcagactgaatttgatggtggatgtaatttatgaaggctgaggtacaagaaagagggtatcatcaagtgccattttacatgctatatcttttttttctttctttcttttttttttttttaagacagtcttgctctgtcgcccaggctggagtgcagtggcgcgatcttggctcactgcaagctctgcctcccgggttcacgccattctcctgcctcagcctcccgagtagctgggactacaggtgcctgccaccacgcctggctaattttttgtatttttagtagagatggcgtttcaccgtgttagccaggatggtctccatctcctgacctcctgatccacccgcctcggcctcccaaagtgctgggattacaggcgtgagccatcgcgccaggccttacatgctatatcttataagtcttccctctctgatattctagagcaggacacatctatgaagcagaattcttatccatatgggaaagaagatttggggcagcatggggtattacatgaaacactgttgccatcagatctgggccctgacgttaacttgcaggacgttaggaaagttaacattcctgggccttgtcaaatgcagtcagtggcctaagccatctccatggtttcttctgtgaataagacagtcagtagccctgggggtctaatataatcattgccactaaaatattttatgcctttgagatagatatactaaacctctttttcctaatttcctcatttttaaaattgatattctattatttctatggcctttccagcatgaatattctgtaatttggggtcttataatttaattttatattcatgagcctgagtttctatacttctggaatcaggaaatatagtaagatatgtacgtgcatgtacaggtgtgtgtgtgtagagaaggatagcctgtggattaaggaagagcgtctaggcacatatccagtgcccagtaggcattagaaactgttagctgtgttaagcatatcagctcctttaatcttctatcattcactatagcctttaaaggtaagtgttcttaatgccatttaaaggaagcataaaactttgagagcgttgtataattaagctccaaatccatgtcagtgtgattccacaaaatcattctgcttgctgtacttcaaaatccatcataagaaaataatttatcttacaatatgggaaaaatataatggaatgggttggagtgaggtagggaatgcattagcttattaaagtctcctaagaaacttacaggaggtaggccacaacacttgacctctccctcacaaaaacaaagacaaacagaaccaccacaacaattacccaaaacacttcgattacacatagacataactcagaagcgggaggtgaagttcctggtctacgtgcctggagcataaatttgcattctgaaatgaacattttaaaagagatgtacaaatggttacactatttagcgcccgcagccaacctgaattaattattcaagaactgtatgaactgttggtgcatctggatcctgcaaaggataagtcacacatctgttgctcactcctctgggcttgtctctgaagggtgatgggattcacagccgcttctgaaaagcagccactagatggcgacctcaccctgatctctcctgacagtgagttcgtttcattttccctggaaaataaatgctccaaaagtatagtcataaagaactacagagctgagggtactataatgtgtctctctcagtcattattcttttatgaaaactttggaataaagctatttgtaaattgcactttcttttaccactaataattaaaaagcagggccaagtcacgaaatgccattatccagtaatttgattttttgaaattaatgaaacgctttcattttcagacgtgtccccccaaccccccgaacttcactgctgatggaagaaagcagccagaaggataaagaaatttgagaggggaaaagtgctgttttgcttatgagttacaatcttgggttgctttttatagtgataaggggttgggaaattttaattttagttcacagaagtcataaaatcaggcaatgaaactaaaatacccacagtcctcaagttattaagtagtatctcattggcttatttagtaatccctttaatgttctttaaggcccccctagtgtgtccaatttcagctagtttatagaaatgatgtaaagaataggtctggctcacaagaaatcaaaagcaaggatagaaatattcctcaaccttgtgtttatcatttattgtaatgtgattgtgttcttggaaaagcattaagttcgggtgacagttaataataattgattgatctatgtttctattattaagaatacattactataccaagcataacttgagttatactcctcagaattggggcctaatgctgcatgaactgcctcctctgcctagaacttcttgctagtacaaaaacttgcccttgctagtagaaaaatttgactacactggttcttgttgacttttcctgtccttacctacatagcatgtatagcaccaagctgtaaaaagtcattttgcaaaattttccatttaaaatgtatttctcatagtaatttttaaaaacttgacaaaataggattgaggagtgtgcggtcaaacaaaatgaaatggagttctttattgccaggcttattaggagactttaataagctaatgtacattgcaaatcattgataagtatgcagtatttgctaattttttttttttttttttggttccagaaactttttttactgaagtattttataccacatacttacacacttttaaaaaatgctgacattatggagaaaaggatttgggaccagtagagctagggaattatgggcaaaatatgaagattcttgactggtactctgtaagccttcgttttcttaacttctctccccacgtctaagggccatgaaaggtcaatttgcttcctctcagcgtttcccattattattcttttttgctgagctcttagttttgaccaggaacctcatgtgtggaaatggtgaggacccaaaccttgaccccaaagcaaatgtctcaaatacaagcccctccccccagaagttaggaatgctggctgtgctcagacccctctggtagccactgggggacatatagaagacacaagaggtggcctctacttaaaaagagcccacattctcacacaaaaaaagagaaaaacagtaagtgaaatgaccacaacatgattcaatcatttcggaggaagggagagaaatgaatgcagcataattagtaatagcgcacggtttaagccataggcactctattaaaaactttacgtgtgttgatacgtttaaccctgctaacttcatatccgttttacagatggggatctgaggcatagaaaaattcagtaactcccccaaggtaacccagtgaagaagtcttggaagcagaatgcaaagtcaggcagtacagccctggactctccatgctcatccactatatgctattgcttcataggaataggaagctacagcttgaacctggccagaattttccataactatatgtccttcgtcactctaagagctggtttgtagactgcttgttggccatcagtgcaatatggaagtgaatgtgtgacaaggaggcaaggcaacaatgctgctttagggagggtgctggatatattacccatgaattagatggagtgacattctgatactgggccatagggaagaagtacaaactccttagaacagcttctacatggaaatttcaccagttaaattctacctactgcttttcttgggcaatgatgtgaggaataagtaaaaccttttttccaaagacagttcattgtactagtaaagatatgggctttggaattagcacacctgagttcaatgtaggggtctaccatttaccacctgcatgaatcttgatcaaactgcttaacctctgcaagctaaatgtcctaacctctaaagcaagagaaagatacttctctacaattttattgtgataatgacatttcatagtgattatgcagtatttagcacagtgcttgccttatatggaattttcagtagtcttggttttggcttgttatctttctccccagttacttctctttcccctgaagtttgaaagaagcggctgtgaggtatgaatatatttgccccttaagtagaaaggaggttcagtttgcagacagcattcagaggagatgagtgaaaggtttccatcactactattgattaaatgacacatagattaaaaaaaaaatatttggttggtttggcacaggtttcaaactttcagcatctctcatgctttgcacaggtgcaataatatacttattttttgaagtcttcatcaacaaaggagtaaattcgtttagcacacagtgaagccaattctttttctttcctttttctttctttctttttttttgagacggactcttgctttgtcacccaggctggagtgcggtggcatgatgtcgactcactgcagcctctgcctcctgggttcaagcagttcttctgcctcagcctcccaagtagctgggactacaggcgtgtgccaccacgccaggctaatttttgtatttttagtaaagacgggttttcaccatgttagccaggatggtctcgatctcctgacctcgtgatccacccacctcgacctcccaagccaattccttttctaatttgatctcacatggccttctccccctcccctcaccaacttttagttgaggctcctgtgtgagtcatcctgaactcccagtttgtgttcctgggctaagctcctaaatccactattaacttcacttcttgtacttatccacatccacgctcagtctctctgctatctcaataaacacttttttttttgctatgaaaaattaattttctagtgagcagaatatcccaacccctcaatcctggagatcaattcatccagaatttctctgaaagttctcaacttgactttaaaattgtttcttcagattccttttggaacctcaatcttcaccagagattccccattctgacttcttagttctcatcttagattttttctttgtaaaataagaattagcatgactagcagcatcatcatagttcagtttctctgtttctgtggatattgactatgactccccctccccatcattttccagcccagctccccttcctggtaggagtagctatagccaatttgacagtagatgtttctttcagtcactttattaatttagagcatgcaaatttagattatgttgctttgtattttcacagcctgtctgatttttaacactaagcaattttatttcctagttatttgttagcagatttatgttgcattttgatttttatatttaagttaaccaacatctttttttcttatactaagagagtgatttgtcactagttgtcaaaacactgcatagaagctcataacatgtaaatctaatttttgtgcttatagggaatataagaaattttatttttatttttttagagacagcatctcgctgtgttacctaggctggagtgcagcctcaaactcctgggctccagtgatcctcctaccttagcctcctgaatagttagcactataggtacatacctctatgcctggctaatattttttttttaatttgtagagactgggtcttgctatattgcccaggctggtcttgaactcctagcctcaagtaatctttctgtctcggcctcccaaagtgctgggattacaggcatgagccactgtctccagccaattctttaaattaggtctgagttttttcccaaagagataaaaccaatattgagcacttaagggtatgatctggtttagtctcccagatactgaagtttaagagacctaagaaaatacaatcctccctttttttgtcactgtaattctgagccaatagagaaaatattgcaatgaggatggaaggcaaatatcattttaattagtaataacacacaataatattgcttacacccactgaacttcagaattagacagaactgcccacttgaatagtagttcagaactgggcagacatcctttgtggaagcaaggcttgctcctgtaacacccattctatggatgcatgcagtagaatggacatttctgaaggcagcttgctccagcaaagagaaacaggaggtgttaggggctgagctaagcatacacagcttctctttgcagatcatccttaatatttctgattatgtcacttcttcaggaaagttgttaaagaggaaataaagagatgctatcagtcttgctaatggagttttttcaatgtagaaggtaacaagagaggacaggaagaaagaattccccctctaatgcttggcagtagaacatggtttgttatgttttaacatgatttttctatataaatgttgaggaagccaatttctactctggccacattaatgatgtttttctttattttgttattaaaatttccagtctctttgtatttttttttcaagccctccttatcccctctgccctagtcactcaccacttctaggtaaaataggtaatacaagttctaaatagttcatttgtaacagctgaagatatttccgttgtgaatgtcagaaacccaactcaaacgctttaagcatgaaagggagtctattgccacacagtttgaaaaagccgggaggtgcctggcttgatccagagtctcaaaggacagcacagatgattctcttcatttggtaattgtcttctgggttgctagtcctctgatccctctgattttcttatagcctctagggactcaaagctttcttcttacccctccagcagtccttgcttgcaaagaatcctctttcctaagtgtaccagcaagagctctggaactgagtgtggccgggatggcttgggttgttgccagttctaagggtggtccctaaatcagccacaagagcatcactgtgaaacttgttagaaatgcagattctcaggcctcaccccagacttttgaattctaaactctgagggcctaagccccccaggtgattctgatacaccctaaagtgtaatgaccgctttttaagtctgtagtccaaagtctgtgacagttaggggggtaaagtacattgagtggtctaggctgagtagcttgattagggtcaactttatccagtccaggtggttgaaaggtcaagaggggtgggtagcttcctaaagaaaaattacgtgttattataagataaagtaacagttgctgggcaggtaaactcaactgataagtctataatagaatccttcccacgagtactaagtggagagttattacgagaaaaaatacttggtagtgatgcccaagacttgtgtgttgtgtctttacaagggtcagagcaacaaaggcctttcttcttatagtgtgtattagtgtccagtgattctcctgaatggagaatatcaatagttttatcctttagcctgggttactcatgacctcatatttccccttatatgatgagccgtgctgagcagctgcgtgacagcatgtaatttgggcaatgcctgattgaggccaagtaaggtatctaccatattgaatatttggttttcttgaactcacccaagaaagctgaatattctgtgtggaaacaggttacacccaaaaaatatacttgagggtgctgtgataaatgatggtaacttttctgtttgtacctcatttacaattttcacaggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtaagtagaagggatcacgacttatgttggacacctttaatctactgaagctctacgtaaaatatggacataaaaataacttgtctattctactccctaccctccattcctgacacattctcgcatcttccttgattaaatggatccataaaattattaggtctggaaaggagagaggctcatgatttaatttaaaggtcttccactaactcaacactaacagactttttcctatgaaatgtagccctttaaaactattgaagaaaagcttatttttgcaaaagagggctatgatttgtattgcatctaattcttgagtattactaactacaaccacccaatttataccaaaagatgaaacataaatattttaaatcctaccattagcccatatatgcaagtttttagaagctgccctttcctcaagacattttactaccatgtattagaaaatagtcaaaacaaaaaaccaaaacaaaaaccaaaacagattaatggttgatgatgaatttaaaagtcacccccttatgttttgtagtgtacaacctgtgctactttgactctggagagtattagtaggtagtgttaatgaagtggactcgatgagtatggaattatagtgaagcatgatagaataaaatctgactattcttgtaacctcatatcaagatttaaattattcctgcattatgccagtttagcatgggggatttgaagcccactatgtcagttacacacatatagccattaaaccacttcggggattttccaattattgtttttttttttttttcttcctaggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtaaaccttgtaaagaaatttagtttttaatagagcttttcttacaatagatagactatttccagaggcaaaccacaggttcagagtgccatgcatttttgatacatcatccatatcctgttttaacaatgttgaattatcctgtaatgcaattttttccgtttttacttagactactcatcaagaaatggttcattttctctgataacctcgggaatgtcatgctgtgggggctgagagatgacaggatgagtgtcaaagtgtgggaagggccgtaatacagaggaaggaatataggctttggaatttcagctgaatcatttaatgtctggtgtcatcagtaaactgtcttagccttgttcagcttacatttacttttctttgcaaaatgaggataataattgttagtttctgtataggtcgtgagaagttttgatggcatgtctgtatatccctcagcatattattggtaacaagcacataaaaagcactcaataaatgcttgctttgttgacaatattgttaatctttactccatctatgatgaataaatttttgagatggtatatataaaatgaatgacacataataaatattggtttcctttttttgcagggtagaaactcaggtgcttatctcatttatgctgtcccccccccccccccccagctatcttattccttatctgatgaattatctcaagtgtatcaaactagttgacatggtcaccacatcctttactcattctcttttgctaattactttcctttccaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggtacaacctatttttttcttgttaagctacagccttgttgcaagcaccaagcctctttgctgcctctgccactgcctccttcctcagttgaccagtcctgtctcattctcatttgccacgtgacattgcatcaccatcagtgttctcttgtcactggtttagtatgtcaagacatgtgccacaggctccaggaatgtatgttggcagatgttttctgagtatcacatacttgccaataaaaataaaataaaataaaaaacttccctggcattgacatcaggcttctttcaatgtgtaccttggcttccagaatggctgaaacagcactggagacttttatttatactttaatacatgatgaggggaaaaccagagattttatgtagatgtcactaattaataaaatgtttcttattttggctgatagtgactgcattatttaatgcaaatctagcaggcaataggaaaacgatgtccaaatgccatgatgatggaagggaactaacatttactaagtacttactaattatcaggcattgctaggcagttctttagtgtggtatattggaacattatgggctttgatattagaaatacctggattcagctccaggtagtagctcttgttagctatgtgacatttggaaggtgatgtaacttctgtaagctatatctttcttacctataaaacagggcaataaaacttaccttgaatgtaaggagatcagaaatacacataaaatgcctggtatgtagtaggtactcgataaatggtaggcttattgtttacaaatattattttatgtcaaacatctaataatactgcatgtctacccatgcagcacaacaaaccatgctcagcctgttcctgtagatgatccactgtctcttgagatactaaatgaattttacaggtcttcctgaatccaacaattctttgcagtgtaaacaatctagttttaaccagcagatggcagaagtgaacacattcagccttccctagtagtcttgggttggctgaaaacgtgactgttacctaacttgaaaggcaaagaagttgcctgaccaaggatctatgtaattatttcctttttttctttttgagccttttggttgagccttatggtcctgtgtttgcgcaatatattgtgtttccttgtatcagttgttaatttaccacatcaaatctgttcattccacttctgtgttcaacttcatgtatcgcttctgttcttaaacagcttccatctgggttagctcatcatcgtaaagcacacatttataaaagcttcctgtcagcttatcaggctgacttggagttatggaaattgtttccctttgcctaagagttatttttgtattttgcactagtaataggaatgttcattcctataacccactccatttttcctttatccagaaatatttcttaaattgtcttggccaaatatggtgtttgtactatgtagtgtgtgtgtgtgtgtgtgtgtgtgtgtgtgtgtgtgtgtgtataaagggacaggaggttgggaatcactaagcccttaaagcagccactttgctcctagaaatgaacaatttcattcaatcagggatttttgtctccttggcttgcttttagttcttttgtgtattaaagggcaatcctggaatagacgtagcatttggaattaaattgtatatagtgtttagaagattgtagaatggcagtaattccatttatcctggaataattaatcatatgaagtcaaatcacaatataagagcacatattagaaagcgtaagatactggtcaaatgttacagaatttttattatgccatcagttcttcagatttaaaagttaacaggaatcatccattaactctatgtcagtgttttccaatagatatatgtaacacatgcaattataaatttcctagtagctacattttaaaaaggtataaagtaacaggtcaaatttattttaattttgtattttattcaatttaactaaatatacccaaaatattatttcagaatgtaatagagataaaattatcaatattttgcactttttttcacattaagcctctaaacttgagtttgtattttatacttgcagcacacctcaacccaggggctacatgcatttaaagtgctcaatacacatgtcaatggctactgtattggtagtacaggtatacagaatacaaaaattaaggtgtaaataaataaagctatagtattggattaaaaggaggtctaagctttataaaagggtactaaaatgtataatataaagggagaatgacctcacttaagagagttttaagagaagcagtaagagcatcagcaaaaagaaattacataacgagttggggaaaatgtccctatccctatctacagctctatgtgcagtttggcattactcatcacatgcattacagagagctccgaccttcctctgagtatggttgattgttcaaagccggatattgtggcttgatggctccaccatctgaatctatggtgagtcccatgagcctaatagcactgcactctattgccatggagataattacaacggttacccactgagcattatgcctaccccgctgggtgggatgaagtggagggtgagtgctgagggaagaaagtccttgttgattgtacacaaatgacttggataattagcctaagtggccaggaaaaatggcccaaaatgggttaaggcataaattactgtcattggaagtttgtaccactgtgaataagcccttgcaagagatcccaggagcattttagggttctgtgtaagatggtggggaggtaaagggagagcaaaaaacactggagacactgcaaaaaggcatcatttttattctgaatctcttgtgtagagcatgagacccccaagaaggcctttgagcattaggtagtatgaggaccacaggaaacagaacaaatttcttaatttatcatttcttttacatagaacagtaaacaagtaggggatgaggttttataactaagaactaagaccagaatctcttcaagatatgttttattctagcaaatctagaatacacagataaacatatatatatatatatacacacacacacacagatagataagtatctgtatctatctacatttaatatatgtttccatcaaagtcattgacaatgacactttaagatccctaggtagtaaatgtgttaccttccctattatatcagacccatgacagcaggtaaaataaaaggcaaaagagtccaaaattatttttatttattttattgattgagtgagtgagtgagtgagacggagtttcgctcttgttgcccaggctggagtgcagtggcgtgatctcggctcactgcaacctccacctcccagcttcaagcgaatctgctgcctcagcctcccaagtagctgggattacaggtgcccaccaccatacctggctaatttttgtgtttttagtagagatggggttttaccatgttggccaggctggtctcgacctcttgatctcaggtgatccacccacctcggcctcccaaagtggtagcaaaattatttaaaaacttgctaatttagtactcttcagctctcaagtatgagtagcaaaaaagaaaaaaatcttgaaactagtatttgattttatgtctctgatagatgcaaagtgtataatttagatattaagtgcaatttctgggcaactcctagtcaacatttagttgtaacttgatacctctcaatttaagctagggttttaaaaaaaatcatacctgatttaatatgtggctggtaaatgtatcttcctatattgaggccagctttgctgcagaggccaaggcatgatcagctagaaatgtggtttcacaattgcagatgataaacatctgaaagaaatacacgtgctttgttttgaaactggcacgaataaataaaaatgacattagtctggtgcccttttgcctgcaactatttgggtttggatatatttttaaaattaaacaaattgagctttttggtgttcccaaatcaccgtgatccaaatgtctaattccagtgccaaattcctgggtggcatttgcaagagggcacaaggggtgcactcgagtgactctttcatgctgaactcctaatgtttagaagtatttctatgggctccatctgattgcacacacgtgtctttcagtctgaccgtgcactccctgaggttggctgtgtggatgtgagaaagctcttgttgcccttgttgcccgttgcctgtgctttgtcaagtctgatgcgcccctgccctgctctgctgacttggctctgaggaggccggctctgtccctggtctgcgcgtccccctctgccctactccccaaccccatctttgctgtctctggtgaacctgtagagcatttcaattgtctgtctgagtgatggttatgcagattgcgttttcatttctgtaatgttatcctggtttattctacctcttactaacctctggttattgttttcgctttttctgttcttttgctaacaaagttgcgttgaccaaagctgacctgcaaggtagagaaggttcttgttcccattaccactttggactgaaagatgccctgtgtaacccttggtatcttttctttagagatcttcaagctgtcacacctcttggacagcagcaattgtggggaggtggctgaaccctgtgttcttctgaaagggtgacagataacccagatcaatgcatgaaaaatagctatcaagaggagacctcatgggggaagaaacatgattccattttggggggtaccaaagaggtttgacagcatcccataccgtgactatacataaacatattaatttactctggaaatgataaatacctctccaagtagttgccatggaggggttggctcctcttaatttattcaccatacatagaaaaaagaacttggaaggaaaaaaaaggccaaggccagcccttatgccttaagttattattttctggatcagggaggtcatttcctggagcaggacatttaagtacttgggctttatgaaagagaatgtcattttctcttaactagttttaaagttttaaatatttctgggcatttgggagacactaatgtcattaaaatgtttcagagatttatattttctattggggattttggttgagcactttaatttcctgttttgtgatcgcaggaaaaaagtactcttgaggaagaagatgatctgtcattttaatcctgaataccctataaaataccacatgtgagatgttagtgaatatctattgcagaaactacttcatccactattcaaagaggcatcttacaaagtcagtaatggcccactgatcctatggtgccatgctgctatgtctcagaataacaagggaggaacaagcattttaggtgtcttttggctgattgtcaagcaggagactgagcctcatgacctctgctgagtttgcagtcagtccaaattgttagaagtagttaaggcaaaggtaacgttcaaaaaattacttttcatctaaaaagatcattgactttgctgtgactttcttgttatatgccatgtagctaaccagtacaagcgcctatctatccagaatacatccaccaatgaagactctgtcactattttaccataactttgtttttctttatcgcctcttagcagattcacatatattttaatatatatttaaattaaataaaagaatatacactagttaggacttaaagtcagaggaagctttacaatagctttcagtttcaaagtatagagggcccttgtggcaatactgttgttttagacattatgtttaattgtcaagaaagatccactatgtatttctctgtaaatggaagagagagagaagggggcaggactcaatctgaatgcaagacaatccaaggagattgaagctccttaggactggatttagcggattaaactagacaactacatctcttccctgactttactatcacgcagggtaagaactatatggattttgaattcccagagcttagcatattctctcacctagaaaatctggacatggcaaaataatctgaaagttctcatccaaaggaataatggtttgtagggagaagtgagtcattgatttctatgcctaaagtaaattgtttaccaaagcgtagatacagatttagggacatagtggtttggaatatattgatgtttccttttatggaagctgtctaggcatcaatatggttttaacattattactttattggcacgaactttcctccattcttgtaatgacttgacagtctctttgtttgtggcaggagctgctttttttttcgattatttggggccgtcttactctttccctgttttataggaaaagcttttagttttttgtttcctaacattggggtgtggactattactcacaagctggctttttcagctacaacctgtgagtatagatagtactaattaccatgaagtatgaagggtagtgaagatatatgacaaggaaatgaggcagttggaagcctagacaaaaatgtattcagaaggaaatataacaatgaggtgtaagaagtgacgtaatgagtctagatgagtcaacagcttaagtcctcttgttattgtgtggttggggtagtgttttattttttatttaaaaatttttaacttctccagtgaatgtgttgttgaatttaacaggaagttagtgtcagctatgcctgtgtatcagggactaggtactggggatgctaggatactgcagatgagatgcagtctctaacttcaaagaattccacagatgatcagccaataattacaatgcaaagtgaaaactcctatcctagagacatgcgtcctgccatgtgagcatgaaggaacacactggatcgtgtagggtcatggtggtcatggggagtgctcaggggatatcttctcagacagagtttgagctgagtctgaaggacaagtatgttttagatggatgaacgatggaagcacattcgagagcttggcttaattgggaatctacaagaagctcaatgtggctgaaataatgtgtgtggggggatatgatagcacatgaaatgggagtggtaggatagagacaggtaatgacagacttttcctgtaaggagttggactttatcccaaggatgctgtgaggaggacagagatttgggttggattttcattttatcaggatcactctgacactagaatggagaaaggatgatgcagacagaaactagaaacagagagcagattcaggagtgaagcagcatattccaagacagagggaagagacatgcccccagtgcctgttacttgacttggtcaaggaggtaaacaagtttccctttcacatgaaacctcaaagagcaagaaagaaagtgaactctttctcctgtttgctgcacacaccctctccactgctacactgttattctggttagtagcacatgtattttcacattatgacaaaagatatcaagaaagaagtttaccgactttcctggtttcaggccagaatctacatctctctaggtcaacacaggagacaggagctctccacggtactcctgtgatccacgggagggaggttgccttgctgagcagtgcagtctttgtatcagtgtaccttggacagaatgacagcttctacagaacattcagaagtaactttctaattcctttttgtttttaagaagggtattagtggaaaggaagagatttcctaaaagcctattcatggaagaaaggagctgcagaactataaaagaaatattaagattgacctgtttggtgtgaggcagatgacataaattatgagaaataaaagaataactcttttttgtattaggtgattaattagaatcttcctattccatctttaattataacttctcttagcaggttttatttctgatgtttaatgactttttttctagaaatgtaaggtgtccctctgcccagatggtgaacacgtggtcaggggatccaggatccattggatctgggtgctaagtgctggctattttgagaaagtcaatcaatgtattgggttcagatgccttggaaatctcaagattctttaaaggcattttagaacagagttagaattagtcaaacacctttagttaggtaaaggaaattttaattccccaactgtctttactatgatgaatattgtcctccacctcattttctccgaaactgaagattgtatcacattctccattgtattttttgttataaaatatagtacttgacctactataagttcctcaaaatgctttctattgtggaaaataataagagagacataaattgcagtgaacttcccattattgttcttgtgtccttttcctccacattatacgagagaggcgtacaacacaactgtgtcagtgtggcacactaccaaaatgcatcttgtttctggactcctcatcaactgtacacccaacttaagtgggaggaggaaacctgattattgtcctttctagcagaattgctgatgatctttattgagagtctccttgatgaaggcatacactaaggacttggcaggttgtatctccattgtgactacaaccttagctgatagatactgttgtctgtttcataggtgactttataggtcttgcatatgttctttcatttaatcttcacaccatatgatgcagtagaaatacatatctcccttatacagatggggacactgaggtttagagtttaatatcaccagcccaaggtcacattactagtaagtgattaaactggattttaaagcccatgacctttcgcctattatgccgtatggtgtgagtctgggtttgcttatttccaaagcagaaagagtacatagatgaccagagagtatctgagagtgtcctccatgctgactttatggtagatggttttcatatcaacaccatttcgaaaagttctagataatatttgcacaatgttagagcaaagtattttaaattacctctttttttgttgttgttgagactgggctttgaaactccttctctctctcttttaaagtatattccactgccccagcagacccctacatcagtgcctagaaaacaaggaaaagcagacagactcctcagtttacattttctaaagaatcattgacttatgagggattgtgtatcactttgaaaagagttatttgacctttgtgacccaggcatcccatgaaaatagggtgggttgaggaagaaggcttcatgctaccagccatcctctcactcttacaaataccctacctgcagcaagtatcaactcccacctctctactgtcatggaaggtgctgtgggtaaatcactttactcttaagctgtaattattctttttagatcattgaccatcaagagcagtgctgtgctagagctggcactggcacaggaatttctaggaattttgtaagccagtttacatgaggcaacatgttatggcttgaaattggctatgaggggagtactaataaaaccaacacatgttacaaatcagttttattttccttttcctggggtgctggttgttaaacatttactagtgatatatcaccaataaaaggccactggggataaagataccatgaagccatctcagtcaaccaattcccatccatggccataaccaattttatacccaacgtattatgagagggttgaagtggttgaagagaaaagggtgttagtgaaactgctccaaatgttagattttattctttgtctttttcactgatcactctaatcatgtgacctttttaaaacctctgtttgagaagaggaagccataagcatctgaacatgcttgagaagagtggttttgatgccttgcttagctttggtaaggcataggtcctgacttcaagacaaaaagcatgatcttgggaatacagccacccttaggtctctctgacaatgagattttataataagatttaggaccctattctctggcattgccttatgttctataaaatgtgacctagagtattcgcgtctcagtggattcacttgacatttttaagtgatcattgctttcttattttaaagctaaatataagtgaatttggcttcctccagttaaaatgaatagatcttatgttgtctgtaaatgactctcttcagaaaagccaaggggactcaacactgtaaatttagaaatactctgaaagctatggaagtagctttgctgaagggtccaagacatatattcagctaagtaaataggctatccttattatcaggaataccctctgtattagttagggttctccagagaggtatcatatatatcatatataggatatatgcatcttatatataatatataaaatatatattatttagatatatacatcttatatataatatattatataaaatatatattatttatatacatatgtataaaaataggaattggctcacatgattatggaggccaagaaactccacagtccgctgtctgtatgctggagaataaaacagttggattctaaagccctgggaatgggggtggcaggggcagaagtggcatgatagtgtaagttctgctctgattcgaaaagcccaagaaccaggagcacaagtgtccaatgtctgagggctagagaatatggctatctcacctcaagcaaagaaagcgaattcctccttcctctgcctttttcttctattcagaataggaccacaacagattggatgatgcctactcacactggggaccatctgctttattctcttcaccagttaaaatgctaatctcatttgtaaataccctcaaagacatacctggaaataatatttcattattattatatataatgaccaggtatctgggcatcccttacctcagtcattttgacacataaaattaaccatcacattctcctgaagactctcaactctttaatttttatattttagcagtcgagactatagattgctcaggtaggcagtaagagtctttcataatccatttgcattttcaaaaatttccctgtagggtttctatagacttatttatatgagacttatataaatacacacacatatacataaatctatgtatattcatcttttttctgtacttttttccttccacccaactactgttcactcatttttttcctataaaacaatgtaaattttaaaatgtgaaagtagaaagattaggcacttaccaggggtagaaaattaaactaaagttggaagatctctttagacagttcatggcatgtattattctgttctcatgctgctaataaaaatatacccaagactgagtaatttataaagaaaaagagacttaatgtactcatagttccatgtggctgggcaggcctcacaatcatggcagaaggcaaacgaggagcaaagtcacgtcttacatggaggcaggcaagagagaacttgtgtaggggaactcccctttataaacccatcagatctcatgagacttattcactatcgtgagaacagcatgggaaagacctacccccatgattcaattacctcccaccgggcccctcccacaacatgtgggaattaagggagctacaattcaagatgagatttgggtggggacacagccaacaatatcagcaactcttataatgctccttcccatggaagctgtggtttgttgggacaggcaaaccctttggttaacacggaattctactatgataacttcacatttaggttacaccgatagagtctaagccctttgacttaagcccttcactccttgtgattaaagttagtgaatgttgatagatcagcctcacctggtccccactcctgggtcaccagccttggccctctaaaggaatggacattgagaagacaaacttgatatggcctccaggcctgtcacttctccttttctcccttaccctctgcctgctgcaccctacatttctccacccacttcttgtctggctagaaccaggtggtgctgctttagcactatttatgaatttcaaattggggtgtttgagacataggtttggttaagtcttatttgggcaataacagagggaaagtgcattctgatactagtgttgtgagctttaggaagaaagtctatttcaaggacctacaaacaataaaaaatactctatcaactttggttttctaggccatgaagaggaattgactaaatcagtgtacacgtgctgtaagggtggattagagcagtaacaggcataaaatggttgtatcagacaattcttaatgagaagaacaatcccaccatcaagaaaaatgataggaaattttggcagccatcagaattatctgataaataaaatgataagggaatgagatgcaatttcatgttttccagcaaaccaaaagcagggctggaaattagaaaccaaagtactaacaccattgacatcttattcagtctttccagacacatttctgttgtcttgtcactttctgtagtatacaaagaaagtcaccatcttttctcaaagggatatgtgactattttcgtgagagttattcacatatcaagagcaaaaataacttataccattcctatacaggaacttcctaaggcctttggatgttttaagatattaataattaataatgacaatgataaaaaaagacttcataaatatgtaattaaacaaatttgtgctgtcttagaatgtctggaattttatgttggtttggaagagtgttttatgaaaaattatgattattaagtccccagaattgtctgtcatgcttataaacgtaacatttgatacagatttctgttcataaaattggacaaaatgagatcttcctgtttaactgaattgaaatggtatttgaaagttttccttgtaaaaaacaaaaacaaatccttacatcaagacgtcatcttttcccagttgtaggtcagaaataccttaagttactcttattaatccaatgacaccacacatgcacattccccactctggcttacacacatccgtgagaggttaggtgagtgggctgcacaattagcaagcttgggtttgagacctcaccctctcacttgccacctatggattttggggaaaattatgcaacttttctgtgtctcagtttacttttctgaagtctttgccttttgattcaatcaacattttaaaaattacttaaatttgaaattatggagatctcctatgagaaaataatttgtttctctgattctttactacttttaattatatttgcttcatcatgtgcttatgaagattaattgaattaatatcttaaaagcatttagtatagtgtctggctcataataagcactaggtaagctgtgtctattgttatatcctctttctgatttgtacaagattattttatatcaatagatgtttagtgggaagcactgttgaagcttttggtttttctcccccaagacatgtttttctaatttctttgacacactgctatgtgaaatgcatacattaaatacattgacataaaataggctctgtttaggaaaggatgtacttaaacaggttgaagtaagaataggagctcacaaaatgatcatctagaaattgttctagagtctagcccagactctcattcattcaatagttattacatactgtacttgggcttgggaataccaaagagttcttgtcagcatctggtgagtctgaaatcaaaggacacacggccaattaaataccaccaccccacccaccctaagaaaaaaatgtaaataaaaacagtttcaagtaagagattacttatgtgagctcttattggtaaattctagggataaatttttacaagaaccattttgctttaaattctaaatgaatggctttatttctttattttttctttgttatttagttctttcttttattcaataatattttgaatattttgaatagaaccctcacgctataccaaatacaatatcagaaattagagatgtaaaggtgaccaagacagacaaggcttctgcccttgagaggcttacggtccagtaggatttgaaagacagtgaggaacttaatagttctgacaaaaaacggatgcactgaccagtggaacaggatagagacccccaaaataaacttatgcattatggttaactgattttttttttaacaaaggtgccacaagtatgcaatggagaaaggatggtctcttcaataaatgatattggacaaaatggatatttacacgcagaaaaataaaattgtaccctttttataccatatacaaacatcatctcaaaacatattaaagattcaaatgttagacctgaaactataaaactactagaagaaaacgtacaggaagtgctccattgcattgtttctgggcaaggatttcttggatgtgacttcaaaaccacaggcaacataaacaaatgagattgcatgaagccaaaaaggttctgcacatcaagaaaacaattaatagagtgaagaagtaacccatagattgggagaaaatatttgtgaagtgtatatctgataaggcactattatccaaaatatataagaaacacaaacaactcaaaataagaaaacaaataccccaatcaaaaaatgagcaaagaatctaactagacacttcttaaaagaagatatgcagatggccaacatatatatgaaaaaaatgctcaacatcactcatctttgggaaaatgcaaactgaaaccatgatgagatatcaccttgcacctattaaaatagctactatcaaaaagacaaaaacaacaacaacaacaagtattggcaaaggcttggagaaaagggaacacttgtgcatttttggtgggaatgtaaattaatataaccattatggaaaacagaatggaggttcctcagaaaactaaaaatagaattaccatatgattcagcaatcctgcttctgggtttcagtccaaaataattgaaggcagtacgccaaagagatatctgcattcccatgttcattgcagcattaatcacaatagctaaaaattagaagaaacctgggtgttcatcctcagatgaatggataaagaaaatgtggtatatgtacacgatgcaatacatttgctcattttttgattggggtatttgttttcttactattgagttgtttgagtttcttacatattttagataatagtcccttaacagattgttttattcagccttaaaaaaaagtgggaaggctgggtgtggtggctcatgcctgtaatcccagcactttgggaggccgaggcaggtagatcacgaggtcaagagactgagaccatcctggccaacatggtgaaaccctatctctactaaaaatacaaaaattagccaggcatggtggtgtgtgcctgtagtaccagctacttgggaggctgaggcaggagaattgcttgaacccaggatgcagaggttgcagtgagccgagatcatgccactgcactccagcctggtgacagagcaagattccatttaaaaaaaaaaaaaaaaaagaaaaaaaaagaaaaaaaggctggaaattctcttatttgcaacaacatggatgaacccggaggatattatgccaagtgaaataagccaggcacagaaagacagataccacatgatctcacttatatgtggaatctaagaaatttgaactcatagaaatagagaatagaatagtggctataggaggcggggggaggggatggatggaaaaataagagatgttgatcaatgggtacaaagtttcaattagacaagaggaataggctttggtaatctattgcatagaatggtgactacagcaaataatagcgtattttaaatttcaaatcattagaagaatagatgttaaatgtttttaccacaaaaaagtgctaagtatgtgaggtgattgatttgttaattagcctgatttaccattccgtgttgtaagcatatattaaaacataacattgtatcccataaatataaacaactattatctttcaatttaaaagaaattaatttaattacagtccacgtaattgttattagttaagtaaataggaagacatgatgaagagtaaaagttctgctaatgggggcttccttaagtaggatagtttggagaaagctcattttgagctgaaactcaaagaataaaaatgaaacagtcatttgaatctggagaaagcacagttaaggccaagggtccagcaggaagcgcaaaggaactcgaagataggggtgggcatgaagtattaaggcagtggtccaggaatatgagcaggcatctgaaccacctggagggcttgttacaactcagattcctcaattctgcccccagtcagtaggtctgggtacagccttaaagtgtttttctcataagcttccaggagatgcagatgctgctggtttaggagcaacactctgggaatcattgtgttaggaactaaaaacaggagagggctgtagcactgtgagctagggacatatggtaagaaatgagactggagaaggaggcaggggctcctaggagctcaatcttgaaaggaggttcaaggttagttccagattgttgagaagttgaaagttctattaagtccttagtgacaatactgttgttcttggatgcttacaatgtagtcagtcttccggtactatctgattctacatggcctttgccccttaatgcaagtgaagcaaattcagtggaattgataaataacctataatccccgccctgtatttggtccctgatgaacttctgacaaatggaaaagattgcatactttgcagagtgcagacatgctcctacactcaggttttggaagcatgatatagcaaatcaagggtggttacaattcagatcaccctaacatttactggaacactttctgcatcttcacaatagacttagtgccacaaggacctaaccagagaatattacctgatttctaatagcaagcagctttcaaacttttgatgataaaatagtaaaaacataaagcaattagaggattatatgaggagaagacagtgcaatgcgtaataaagtgctaaactgaatattatatgcaaaaattaatgacgcagataataattgctatggccacaacaaagcgggagaattattgtttgaagttattgactaatgtttcatttgaagaaggcattcaggctggtccttagaaaaatggttaaaatttggcagttagagggaaggcgaaagatatggaaaaggcttcgtctttagattcaatcaacattcaaagaattattgtgttttcccagagtttttgctgttttactgccttttacagtaaaactttccataaaccttccatgtgtttctgattattgagtacaattgaattactagccaattgtatggtgagagctgtttggccagggagcccctgtggacttctcagaagcttttatcctttgaaagaagctgtcctgatttaccattgttaatgaaacttgtataacacaatgcttgagtttaagacccactgagaacatgaccacatacctcctttcatctctacatgggggaaccacatggccaataggagctgcagaaagccagcagcagtactgtaaccccagtgttagtaattgttttgaactttcttatgtcatatcctcatagcattgtcttatgagtgatggcctgtcctgcttccacccttcatgaataaatacaaaatgccttgccacccagaagacgaaccctttgtagtcgtgcatctcttttgaacatgcgtctttaggaccctgtgttctttcatttcagtattcttgcttttgtgaggcttacgttagaaactgtgaaatatgctgttattgcaatggtaatatgttttaccctgtcaagtgcttttatgcattagttcctgactaatacatttggtgagtcaaagggctcatctcgtttgctgagattctctgggaaattcatggagttatactgaatattaagatatttcctgtgagctcagataatcctaaatgtatagatttatctttaatcccaaagttaaggcagaaaatgtcagtaaaagagagagaatggttgaagagaagtgccaggcggaccgaaagagtttaatggcaatctgtaagagagagatcatcaaaaaaattttaatgcccccacatgtcagtaaaagatttggagaatgccttcaaaataggtaaatttacttgtaagttatatacatgtactattattcttatatattaacatatgaaagacacacagaaatagaaataatttagaattaattaaaagaaacacaatttctaatattttctttctatagcacaaatgattctcttttgcatgctccagcgcatgcacactccatttaagagaatccatttttagcttggtgcagtggttcacacctgtaatcccagcactttgggaggctgaggtgggcagatcacgaggtcaggagatcgagacgatcttggccaacatggtgaaaccctgtctctactaaaaatacaaaaaaattagctgagtgtagtggcgtgtgcctgtaatcccaactactcgggaggctgaggcaggagaattgcttgaagctgggaggtggagattgcagtgagccaagatcgtgccactgcactccagtctagcaacagagcgagactgtctcaaaaaaaaaaaaaaaaaaaaaaaagaattcatttttagaatacctagagcagcagtgtgctgtagtgcaacggctttcaaacttcagactgcatttgaatgtcctggaagcttgtaaaaacagatgtgtgcctccctgcaaaagtttctaattcaatgggtctggggtgagctccaagcgtttgcattcctgacacattcccaggttgtggtcgtctgagaactacacattgagaaccactggtatagtccacagcatgcgttttagagttactttacctaagttggacatcagcatccttcaattaccaaatgtgtgaccttgagtaaattactgtgtcttcccgagctcagtttcttaaaatctgtaaagtggaggtaatcataattacttacctcttagagtacctggagagctcagcaagataatgtaaatacattgtttagtacccagtactcgccccctaaaaaacatcaatacatgttggctgctaaatcctccttcttctccttctcttccttctcttcatcattatcaatatcattaaacatctttttttatgtcacgaagtagatatagggactgttggtttcaggattaaaaaaacactgtgccttaatttataagaatcatgggaatgattttttttttctgagttagcattctacattaaaaaaagctataatccaaatgagatatctttctagttgaaaggtagagatgaagctattttgcaaagtcaacccgaaggagaacagtgtgttcagccctctcccttctgtgtataactgttgatagtttgtggctaagtgtgtatttccgtcatcttttgtatatactgagttcttgttgcatgagattgagttgacaattttggtggtgtgtcttcaaatgtttgggggcatgagaatggtaaattcaggtgatttccttgaatctaatttttaacatttcttctctctctcctttttctttttttcccctcttcttgtgcattactaggacccagtaccacctgccaggaagattcatgtgccaaccagggggtctgcatgcaacaatgggagggcttcacctgtgattgttctatgacctcttattctggaaaccagtgcaatgatcgtaagtacaacaacctttcatactggaactttgtgaagatgtttggagatttggagaatcttaaaggacaatatgtaaaaggatggctcttctgaaagattcataagtaattctctcctccagaaacttgggaaataaatgactagtgctcttatgagaagagtgaagagatgtgtcttgcttaacaacactaaatattctcccacttgctcactccctgtgttttttctttagattagaatagcgactgagaaacaataaccacagcagcaaaccatttcaggcaatatttttgttgtaagggcttcagttcttcatgaattaaatcaccttatcttattgaatttaactccaaattggttaataattttgagactctccccttttgcattgcctagaattttgaggctatttaaagggtatagctgttttctcaaaaagtttgagttctctgaatttcttaggccttacaaatgacaaagacattcaagagtttattttttacaattagcaaagcttaaagcgttcttgggtatctttcagatatagggtagaaattctctctgactaaatttattggtatctggtttatatacacatagctattctgtatgtatgtgtgtatatatatgtgtgtgtgtgtgtatatatatgtatgtatgtattttctattttgtgagtatattttatatgtatatattatgtatttggtttttattggaagagagtcttgtgattgttaattgtgtccactagtgatgcttctggctcgtgggtttagttctgacttcatgaaggtgcttctagcactgatggtggagacacctcaatgctgtgggcatctataacctgtgtctccacttctttctcatgttattttcttgatgtgaccatagtaaagatgagcacacacttgaaatttctgaataaccgtggcaaagagatttgttgaaaatccctgactctgtgggtcctgctaaccttctgactttctaaatgcagcctttgttttataatccagactcatttgacctcttggttttagaaaaatgatgcatgatgttatctgagaaaatagtaaagtcacattatggtgtgaccacatgggagcagacaccaattacaatgctatgccccccagatctatgtggtttttttgattctttatttctcagctttttatctgtgtgcagctgtctgttgttgttctttttcccgttttttctcagtagttttggtcccatatgctctttcattctcttaaggtacactgaggagaaacaagtggagaagttggcaatatagagagaaaattatgtaatacgcattcatctaattacataagcatatgtctctgtatctgtcatgtgaaggatacgatgtctggagaaagttttggtataagactgctcttaccaagtcttttggtattattgaaagtcatgttgccatatttatgatgtggaaatactgtttcactctgaaacaggtagttataaacccagccagccagagaacctgaggaattatactatatgctctttctttttcctccaatttgtcagtatagcactcactaggaaggcttttttctctaaatggtggcataatgcttctttatcctcacaagtttatttcttgtcgcatatacgtccctttctgggtagaaaatggtcaggaagagactctccacacagaacaggtataaaggtaagttatcgtaacgtggtgagcacgcacaattttcagaaggtaggtatgtctttttctgtctttgacaagttcctgtctgtcacccaatgccaggcattattttctggtaaaaatcaggaaggattctttctagcattctgtgactgtttctggttttatcaagagcagattgtgtctcattctgggatgtggagtatcacactgtctgacttggggaatttgttgggatataatgaagcactagaacttacattgggaaaatgtcagctttcctttgtggcaacagcttatcacagttcaaaaacatttctagtaaatctaggtttagggcaatacattttgaattttattctgtaacaatgcagctaaatcttttcattatagcagacttgggaaactgcctctctaacaggagctacttgcctagtcccccacctggagattggaccacggcttctgtgattggatagatacatagatacatgcaaatgatgaagttcacatctatttttttttttttttttttttttttgagacggagtctcattctgctattgcccgggctggagtgcagtggcacaatctcggctcactgcaacctccacctcccaggttcaagcgattctcctgcctcagcctcctgagtagctgggattacaggtgcctgccactacgctcagctaattttttgtatttttagtagagacagggtttcatcatgttggccaggctggtcttgaactcctgacctcgtgatccgccctcctcagcctcccaaagtgctgggattacagggaagtacacatcttagttgtggagtgtgataagtatatagaattgagacatataggatgtgactgtgaagtttgaatataaacttttaatgaaatccaaccaaatatagcagaatggtagattgtttaaaattattacattggacgtttctgtttccaataattggtattcaagttatctggaagaccttctgttttggaactagcagcaaagccagtttgttctacctagaaaaagcagtctcactatatcatagaccattattttctatagcagccttgacccttagagttataattggctatttcatctcacaaacatcttcaaaatgaagttacctgcatgatattctatatgcttacctttgttgataaatttttggtggcgtagcctgtatcaggactcaagtgttaaccttcatcatcaccggcagacttgaataggctcatgcttatcatcagcaaaaagtggtgggggaaattgcaaagaaagataagctcatggaggaggaagaataatgatgaaaaggaatatagagaaaatcagaaagtgggtcttatatggaagagcacagaggtcatcagcaattgctttggtaacatgcctgccacaagtggcctgcctttgacctaaataacagaaatgggtcacagcattaaaagtcgagtgccatcaaggaaacctggcttttacctaattaattcctgcaaagagagtgttctatagaatgttgcatatagctcaaacaaattgtatccatttaaatgctatcataggaccatgcaaataggttagagatgaaatttaattgtaaaaagcattttgtgggggaaaaatggttatggatatctcattttccagaagctgtttctcagggcaacagattgatcctcaattaatgaacatgaaaacacttcagtttattactacatatccaaaaactgaaacttactcaacagggaaatagctaggtcttatattttccaaaataaggtactaaatccatcatgtgtaaaaaagttaatcatatgtaggcatgacttgtaaggctctaaaaatgtctgcattttagggtattcctttttcctagcattggttcttttatgacctttgtgtttttcttgcctgtttaccaaatatgattgcctgacaatgttaatgtgctgttacatagatgttgcctctatgagtacagcgtacattttaaaacttagtctcatttagtgtgagttggccaagcctggatgttttcactttatttctttattctttgtgtgaccctggtgggttgatggaggcagtgggatgaatttcagtttcactcttataaacatagctgtgcaaagctgatattctttagagctgattgtcttgtataagagtgactcccttgtatggggttaggaaacaaaaatcctctgattggaaatccaagtgtaattgatttgctaattgtcttacatagttttagatatgaccttccacaatgttatgtaatggtaaagtcatggggagtttcttttgggttgacttttagggctgttttgattctgcaatctaatcatcccagaagaaatgttgagttaatgtagaagtcagtatgatctgtggaagaaaacataagtaacattctccaagataatcttcagttctcgtgaaacatttaaaattgagggagctggctattcagagggtgagcaccacctgaaaatcaacttaatgaaagctgtcttgggctacattttaagaacaacaaaagaaatggaaccttacaaaggttcttgataggcatattcttttttgatattgggttcttattagtattttaaatcaggactgagaacctgggaaattctagcatgttgtagccatggcagcaccaggcaaatccagaatctccttcctgtattttgtggtaatattgtcactgtcagcctgctgttgagtttttctttccttcaaacatcgaaaaatgttgtgtagaatagaaccctcctgcatgcacccacacatgtgcaaaagggttgtcatttttatggactttgtgaaaatagcagttttaaacatttcatacctatccttaacaacattgttggcttttaccatgtacatgacaactgttttgagtggcatacaatttgggggtttggttattgcttctggtgccctggagaagcacatataggacagtctttggcacatgagtccttaacacacatcaagttcctgactttatgaggtgggtgctcatcatggctttgtggggtgaagtaaagggaatgaacgtgggtcctcagcccacccttaggagctggccaccctgtgctacattgctggtcacacactgcaggatgcctgttggagaaattcctaggttcacactggcatgtggtaatagatgttctttgcttgcaacaaatcaatagcaagcagctgtggatagtgcagatagtggagtgtaaagcgtctttttcagacagttttctgcaggagtggctattaagctgcagtgttggctattgattggccttttgctttttatttattgtgtgggtttatttatttttttaatgtaggttggtgtattgattaaatctgttaaaaacacatttcccattcaagcttcagaaaatacaagcaatgtatgcattactcagtgtgcaaagaaggggacagatatgtgtatactgattctgtctcttgggtccatataggtacatagacattatgttaaaaacctatgttgttatgaacctatgttgttccagacctattggtatagcagtaatttttaaggatatcatagtatagtacatccatgtttttggttatgtgttcattccccgccattgttttcagactctacctgcccagcgaataggccatatgtaagaagttcacttgtaaaacaattgtttgttgcttagaatgcactttatcatgtattgattcattcactcaccaaacatttcttatttgcagatataatcatgaataagagagttttgttctcaaagaccttctagtctaatggggaaagacacatatgaaggtgcttcagtagaaacatgaacagtgtatagcgaggagtcataaggtggagtaatggcagctgtccccagggttgagactctatgaagagcagctgcttttaggatggttttcattgaagatgagccttgaaatttttttttttttttttttttttttttttttttgagacagaatctctctctgttgcccaggctggattgcagtggtgcgatctcagttcactgcaacctccgcctcttgggttcaagtgattctcttgcctcagtctcctgagtagctgggattacaggtgtgtgccacacaccacgtccagctaatttttgtatttttttagtagagacggggtttcaccttgttggccaggctggtctcgaattcctgaccttgtgatccgcctgcctcggcctcccaaagtgctgggattacaggtgtgagccactgcgcctggctgccttgaaaatttacaagtaggttcaaagcaaacatggtatggaagagggctggaaaggaaaggtagcgtgccagcaggcaagcagggaaaatatatgctgcagtcactgttaacattctgcatgtttccttccggtcttcattttaagcattagcatggttcagatcacattctgtttgacatttttgccctgctttgtttggtttaacactataggctatgcatttttcaagatataaaaaaaaattagatttcccaacttctttcaatagaatgcatgttatggtgcccaactcttggggagaaactcccctatgttgaaatcattgctgagtcctaaatgtaggcctcatagggctcaaatctggatttatttcattgagtcgttggtggagatcgatcttgaaaatttatttataaagaatccaatttttaaaagtttgatttgtaatgtgtataacttattaaatgataaaagaaatcaaagcatagtcattaatttaattggctctagaatcaaactgctttaaatgccagtcctgagtctttctatctgtgaagttgaattgttcacttagcttcctgaaactttggtgtaacataaggagtgtaataggtacttggtaaataggattagtggtagtttttattgtagctaattataatatttgacaactgttaagtccttatcatggtcctgacactctactaggacctttataaggatatcattcttttaatcatccccaaattcttaagaaaatattatagtacgatactcctgattttaattatgacaaaactgagatcacactgttagaatatagctgattgagggtttggtcccaggtttgtctgacataaaagttcacattcttattcgatttgctgccacttagtcattattagaaataacagtttaacatctgtactgatattagactaggatgcttaattccatgtgggcaagtcttcacagacaatcaaactgcataaaaacatagaactgggaaagggaaattgtgttcttgatgattatttgcatcatattgtggaattcagaacatttcaggtcttccttcttaacactcagatgaggccatttagaattaaaatgtctttagccattatagaattagagtatcttgcccatactccaaactatttatattttcattctctgttgacctagatcttctgatttttatgtgtttgctttatttcaattccaacatatgtcatacagcacggtggacgagaccactaatgtgtaatggggtggcctgtgttcaaatcatgactctgtcccttaatatctatgttaccttggacatgataattacagtgcttctaaagtgcagatattttgtaggtcctatcttgtaagaataaattttacaaacataaattgaataataataaattgaatgtgtagtggtgaagtttaggagatatggcacatgatggccctgccggctactcttcgatattactttcaaaaagttaaaaacatgactcatacaaatataattattataaagttaaaaacaaaacactcatgcaaatatagaatgaatgtgtgtcaaatttatttaactccataatgagagaaacaagatggtaacagtgtaaacaagatgacaaaagactatttgaagaactggatatttataggccttaagaatattaaaatacaaattttagatttaaaagtggtaaatgtcctacaaagcaaaaatctcttaacctttggtgttatcttttctatggaacatctgtgctgaacaaaaatctacaggttcagagggcatcttctgtactctgggcccccgctaacaataaatgtcagtgccagtcacaggttcttctcccatagagctaaatgtttctcgggtgggcctgttaaacagtgtccttttataacattagaaagacacatgatttttttcccctaacttttgccctatgttttggataatttttattaatttatattcagtttcatttttcttttttaccttgaatacctctttcatacacaattacgttttttaaccgcttaacagtgtgccccaatgtgctgaattcattgtcatttaaaccccacggcaaccctaaaagtagatactattgtgataccagtttcatagatgagagaactgagacagaaaagtcaagtgatttgctcaaggtgacaaaactattaggttgaggaacaaagattcagagttatgttagtctgactgcaaagtctgggctctggactgccaatatcttcttaatgcctcagggaaagtttcctgatgagaattcatctgaattcataggggtttagattcacattagccacagagcttaacgacttttgttagcatcaattatactgtaatttctagtgtctgtgttattcttttgggggggatgctattttattttattcactttaaatgagggcatttaaagtaggactgatttgctcggggaacaagatcagaatttccatcaaataagtgccattttgcaggtttggtacatctaagcagggaggaggctgagtcctgagaagtcagtgaggctgagaggggcagcatagctccatgataaccaggtcccagaaggcgagacagatgcaaaagaaacgtcaggagtggcagcaccaaaggttatttctctgcatctgtttttattctcgggcccacagatattccatggagccaaagggaagtcagaagataacaatgaaacccagggtcttctaagagcagaatgaagctagcggtactcttaggaacagttctatagatgtgggttgtagcttgttgcccatgggaatcacacttgcttttaagttccatcaatattaagaagggatgatttggagtattctcaagctttatcagggctaatattaatatgtgtgcaatactaaaccgattcagcaagagccaggactgcgtgcagctttgtttttcacaaccctccctgaaaataagctgggactcataggtgacacattggtttctacaaaccccagtagacacttggtcctatggttcaagaaaaaatagtctccataattcaaaggcatatagcttatcatggattatcataagctgttggagtttgtggcctcaataatttcatttccaccatcttccacatgctatatttgtagaccattttcattgctgtgtttaattatagcccattcatttctggtgtccttggctagttacttacttaaggtgacggcaataatccacttagagcctattgcttcacggaagacaatttttgtattaccatgttagtcacatacaggtgcaattccaacatatttttcaacatggacataatttcctatagttatttccacatctaaaggcacaagaaagatctaaattactttactttgtcttgtaaaatagaaataataaatataattttgttcttttcatttatttttctcctctactttctttttagggaaggaagagatcattttttgaaggtggtaaaatttacatccagcaaaatgcatagatcttacatgcattatcacaaatgcttatacccaagtaaccaacaccagttaagataaaggatagtttcatcttctcagaaacttttcttgttccctttccggttagttcttctctttaaggtcattgctgtttgaatttgtatcagcatttgttatttttgtctcttctggagtatatataaatggaatcatacaatatgtgatcttttaggtctgttttctccagctccatgtcagctctgcattctagccagctgagagtctcttctgagtcttagctccatctatataactgcaggagttggctggattccagctggaaccttcctgcctgctccatgatgcagaaattctctccaggcagtaagctggagcagtcttaaatctcacagtttatcttctctatttcagaaaccactgctcttctttgcctgatgtctcatgtctcatgagccattgtttcatgtgttgtcattttcccggttatatcaggtcagttgtagttccagtctttgttactccatttaggttgaaaattgatgccaacctattcttttttacctgacttcacctttgcactgtgagattagggtgaaggtagcaggagaagacataacatgtaatgggctgtgcttcaagccgcaaattctaagggttttctgaggctttacatcagtcccagagtgatctggcagtatgtaatattctacaactgttttatttattcatttattttagggaaaagccttcaactccagtgataatccctctgtagtcaaagaaccttcttggccaaagaaaacgttgcaagaagctgcgcaaagctagttaaagacttgccaatgtgtctctatcaagtatttattaatttgagtgtttctgttaggagggctacattaaatttttttttttttttttgagaaggaatcttgctctgtcacccagactggagtacagtggtgccatctcggctcactgcaacatccgcctaccaggttcaagcaattctcctgcctcagcctcctgaataactgagattacaggcaccagccaccatgcccagcttttttttttttttttttttcagtagagacggggtttcaccatgttggccaggctggtcttgaactcctgtcctgaagtgatcctcccacctctgcctcccaaagtgctgggattacaggcgtacattactttttacttccactccctctgaaaacacttgattaagctcagtgattgcaggcattgatttgacttgaaaagctagtggttcttattattttcttcacttagaattatagtttattttctcaacctacccttttcttgtggatctttgaccactgattcatgtccctttgccaagtgaaattaacaaatgttttcaaacaaagaatttggagacttcagaaaagtggagttgtttctataccttgtagtgttttggccattgactgtccttattttgatcaccaggcactggtttgcatttatgattttgctacatgcctacggaagaaatgaaggaaccttgcattattggtacctttgatttaactgagtttttttggatatggaaattataaaagctcactgctgaaaatgtggaaaacacataaaagtatgaggcagtaggaaaaaaacatgcttaatttcatcaactattaatatgaccttgtttcagaatatgcatgatgtcaggcacataacagatactcaaaatatatttgttggttgaatgactgagtcttgcatattttcagcatctgagttgtgcaaagatcttagctttcttttcatgaaaagaacactaacagttttactaggactaggtgttttcttgccagaagaaatgcttttaggcatatgggaattataataagtatcccaatatgaaatttccttcttcagataaaaaatgaaaatgtcaagatggttccatttcttttcaatcttgcccttctcctttctcaaagaaagccttgctgtttctgaacagtcattcatacatacatctatataaaagggaaatggttttacagcggatcatggttggagggaaaacaccgctataacataatatgggaaaagagcctcttggtcccagtttcttctgtggcactcacttccaaagtgatgttgtggtttatttcacaagatgagatttcttgtaacagtctagtactctagtgatcgagtgagatagtagaactttatcgtcaatcatcaaatcccacagttttatgttgaccaaaatcagtactacatgattgaagaagttggatgcattatatactgaaaatgtaaaacacaaaattcccctgatttttttcacaccctggattgcaaatttttatttccctgtaggagaattcagtcaaaccttgtaaactgtaacaactctcaggagcattggtaagaaacaatatcatctaacttcaggcattatttcctggtaaattaactacatgctctttgaaatcagccctttactaaatctaaaactgcagttttactcagatattcttatgtgagtgaaatcaaatgcatgtatgtgcatacatatgtaatataaataaatataagttttctttaggagttttcccaattcttctgagatgatttttctatccaaatacctttgtttctatgtcttaaggagttatagctttcggttgcatcttagtccattggcaagacttgtatttctgtaatttctgtaaaggtaaggtatctacttgggccacagatcaggtatctgtctgcctttgtggatgtttggcataaagcccctttattccacctaaattctcgatatttggggtatgattttatttctgtaaaaaaggatttaggcagggaggtgtcatctggattttatctgcccttaagagtaagtgttctttctcctctccctatctaaaatttccatgtgattccctcacactggcactaaagtgtgtcatctggttagagctcacatcagtgccctgctgctggtggaggttgcgggaggtgagctttagaaaagggcctgcagctcaacatacatgtcatggacacaatcgtattgtccccaactcatgaaaattcctgagaacagagcaaatcaaaaataatatgttaaaacaagaaagtttagtgaaacaaactctcggtattgttagaggctttattctaatccctacaacacagcacatgtattctcaacatctaacatatttaatttgcatttggattcctttagcatattgtcctattatataaagtttaatgaacaataaacacagctataaccaaatttcacagctatttctcagtgtggggtaagattttgcatttagttatatttggtttcctaggtaatatttgattgtggctctatttcctgaagctgcatctcttgtcacatggaatcttttggtggcggattctgccgaccgaggggaagccaggaaggagtaagttgctttgaaaccactgaagccatgatagtgaagaagacttcacagtccttgacagtctttgagctctccattgttgttctccaggcttgtatttctgaaatctactgtatgtactagttccagatcagtcttgcccaaataccatttttatcctgtcattcctctgctcgtgaaccttcaatgacctcttctcaatgtagtccaaaccctacacttggctttcaaggtcttccagaatctgtttttcaaaagctgtccctcgaaccacattttcttgaatattcatggctttctatattctaataaggtcaggtttctcgctgtcactagcacattctgtcgtcattatgctccatgcccttgcagctgtacttctttctccctggaaggcgctcttctctggatctatacccctttggggttcagcccaagtctcacctattttcccgagtcttctttggtcagttaaatccatactcatgccttatcccaaatcccactgcatttatattcagtgctgagagacactctggcttggcatctaaagggaattagcgtggacctgagagtaaaaggtcagttcaagttctggcttcttttctttctaatttttgtggcatttgtcaattaatagaaggtgatcttactatggaagtctcacaacagtctcagctttgttaacaaagattataaataatgggggcaaagcagagtattgggcctgggaaagagtttttgtaaagcttcaggtagaaccttatgttagaaatgtaaaacctcctctaaagaaaaatgttaccaataaataaagcaagtaggattttgagtagattatcatttttgttgtgtattcaccctgtttcctagagaatcaactttcctactttgtgcttactatagtttcctctagagtaggggctaactgtgtagaagaggttgtgtgtgggtcgtagggttactgggattagactattcaaatagcacaaatattctgtgtattctgatttcaaatgtaaacatattcctgattggaaatgtgtatatgtattttttatttttagttctggggtacatgtgcaggatgtacaggtttgttacataggtaaacatatactacggtggtttgctgcactatcagcctatcacctaggtattaagcccagcatccattaggtatttttcctaatgctctccctcctctgatcctatcccctgacaggccccagtgtgtgttgttcctctccctgtgtccacgtgttctctttgttcagctcccacttatgagtgagaatatgcagtgtttggtttactgttcctgggttagtttgctgagaataatggcttccagcttcatctacgtccctgcaaaggacatgatctcattcctttttatggctgcatagtattccgtggtgtatatgtatcacattttctttatccagtctctcgttgatgggcatgtgggttgattccctgtatttgctaatgtgaatagtgctgcaatgaacatacgcatgcatgtatctttgtaatagaatgacttatagtcctttgggtatatacccagtagtgggattgctgggtcaaacggtatttctggttctagatctttgaggaattgccacaccgtcttccacaatggttacacaatttacattcccaccaacagtgtaaacgtgttcctgtttctccacaaccttgccagcatctgttgtgttttgataagtccgtataatttaattagaaacctaagtaggttttggaggacctactacctttacttaaacatcctgaattttatttatttgtttattttagaattggggtcttgctctgtcaccaagactggagtgcagtggctattcacagctgtaatcatagtgtattacagcctcaagcttctgggctcaagcgatccttctgcctcagcctcccaagtagcttgaactacaggaacccatcacagtacccagtatatcctgaatttttaaggcagcctctccaagaacattctgaggtgttctggtgtctttagtaatcttatctcctaattttggttcttgcctggaatgaagaaaattactggtctgtgaatctttggctcttgtcattgtaagacttagggaacaatgctgcaatttttgcagcctctgtaatgaccagaactttcaatacacaatcttaactttgtagatattaacttatttttaaatctgctcatttaaagccataaaatgtaatctaatttagtctttacaatgaaatatttacagtagataatttcacagtcactgctccctaattcaaaacgctttgagcctgaagctctaaggccaggccagcttgagtctgatactgatgtgctttaacatgaaacgtgagaccaggaagtggaagacccgtagccaaactctcatccttattcacagtaaatttcttgacagaagaaaccagggaactatggggtttctggtttattatctgagtggtctaatgcaggaattattgcctgccatggggagatgattgcagatcactctccggtggagtttgactgaacaagaagccacatcccaggtctcaggaataatgttattccacaccctccctgttactcaggggtgctctatgatgggctcagctgccgaacattaggggattcgaccaaaaccttaatcatggcgattttgataatcagttccaatgagcagaatcctgtgggctctgtgaaacccgtgaagctgatagtattgaaggaaatgaaatgtgataagtgtgattgcttgacatgccagaagggggttggtggagaaagaattcaaaaaagaaaatttagctatcttaaaaactggcacttctgagaataattatgtagggaatttgcactttcatactctaggtgtttctgagaacaaacacatcttaagaatttagttagaatatgtagataataaagatttaaactgattgccaagggtcctcacacaggaatgatttttcttttatagttaatttattaatttgagtaaaatgtgattcatttacttctgagcctttgcatggtgttcatataaatagtgttgataatttctttctttctttttttttagactgtatctcactttatcatgcagtggcttgatctcggctcactgcaaactccacctcctgggctcaagtgatcctctcacctcagcctcccgagtagctgggactacaggcacatgccaccatgtccagctactttggcatttttggtagagatgagtttcaccatattgcccaggcaggtctcaaactcttggatgcaagtgatgtgcctgccttggcctcccaaagtgctgggattacaggtgtgagctactccacccagccaatagtgtttgtaatttctgatgacaaatatttcatgctaaataagtagccgaccaggaatgaacaagtaattaccaacagtggggcacactgttgtttgatggtatatgttttcctaacatgaacaaactcccttacaacttcaacatctgtgccttaactaaaatctggacatgctgcattgagagagcatctcttggaagtctcctttagtgaaggatgcttttttcctaatgttttaaattcctggagtcagaccttgattctacaatcattcttcagtgatgtttcttcttttaaggtcacgtattttttatatgctgtcgccccgtcctcatcattagcatttattgaccttcaggatgtaaaaaatactctgagttcttcccttgtagccttcttctcactccatcctttgcattgtccttggtgacttaagttttcatgttgtattttttcctaataacctgatttcctcaaatacctggccacgtagcaaagggagtttctattgctggtactgcttcctaagttttcagttctcccataccttaaacctcctgacactactttctgtgtcaataatctcaaatgtttcactagcctccatgtggcagttggagtttctagtctagaatacaaatggtattcccactaatacgcaggagctcttgcctcatgacttgatacactatccaaattccaaagacattcccttgctcggtttcttggcccctgccttacagctagaaaaagtcatgtacttggcaattacttcctgtaaatccatatcctcttaccttagcaatgccctcagtatgttcttttttgtggccatctaagctttgtccctaaattgtgaccattttcttttctactcaataatatctcattttctacgttggtagttagtacttactcagtagaagttatctgatgagagtctttcttcatatttctttgtgtcaaaatgcatttttatgtttaaacatctcaaacctccctggcaattaagacattttgggacttttctccaaacataacattccatttaagtctgggactcactttcataaacccatgcacctgtgggaaaactctcttccccaacgtgccctaaactttattgatttgggcttaccttccttaccttgttcatctagatatgttcaatgggccttgtactgaatatttgtgtggtgtttacatgtttatacatgtttacctgtgtgtgactttttttttctaatttgaaccaggactatgtgattattttacttgtacatttcttagaacagtgtcggtcctcaaaaaaaacgagtgggtttcttactctctttcctttctttcactaaatatttcatcattgtagcactgatcttacacatatttgttaatttttctggctcattgtcaactgtgagttctacagggtaggtacaatgcctcgtttatttttatattcccggtctctgtatcaaacctacataggatttgcaggaaatgagccactgggagtttttgagcaagtgtgtgatatgcccaaagatatgccttagaaagattcctcctggcagagtgtgagaagcaggttgagagaaaatagtaagctttgttgagagaagattgtaagcctttctgagagcagacaacacgtggctgcataaacagaccctagtgcaatgtctgatatatagtgcagattcaatgaatattttggggaagaatgagcaaaatcaagaaagctattaggaggctcttgaaaataggtgtggtaaatggcaaaaaacaaacaaacaaacaaacaaacaaaaaccccaaaagcatgaactaaagtgtcagtactggtaattttagggttagcctcaactttaaaaatagaatataagctgctacatacacatgggcacagccaattatagtagtcaaagtatagtagtcaaagaactggtgaaatggcaaacatttaagaaatttactccatttttaactttataagatttgattattattcctttatagccttagctttttttttgtttttacaattaaagatgtttttaagttaaaataatccacttatattagagcctctttttctattatccagacagcacatattattctatccattaaaaaatgtgaccattaaaaatggctagaatagcttaataatataatatcatatttattctatgatttccagtggaatgaactgttatggtctccctgattgattataattttaataaacttggttgtgtgtggctaggaacaagttcattccaagttcattttttccctgatgtagataaaattccatcagctaagttctgctactgtgccccatctccagacttctagctaaatgaagtactacagggctctgattcttgctcaaactcactactgctaaactgaaatgcttgaggtattcaaaactgttattttctgcgtcaatttgatatatgtgcagcatttcttttttaaaaggacatgttctgaatgtttagagtgtgtagataaccactcccaccccccaacacactcacgtaacagaagaaactttggatacttttattgtgtaaacttacagaatttgtgtcaaagaagttcatgtggcaaagacatcaggtgtatcaaatattttggtggttttgtttaaattcagagtgagaattaaccaagcatctacaatacgtacacctgctctgtattctaacccttttgttcatggcatgcacattaaaacacgtagctccacttcgctgcattgttgattgcagttgatgatgagggttgtcgtttctgtcaacttttagtattgaagagaagcctcatgtgtagtgatgttagggacagttcagccatgttacatacctagaattgtctctgaaaaaaaaaagtcatgaactttttttttttaaaggcaatagaaagcaatcaaccaaccaaacaaacaaacaaaaaaaaacaaaaagtctgggcgtggtggctcacacctgcaattccagcactttgggaggccaaggcaggcagatcacacggtcaggagatcgagaccatcctggctaacacggtgaaaccccgtctctactaaaaaataaagaaaattagccaggtgtggtggtgggcatctatagtcccagctacttgggaggctgaggcagaagaatggcgtgaacccgggaggcagagcttgcagtgagccgagatcatgccactgctctccagcctggatgacagagctagactccatctcaaaaaaaaaaaaaaaaaaaaaaagcagaaaaatgtgttgattacagagttaagggggagaaacttataaatcatggttatttaccacccctgagaaggtaggtacaaggttgactactacttacctcttaatcctatgattttctggttctgtggcttagaaggtttaagctctgtcaagtggctcaagcaggacagcccaaggtgactccaattctctgtgactttgttttcccatgtgggaagtaaaccctaccgctgtgttgtaaactgtttagatatccacataagaaggggttattcggtattttgggggggcttaagataaaagctatctccatttgagaaattagaaaaccatttctacaaatcaactctgttaaaccttgtcgccccaaatcaatttaggacaaaaagcagcagcacattacttttttaaaagcccaattcaattttaaagttttgaaaaatttcaagcaaacataaaggacagaaaatgttaaacatccttgtactcaccactcttaacaagcgtcaacattttgccacatttgctgaatactataacttacttttttgctttttaaagtttttattattgaacacagacaagtactatatgttaatatgtgcaatgtacaagaataatgaaatagtcatatgtctactacccaacttaagagttatagatttattttttaaagaaaaagtataattactttgagcttgccagcgtaagtttcctcctactctctccctgcaaaaaaaatagttgtgtacaaaataaaattcctggggttgacattcagatgaccccaatgaatctgattttttttcttttctttttttctctttgctttttttttttttttttgacagagtttcgctcttttgcctaggcaggagtgaagtgatgtaatctcagcttcctgcaacctccaccccttgggttaaactgattctcctgcctcagcctcccgagtagctgggattataggcgcccaccaccacacctggctaatttttgtatttttagtagagatggggtttcaccatcttggccaggctggtcttgaactcctgacctcatgatccacccgccttggcctcccaaagtgctaggattaaagacgtgagccaccacgcctggcctgaattttttttctgttgctcttcaagttagatggtttaagtaatgatgtttgccgggaagagatttgaggacctaaccgtgagatagtcctgccctgttcaggtctcccgtgtttcctcattagaccttccagcttattactggaaaagcattcttttctccatgttttaaacacctattgagtatgaatgttttaagtgcttattaaatactggttcataactctttgtaagagttaggggagaatcatcaatatctggaacaacaccattcttcatgatattggttttgagagccacgtgggcagagaaataaattctagaaaaaaagaaatggtaatctgacatgcagacttggattataaatatggtcaaaggtgtacttaaaaacaagatattttgcttcttggttagctttactgagaatccagggatcaagtaaaatcattgccattggtactgacggttgagagtcagtgcgatgctaaaccacaggaactccttacttctatgcatgattaaatccagttgtcaggtttgggcagaagagagccctccttttcctcaagtctatagggaggtgctgtgggggagttttctcattttccagaatatacagagcaaggatcatccatcataatcagacaggggtatttcatatcatccatttccagtgagaactgtggtaaaattctgtcctttttcccatttttggctgctgtgattgaaacccgtcttataaacagaaaagggtagtttgagttattttaaaaaataagaatccttcagtctctgttgcccattttctcctctatgaataatttctgcagacaggtgaccagttcaaccatctctctcggttacaaatgcctgtggttggtccacttccttcagccttggagtaaaataaaggcttcttttgcaagatcacgaaataattcagcaaatactgtgggactataaggtattcctgtgttgtcaccttttcttttgaagaatatagagaatatgcttttcttcctctaattcaaatacatagattccttatgcttgtataatgaaagaataagggctctgatacatacatatcattgaacaactattatcagtattaggcaatttagaaaacaaaaaataagacttcagaatttatatcagctccttcaatacttcatttagctggatccatttaaatatttcattttttagcctatgttgtagtagattgcttgattggtccaaggtagtctctaaatccaattagagaaaatgaaattcaggaagcacatcactgtagattttggtacagtgacttgagtatataattgccatctctttctatgttagctcaggggtgggttttgtgccataaaccaaccatccaaccaccagtctacccacctacccacccaactaaccatcatttgggctatatctatctgcatatcatacataatatccttgcaggaattaatccagcatccatatgagtgtaactcatacctaggctgataacaaaatctgaaaggtttttcactgaaatatatcaggtgactaaagaatttcacaacccaaaagaggagggtatatcgatcctagtggaattctatttcatggattttgttctgcctttattgacacagttagacattaaagagaataagtataataacaaaatttataagaaatgcttatggaatattttctaattttagctacaatgatgggttgtttatattctgtggtttgatttttatatcaatctttatgcagctattatcattacccaaacaagtagatattattgcccctttaataacagtgaaggaaactggaatgtaagaattgaggtaactggcccacacaccacaaagcgaggaagtaggaagctggaattcacatccaggtttgtctgttagaagcccatccccttgacctttctgccatattatctttccttatgctgtggcacaaaaaaagaattgtgaccataccatcttcccagagagggattagacaaagtccagagaacgtctagatggtcaggaactctagtcatggcgatgctagttactataagaggatacttggcaaacagcattgcacccagatggtgcgcaacccacacgtctctatttacgtagaggtctcaagtgtttgtattaacaggtttggaggataataaaaggagttgttgtttgttctttctttgtacgtctgaaattaatttttagcataaatttaaaaggggagtttgtaaattcactagacactgagagactggagatccaagcaaacatttgtctgttgagtttaaaaagatctggtgtaaaagtgattgttttctattttgcccactaggtggcgctttggtctcacaggttccttttaatgggctggatttccccgcccccccacctccccccaacccacctccccccaaccccaccccatacctagatgttggtccaggaaaaaaaaaaaaaaaaaacaattcaagactgattaagaggactatgtcagttgagtttgttcagtttgggttttctctatcattatccatgttgataacaaagataattaaacttatttgaaaattttggacactcctttttcaaccttcttgcaataaactgtattcacttattttggaaaaaagcatcaataaatggaactagtgagttatcttctcagcatgtctccacaggctacacttacaacagtctttcctcctacagagcggggcaagtcataggaagtgactaaaaccatgtcatttgggtgttcatattaagcacactggctatgagatcgccccggaatgtatacacagcccaacatgtcattttcttaacaccttaacatcagtgtggacaaaaacaataaggaacaatgttttaaacatgtttacatcaaagaggactggggtcataaggaagcagttcgatgggagaataaataacattattccaaattcaataaaactgatcagtcattctacaaatgtacactgatttgactcattccattaccatgcaagaattttatttgttgactgttgtgaagacattcctgtcatcaagaaggaattttctaaaattataacctgagatagtagtaagtgatagaaaaattcactaaatggcttttccatgaaataatatttatttatacctacttctgaatacctactatgtgctgagcaggtgcagggtgatgtgaaacatatattaaatcccttaaggagcctacagacaaagattaagagatggctgaaagatagtgtatccaaggtcacgttggcacagattactgaagtgagtggggtggcctggaagaacattaagtggacatttaagatggaacagctaataagacaaaggtaaaatgagtctagaagaatgactagactgagaagagaggaaaggaaagaggcagaaatagtagaatgtagaaaagctttaggcccatggtgattatggagaattgcagaagtccagtaatctagagcataataatgcatatgtggaaagagtgggaaattggggccataggtagaagccagaatcagggactttgagtactaaattgagcatgatctattttctagaaggtataggagagactttgaagaaggctgtcacttgctccccacgtaaccctctaagaaggcatgccattcacttccactttccagaagacacaggtgtgtttccccagaagaccatctggatccagaatctgtgcagactgaccatctatcatggtctttccttgtgggaattttaagtcttgactttccttctggagctttccatgcgaccgaggaagtgattatacaatagcagatgagatccttggtataattaaggattgcttgtcactttcaacatttccccccatcaaaccgtggacagagaggccttggaagggtttagttctgctaccatactcatttaaccctgctaagcatattttcttcagcattttgcaagcagaaatttatagtaatgttttttgacactaactctgagtcctgcattctctgcctgacttgctgtatttgaaggtggtagcgaaacacatggtgtatgtgtatgtatgaagtaggaggcatggtggtacagatttagctatgggacttttcagctttgcctgtatgaaattcatttactaagtatatgtaagtgaaattccagcaattcagaaagggttctggaattgcttaaagcccatcactgcttgtgaattcttcccacattaaaatgttatcttacagaaggtcaaaatgtctttcctgcatgaatataataatgacttacaccttagactgtaaccattgtgaatttattctatgtgtatctatctctggttttctttgttggagtggcaagatttaaagcaggccaattttatgcctcattctatgtgcaccaaaactacttacatgatattggttttcagtgcctgctacaacaaaaacaatatcccagtaacagcccactttactttctgtgggtagacaatgccctcacaggggttattaacttctcccagagaagcttttgtctttgcaatcctgaatgcatttctcttcatattagattttaccagtcaccttgttgattatgaaatgctaagtcagggtctttattagactgactttgctttccctttaataattcaggtaattattatatttacagaatttgcctattttttgaaatcaacactttgttaatcaccagacccatgacaatctataagtagccactttacgtggcttatagatctaaagtgaatgttggttttcacacattcattcataactattatttttactgatatattaggcaaaatataagattcatttatgagtttgttcatcagctagttataaaattcctgttgcatggtaagtgctgtctgtattgggcaacagagataaaatgggaaacaaaacaaaaatcttccctactgtcatggggtttacaacacctggacttctcaaaggacactgaatcaaaggttcttctctaagactttgtatgaagtcttagtcagaatcaaagatggttggcaccatcattcactaaagtggcctgagaagtaaaaaacctctgtatggcaaggagcagtgggacctctctttttttaaacttttattttaggttcaggggtacatgtgcaggtttcttacttaggtaaattgcgtgtcacagggatttggcatacagattattttgttagccagataataaacatagtacccaatagcttttcaatcctcaccctcctcccaacctccaccctcaagaaagccatagttcctgtcattcccttctttgtatctctatgtactcaatgcttagctcccattttttaagtgagaacatgcagtattgggttttcttttcttgtgttagttcacttagcataatagcctctaactccattcatgttgctgcagacatgatctcattctttttatggctgcgtagtattccatggcatatatgtatcacattttctttatccagtctactattgatgggcatttaggttgattccatgtctttgctattgtgaatagtgctgcaatgaatgtatgtgtgcatgtgtcttcatggtagaataatttatatttctttcagtatatatccaataatgggattgctggctggaatagtaattctgttttaagttctttgagaaactgccacaaccattggtggggagctagtgcagttgtttggaggtaagaaaatactctggcttgttgagtttccagagttcttgtgaaggttctttctcatttgtgtaggtggatgttccttcaatctttgaagttgctgtcccttggatggatttttgttgctttcatcttctttgatgcccttgggggcttgattgtggtataaggtaggttcagtcaactcatttaagttcgcttttccaggagtcactggggaccaggaatgagtcctggtgcatggtaatcccatgcagagttcccagccatccctctgtcagcccagcacctgtgtcttcccacatccactgtcaatgccttccctctgagatttgctcagagtgcgcctgtcttcgcaatgtccccatctcttggtgacagatgttcctcttggctgcatctagtcagccatcttgaatcaatctctggacctctacttaatatccctgagaatctccttctctgttgtcaccggtgcaccaactgccaaagacaccatttttgcagtgtttggtggggggtttgtttacctctacaattgcgtaactgaatgaccctgagcaaacggtttaacctttctataattaacaggatttcttcttacatccaagccctccctgctgctctgacccagctgtgggtgatagatcattttcaattctgcaaaccacggctgagaaagatggcagtgtgtaaggctcctctgatagattaggaatcatggaaggaagggacattggctgctagctatggctgctcagacagacaacccatgggtcttggttctctctagtggatctctacagggcttccttaaagtcagaggctggctttgccttaagattcttgagcatgagtagaactcccaacccaaagtaaagagagcaaaatccagagaaggacttttctccattctaaggcccgcctcccaagtccttaatttctgttttaaggtctggctcatctcaagaagaatgacacttgaaattatgacacagaaagaccctgtcttctacccaaaggggtgtggcattgtctggtgatgtgggctgcttaagcacgtttaaacacagtagtccaacaccagtaaatgataccctacagcagggagatgtttccttatggttctgttgaattctctggcagaatgtgaattctatccaacctcaagatttgttgcttatctagtacgattggctgccttgtccacaacatcctaaaggccctctgctcttttctcttaaagggcactctaaagtgccttcccagtgtgtaggaacaggactgaaagggccgtttttcttggctgctggtgactttccaaagcaagtgtctttcccttctcaccttgtccatggccccttgtgccctttatttgctctttctgcctgatgtagcagccacaagctgagagggctttctgtgaagtggcaggacctgacataagcagctttgtgcagtgggaaggaaatgtttatgttattatacacctgggacctctaagtccacaaggttcactttttattgtacacctgggccatccttttctacacttctggctcaatttgtttttggtttggtttagaaggttttcttctccctaaaatctcccttaagtcttaggccctttttatgcagaaatgcctgatctccaggctcaaaaaaagcatcttgtgcaagggaaatcgttttagatttaggaaacctcttacacagtaaatttgaattttcaaggtgactgaaaacttaaattcaacaaatatttttatccacctagtttatactcaaagtgtgctagatgcaagggatagcacggtggtaacgatagacatggtcccagctctagtagagcctgtgatctggtggagaaacaggcactaaatcaatagctacaagagtgatgaatgttacaaaagaagagattccagatgctacaggtacatagagcaggaggatttaacctaatctaggggatttggggagttttcatttaactctgctgttgtctaactgaatgaccctgagcaaatgttttaacctttctataattaatagcatttcttcttactcgccaagctctccctgctccagccaaggctcctgggtctatgaactgtaacgtcaagagagaatactgtcaacaacagtaagcctgactgcagagagtaaacacaaggagaaaatggccttggaaccacagagtagactccagagtatcaggaccatttggaggagagaatggggaaaaggctcgtgggcagacagcagtaaaccctgtgatagacattccatctgtccattagtataaacctggcacttagcccagtgatcctcaaatatttgtggaatgaatgaaatgcaaagcaatgtcaatttctgtccacagctgcttgactcttaaggttagtgttgatccctttggggaatataggcgagcagatgaccccatacattggctaactatgaattgagtggatccaatgaccactgccctccttgtgcagatcgccccacggatcactggctgtgtgtgcccatctacccctttctacaagaacttttctagccctgccaagcaactggttctgttcatgatgctgtggggttaccacaaaatacgtaatagctccattcacttagaaagactcatcctagataagaattatcctgcctcatctacccctccctcatagtttttcatctcatccattccctcctcctccccatgccgttatcaactttatacattggaccccatcctgggactcatactctgctaatcctgttcttggagttagggaggttattcaagtggcttggagaggagatggggaaagtcactctagacaagaaacattcagactctacctaggactaaggtcaatcacaatactccaagcattactggagcaaattataaccgtagtcgggtcagcttgcacattctatgctatatatataatgagggagatatagttttcatggcaggttctctgttaacaatgggcaaagactttggggattgatgtctgcagggaaaggatagaaggaactgaaacttctctccacagaagcacctgaaacccagtctgtgggcctttcgtgtcagaatctagtgaaatgattttgacaccacacacggcaaatctgtgcatgtttttctgtaacaaagaactgagaaaatcaggagtccttatcaaagggaacctttgatgaccctctggtggtcaccttttatagtgaaaatgtttggtaaatagagaaaaaggggccaggcatggtggctcatgactgtaatcctcgcactttgggaggctgaggcgggaggatcacctgaggtcaggagttcaagaccagcctggctaacatggtgaaaccccatctctactaaaaatacaaaaattagctgtgcatggtggtaggcacctgaaatcccagctactcgggaggctgaggcagaacagttgcttgaacctgggagacgaaggttgtagtgagccaagatcatgccacggcactccagcctgggtgacaagagcaaaactctgtctcaaaaaaaaaaaaaaaaaaaaaaaaaaaaaaaaaaaagagagagagcaagaagagtgaaagttataaatgaaaacaataaaaaaaaatccaagaaactcaaggaacctttgatgggaaaactgggtttttctctgacctcactactttcccttaaccatcatagccctgccacttctacatgcattggaggaagtgatttctccactttctgagatcctagaggacttaatttgcatctctatgataagaattttaccattatgatctttttattctcatctgttttattgctacaggattatgggctcctctggacagtgttttattcatcttcctctctcactctcctttacagagtaggcccctaataaatatatgcagaatgaataagcaaaatcaataattaatagatagcaaatacattcatgctgacttctatgattctttttctcttttctgtcttaggtttttaaaagtagtacaataaacctattgctagtgtctcaatatttgcctccaagagaataaattgtccttttaagaaacaaaactatctttatctaaatcaaggctgaaaaagatatctaggtacttccaagttactgagcacccctgccctggctttcaggaattacagctgctgattaaacatctgtttccctgccttttctctacttattatccttctctacttattcatccttcaagactacttgaatttttatcttcttactcagtaaaggctttctctgtctaccaaagctggaaacgtttttttcttttctgatatctagcatgactcattactattcccattcattcagtacagatgatgtagggacaagcactttggagacagtaccttggttcaagtcctactgtgctactcagtgatggtcagtgaccctttgatcttgagtttcctcgtgatgttgataaactcctgtgttgggatgactggtctagagggtgagatgaggatatgcatagaagatgcctattccaacacctggtgcttattgagggctccattaaaggcaactgctcttattatttgcatatatcttatgccatgctctagattgtaaattcaagtattatgtatctttccaaataacagcatctgacttcttgctttcagtgagagagatagtcaataaataaacatattatatcatgaaagatagtgataagggctatgaagacaaataaagcagggtaaggagagaaagaaaagggccagggataatgtaattgaggaagacttctgggagaaaggtgcacttgaatagagattgaatgaagtgaggaaaagaattatgtccgtgctcgggtggaagcaatgcacttgataggtacaggaaaggaaactccaaaaggtgtagaagaattacagcatcctagtgacacagaggcccatggagtggagttttgcaaggaggaaagtaatcctcagtttcaaatgcagttgagagggctgggagggcaactgcagagaacacttcctggattgagtaagtaagagagcaagaccaatgacagtggattggtgagaacagcagacttggggatgccctgagtaatccaatgagggaaaccaagacaggactgtaaccagagagagaaatggattgaaaggggagttagactttcatctgaaagacttggttatgtgtctggtagagaaaaaaagaaaagttaaaaatttaggagagagataataactgacagcatggtcttgaagaaggcaggaactgatggtttggtcttaagaaaagaagtgataccaccacatgcagggtaaagagggaaatactggatatggataaggctagggatggcttcaaggttgctttcttttcctttcccttcccttcccttcccttcccttcccttcccttcccttcccttcccttcccttcccttcccttccctcccctcccctcccctcccctcccctcccctcccctcccctcccctcccctcccctcccctcccctcccctccccttcccttcccttctagatggatttccgctcttgttgcctaggctggagtgcaatggctcgatcttgtctcaccgcaacctccgcttcccaggttcaagcgattctcctgcctcagcctcccaagtagctgggattacaggcatgtgccaccacgcctggctatttttttttttttaatagagatggggtttctccttgttggtcaggctggtcttgaattctcaacctcaggtgatccacctgcctctgcctcccaaagtgctgggattacaggtgtgagccaccacgcctggccgacttcaaggtttctaattaaatatatggcagagtttgcagctgagactgcgggtcagggtggtgagcttgattagaggggtggaagtttaagctagaatgaataagaaaagaaacccatcaaggaacatttaaaaaacaaagtttgttctctttgatcttggggaaagtaagtcatgtactccatttagtacaaataacaacccctaaccacattgtccatattgcagggtttcctaagttcacaccaatgaaccaatctctgtttatgaaatgcgctctgcctgtgcttgcattttacacacacacacacacacacacacacacacacaccactctacatctttgccaattcataaccaatcacctcaattatggagggtgatagtcttttctttctttaattaatgagtttccagtttagatgtgtgatctttacacagtactatttaatactgtgcagtttagattcaggtaataccacagtggcagttatttctagcagcaggtgtggttggttacttttatagacatatgctcactgtgatccagggactatgttggacacttgatacctatgttatcatattgaaaatccttacaaccatactgtaagctgactgatggggaaactgaaatgtattgatattaaggaatttgctcagggtcgcctggcttgttaaggtaaactttgaggttgcaggtgcgggtctgggaccttaaacatcatcatgtcacctagctacagcaagagccagcagaacaatactcttcagcctggttttgatatggaagatgctcttcagcttcatgctggcttgaatttcctttgcagtgaagggagaggagaaagtgcattttaataagcttcaattaaattaatttcattttacttcttttgatgtatggtctcttcaaaaaatccaattctactgatgtttattaagtgcctctacttacttggagagtgccaggcacttcaggggatctatggatgagtgtgattcagccctgcttcaagagctcacaatctagtggagaggatgggagtgtgcaatttgctctaatactagattgaatgtaataagtaccatcagaagtggcccaaactgtggttttttaattctgaaatgcaaggttatgtgactaattagaaaattggcttggcagtgcctaaacaccggaagcatcacacaatagaactcttataaagggtctttatttcaaacatgattatgcatttgttcaaatctatggcatacaatgagtgaagaatgtattgatggtggtgacatcatctgccaggctgtgaaggtcaacagtgccagcccaagttgtggcatagtgttgggtgatttaaaactcaggggcaagacagtaaactcacaacaatcccagtggtggtgcatgacctgcagctgttcttggttctttgtgtgttttggcaagcaacagctgttcaagacattgaactgcaattgcacaaaaatatatgttatgtgaagttgttggtttttcttcttttattactatagggtgcttttttgaagttaacttcggaaatattgtgaactcagaataggtcaagtcctatatattccagctaaacaattgtttaatacatttttaaggagatttaaaagtagggcagtagatactgccataaaattcttttccaggtttactgcaagcttttggaagaaagaaataggagctagagaacatgagctagtacaatgtaccatgtgcaaataggaatttaataaatgcttcccaattcttttttttaaattggtctcctaggtgtgttaggttctgtaatagtcacttccaaaatacacagctgaaaaaagcattgcttttgtcttctaaggttttatatctaaatagaaaggctggggaaatggtccactgacaggtcaaaagcaagatttctagtgtcatattattgggaacacacacgaagccagaaaatccatcatttcataacttttgtagcacttcacactattctaccaccacatagatgtttgcttccatatttgtctgaacatccttgcattttctttgccacactcccctgctgcaatcagtccatgcctccctgatggattggttgcagcagcatttggtgttgcttggatgaggtgatggatgcttctctctcttcttcagctacttggagccaaaatacaaaagtgctggttaaaaggtgattaatcttccctaatggttttgtgcattgcaaacaggactgcagccaccatgtcttcattagccttaatcagggcccacattacctcagatcaggtaatcggttatttattatagaacagcaggcaaaggccttttgagcaagtgtcaactgtataaagtctatttggaaaggaaaaatagtggggttccagttgccaagcatccatagggaaggaattaaagctggagtgtatttctgggcacctctcctgctaagcactttggttgatggagggcagcgggtggctttgaggtcatcaggatggacactcagtaacagccctttgccttttttttttttttttaacttcttttttgcttccagggtgacattatctgggtctagggactgaaacagtttgggaaatgttgtcttctgaaaatggaagatggatttttagtatctttgggggtttggtgtacttcttaaaatatgagtttagaacttgctgtatgcccagtaatattcagggtactggggatacagagatgagcacaacagaccaagctccaagcttttgaagcttacattgaatggaaaagacaggtaataagcaagtaaacacatgcaatagaataaaatattagcactttctgaaaaaaagcaaagcaggtaaggaaagaaagagtggggcagggactgatcagggaagtcttccctgaggaaaaaacatttgtgttgggattaagtgaagggaggtgtattagtccattctcacactgctataaagaaatacctgggactgggtactttaaaaagaaaagaggtttaattgactcacagttctgcattgctgggaaagcctcaggaaacttacaatcatggtggaaggtgaaggggaagaaaggcatcttcttcacaaggcgacaggaaggagaagtgccgagcaaaggggaaaggccccttagaaaaccatcagatctcaagagaactcactgtcacaagaacagcatggggtaactggccccatgattcagttacctcccatcaggttcctcccacaacacatggggattagggaactacaattcaaaatgagatttggatggggatgcagccaaaccattatcaggaggggtgcccagcattgtaagaagggccttctgtgcagagggaacagccagtgcagaattcattcttcaagtggctatgttccttttatttattttatattttgcacttcctaagaatcattccatggaatcaatccattccatcccttccataaagtacaagcaaagttaaacgagctgaagtaggtgaatcactagaacggtgtctggcatatcattcatgttcaaaaaaaatgtgagctgcttcctttcaatgtgcaactcaagaaaatgacttgccatccattcttacatacagagggtggctaccatttgccactgaaacaccatattctataacttcaggccatcaatgggaagcatcttccttttgcttccctctctcctttctctctttttttcttctcacctgtgtgctgaaacacaagtgcctcaaattcaggtttttaaataaataaaattcaataaaatcaaattcaggtttttaaataaataaaataaatgtaatctgcagatcacagagtgaacagctgatgactctgtgataacatcatatcacatccacatattccataccatgatccttaaagaatacatgcacacacagaacagtgggaacagctgaattaggtattaaagtggagtataaatagaaatgggtaagttttgtgggtagctgagaatttagagcatttaggagttcagaacatcattttagtgcaggaatgttggtctttcttgctaggatctgtagagacacatgataatgatggcctttcagggcttggtaaaacattgtaatctgtataatattgtgattatctccaaagctatccttaaaatgtttggggccctaacatcagtgttcaaaatcccaaaatattattctcatcagcaaaatattgctcctacacacaaggtacctcttctccttttttcacttgctaataataatagcaagtattaatataaggtatttgttgagcaattattaaatatgtcatctctaacacaacagtccaaaaagacaggcctaagttcttctactttatagatattgagactcatagaggcataaagtcctacagtataaatgagaagctgggatggccctggatgtgactgcctgtaaagccagttcttcactcatactatttgttatttttcaaaacattcaaccattctcttccctttgagagtttatcatttttctccctaagtcctggagaatctttcttggcaatgtcctgatattctattcattattttcctaccctagttctttcttttcatagtctttatcctttcaaatctagactgctgttcttttctgttggtcctccagactccaaataccttccagtatcagctagtcttatgcactgtgattggatagttaaatactactttgacacaaggctgccatcttactgttggaactctccactgttcttatagtaatcatcaggctctgaacactggcttcccagccctgtataatctcccccactttatttatccaaacttatttcagcagcatggctgaagtcactatccatggaactcactgcgtgtgttcccccgataccttgtctcaaactgtatgccctactaaaagggcctccaccttttctttacattctaaaaggtccagatcaatttttccctctaccgtgaaatttattttcccttctcctggcatattgatctttccctgtgaacactttctgtaaacttgaaaggtctataaaatggtcctttttatatagtctttcaatagaaacattttatcttacaaaagatgccccttactgaaaatggattattttctttggcgatgggtgactgttcagctgaaactaacagaaaacacaacaaatgttgacttaaccagttagaggttgaagacattaagtaagaaaaagttgagaagtatgctcgccagggtgaggcagctgtttaacgatgccatttgggagccactctcttctatctttctgtttcatcatccttgatgtatatgctttcagcctccagtttgttgcctcttagtcacagtatagttgctgcacctccaggcaagaggaatggaacagcagaagtccaggtatgtctcatcggtcagcattggtcagaattacataacatgttacccctagctgcaagggaagctaggaaattgagttttgagcttttaagcttgtatagagaaagtaggactggaaaaatgtgctcaagaactgatcttaagtaaataagcctatagtataaggcgcagcaaagcttaatgaatagatttttatattcatataatgctccattcttttatgatgggaaagatattagagtgaagaaaatggaatactggagtcagattcaattgttactgaatattggcactgtcctcttgtagtcttgagtaagtgactgttctttctgagacagatttcctcatctaaacatttggcttaataataacactgcctcttagagttactgtgatgattaaaagaggcgatgcctgcagcctatgatgtggcacatgtcaattctttttccctcttccatttgaggccctggtaggtgtggagaaaatcctaaaaacaataaaacaaaccaacaaacaaaccagaaaaattgaatcaatgaagacaatatctgccaccagctagtcccataaactcatttcaataaggaaaaaatatcaccccagtaacggaactgcaggagtgttttagatttatttatcttgtaattgagtggaaaggaaatctctgaatgtttgtgaaggtgttgacccatggatactaaggtatgtgaaaataactcacacatctcaggtgtttaatgaggatcaataacaatttgtgggcccatcagctctacagtcctatcacctcaaatcacacacaggaaccctgcttctgaaaagtggcacttgggagagagaatggcagagtgaaatccaattagcaagatctgcaaaagaggcacatgtgccagaatcatgcgtgatcccagaaaaaaaagtatatatatatataactattataattttatatatatatatatatatatatatatatatatatatatatatatatatatatatcatagcacattcttagcctacccacctcccactaccccaaaaagcaggacaacattttccatatattctattgaagttttttttttttttaaaacttgttggcacagaagcctatatctgtagatattttaaaaactttacttatatctatttgaaatgtgttaaaaagccatatattctttttttttcttttgataaaaggaaaagcaacaccctaccagatgttgggaggaatagtaagcaagtgattcaatcagatttctcctatggggacatagactctctcggtcaatgtcacagaatgaaatagtctcagattcacccagcagtgagttattccatctggttgtggcaattaggagctgaagatgacgggaagttaaatgactatctttatgaaacaaagcaaaatagaaaagggaacagctgggggactggatggcttggggatgcagaattggatctagaataaagaatctgttacttcgagttgctagttataatgccagtgcaggttaatacaaattgaaggttgctgctgtgtgctagcagttagctgtcgcttgcctgaaatatgaccataacatttacagtactgtctggattgaggtctctagaatgtaatgtcctttttacttaagggccaagccaccagattaactacatagacagggagtcattgaacttcagctctggaaaggatgttgttaccaagttcagtttgtgaattgccaggaatgttatgtgtcttttctttgcatgtgttatagtctaaaaagatgcatagcttttatcaaatccaaaggaaagaatgtgaatccaccagtccttttctaccctcttcccctcttcccccacaaaatgtgaagaacttgctttagaccttgtctttggagttgggtagtctagaacataagcttttggcttactgcttactagctgtgtggccttgggcaagttatttaatctctactagatttattttttctaatttatacaatggggatgataatattgtttatcctattccataatgttttatgaggaaaatttgaaataatatatgtaaatcgttttactgtaacatgtacgaaggatccaataaatattggctcttattattatgttgaggtatgctgaaagttagtggcagaaacaggaccagaacattgatacccaactcactactctggcctttggaaaacatggtgagcctatctctcttcttatttgtcacacccttcatgttttggcaggactcaagagctaacataaggtactgaaatcaaataattacttctaccattacagcgctaagtggtctacttctgcattttgagctctttttcagaattctttaaacatcttatctgcactgcagtctggaaagggaaatcacagagagaagggaaatcatactttggctttccaacaccctctacccaagttgcccaagacaaaactgtgagcaaggttaaacgtctgactcattagtaagaggaagtctttttaggcagttcctctgttgaatagataaagtggatcaaacaaaagagatgacagattagaaactgtctggtggctaatgtactgtttactgcagtataaatgactggtgtttgggaaatgacagatgagagagaatacaaatgtggacgtaaataatttccaggtttctacagtggaggagagtcatggttggttaggatgttgacagggaagggggaagtcattggttggagtttcagggaaatgagaagagcatggagaggacttttgaattaatccattgatccacgagttaccatagcctccgtgctgcatacagaaggtaccatgaaggggtatagttcttttgctcttttctcactgcctgatccattctaaatgtaactcttgttccagaccaagtgcagaaatctttacagagagaaagcattgggatggggatgaggctatgctcagccagtctgggagatctctaggggaaaatgtcataggaaaaaatagtgataaatatgcttaaaagaaggcaaggaagaaagcaaggaaggaagaaataaagaaaaagagagagaggaagaaagagagaatgaaaagaagggggttgggagggaggaaataaaagaaaaaagaatggaaaggaagaaaggaaagagagaggaaatatggtatatcagttattctgcatgatatgtttgagttgagtttgtggtggttacttgccccagggtatcaaaagaagtctccaattaatttgtagccagtgtaaccatatagcatctatttgcttagttttcaataataataatactggttctgattaaataaagcatattgtcaaacttattatttgcaaacatattactgttgtaactggtaattgctcagatctctttcggttcctgccccgacacccaaaagtcaagagggtggaaggtgaccctttctaagactttgacatggaaattctttattctgtttcaggaatggcaaattccagtttacagatggatggaaaagatttcttccttgtgataatagaatgcaggacagtatttctcaatagccatgccaatgacattttttgactggttaattctttgaggggattgtactatgcattataggatatttaacagcatccctagcctctacacagtagctgccagtagtagcctccccaacactaattgtcacaataaaaatatctccagatgttgccaaataccccttgtagaggcccaaaaatgccccttggagagggctataattgacatttttgaccggataattctttggggcaattgtatggtgcattatggtttgtttgtttgtttgtttatttatttatttataaaacagggactcatttttttcacccaggcctgagtgcattggcatgatctcagttcactgcaacctctgcctctgaggcttaattgatcctactgtcttagcccccccaagtagctgggactacaggcatgaccactgtgcccgtctaattttttttcttctttttttttttctttctttctttctttttttttttttgtagaaacagggtttcaccatgttgctcaagctggtcttgaactcctgagctcaagcgacccacctgcctcagcctcccaaagaatagaattgcaggtgtgagccaccacgcctggcccattatagaacatttagcagcattcttagcctctacatagtagatgccagtagtagcccccccaacataattgtcacaataaaaaaatctctaaacattgccaaatgtcttttggagagggccacaattgttcccagttgagaatcacttcttcaggatagactgttgttaaaccattgattcagattcccagggaaagactggacactcagcagccgagcatcctgctgacccccagaaccctgccttgacacctgctcacaaacccctcctctccaccctcaagggcaaggtgtaatttagctgcagccttttcccaaatgcctgtagcttctacaattcaatcttttttatttgtaagtatctttgcagttttctactttcaaaagactcttagtgatttctaatacctcaaattgtacaggtacatggctttttgtctctttctctgtgtctttttttttttttttttttttttagcttttcattgtagaggttcctactttttattttttctttccatgtttattgcttttgtgtctctgtcttcctgatttcattttggtgtggaaactgtctttctctgctattatcaatatcttactacctagatctcaatttcattttatggtttagccttttggtgtttatctccccagtcgctatcatccttttaatgactatttgtgtttctgggtcttttttcgtgtggcagcttgtcttttggactgcctctctctgtttgtatctttccagctattttttatagtctcctcctacttttggagaatagcgatatgttgttatgacatttctatttgtgactgcctttttcctctattgacttcccttcccctttctgcctttcttttgaaaatggcccatctggattaagtttctatcaagatctctttctataagcaggatttttctcaggtatgtaatggaaaccttttacttctgttgaatggtaatcctaaggggaggtcagggaatggacttttcagttaactgctcagaggcaattgtttgttttactttatataatcgaacttttataaaacttagaatattaaatccagcaaggttaaatatttagccttttgttaactttgtaaaataaaaatagaacttaaatgattcattataaagcaattatcttagaaaatgaataggtaacacattattagaatcaatttgttctcaaagctatgagaaataaaatcaataatttttagagatagataaagtgttttaggtaatgtttgggaataagaaactataagagtaggatttggctatttgcaaagtacctgacttttcccttggttcctaaagaatttcgaaacaaaatgagggcactataaggttcacaaggactgaaaactatttgatcttctcatttttggaagaaagtgagaatcgtaatatacttgcgaaacagattggattccatctggtgtagccaaattaatccttctttaatgattgtttatattgtgtatccaaaatcaaactcagtatcaagagttaattacaatttataatcattttggctcaacaaaacaagagggaattgtaaacagtaaagtttattttatagtataaacatgttaaaaacatggatcttcattggaccatatgtaaattaatcaaattatctccagtttttgttgttgttgtctgtttgtttaaacgtggtgcaggaaaaagcaatggctgctgagactgcagaggtttgtgaagaagtctgttaggttttctgaacattcctcccctccgaccaaaaaaataacccaaccggactaagacaaaaaactgagaaaaccaggatggaaatttgacagaggtgtaggaactaaacaaggaaagggaatgtttctcttctctctagtgcaggataaatttcatcagttccctgtctgaacctcattaaccttaataatacactatcaaaaagtcaactctatgcaattagtatttaaaggtacttgatattttaggtgggaaatttattttctctgaaaaatcacacatgcctccaacaacttgaagcttgctaaaatttatagcaataacattgaattcaattacattcaatcaaattccaggcatcaagtcgttattaaacatttacctctatggtcattgtgctatggttgggaataagaataatactaaggcaagatcttctcctttacaaagctctcagctgattaggaatctcataaattgtcaaatgtcactgtttcagctaacaatgtttctaccataaacagaactgactcaaaggggcaaaaagtaaataaagtacatgacatgggagcatactctcacctgagccttagagaggaaactgacatctgtcaattcacttgttctgttaattccactttgatatttcttaaatatatccactcactagggctaagccacaccataactgacttctaggcattcatctttcttccacttaaattcattctccaccttgcagctatttagttagttcttctagcaatacattggttaaaactagtcaatgacttttcatttctttcaggataaaatgcagtatagtatgcagtggtaggaaattaagcactagaatttgtgtttaaatcctaatttcctctcttatctatctctttgccctggagcaagtaattttactgctctatggttcagttattttatctgtgaaacagggataataacatcacttacttcatagggttactagtaggaaaaattagttaataccagttaagatgatttgtagagaaatggcaccttcaattaatgttaactgttactattgttgccacctctagacactcatcccttcgcactgcccttttctcatttttccctggattgttttgagtttcttagaacgtgtacatgctgttccctttgtccccatcactagactgactcctacttgactttcaggacttctgactttttcttcctccaggaatcatcttctaccactcctctgcatggcaggttagatgcccctcttaaatgcagggttaacctctatcgtacatttcacaccttgtatttacttgtttgcttccctattcttccttctacaatgcatacactttgagggcagaaactcagctctgtttgtctttgcagctctgtcacctggcacagtacctggttcattctctgcagaatgaggaaacctcaagcatccactgaagggaacagtgtagcatagctcatattaccaaatatctgcatgttagaggcttatgtgtttatgagtaggcaggtgtcttcatggaactctggtatcttccagatgttcataggtatatctggaacgatgagtatctggccaagtaatatatggaatcaggaatatgtctctcctaaagagttatattttgatcaacctcactcttactgcagtgggcaagcaggtacaacctagagttttccaaaccgttcagattatgaaacctgtcgttagtaatatattggaaaactcaattatagtgccctaaagagctataataagaaacacagtttggaaaatacaagtctgagttagtaaccaagatgtctttttttcctcttgattctaggattatttcaggaggttgtgagagacacaatgaggccttcagctctgggtagactagtttcagccggagctcttaatgggcatcaaccatcacaagttgaagccattcagggatgagaattcttttagctattagaacctgtctccatataaatatttctacctttctcctccagtggtattctctgagcagaggagatgggttgcatagtggccttaaaaggcacagccccaaatttcactggttatgtggacataatatgactttaggatttcttatcacccacttcaaaaaccccagggtcacttaattaaaatgactgattcctggagcctcaacatgtgccttctaaatcagacagtctatgaatgtgagactaaagccaaagtttgtactgagttctcctgtgactcttatgctccctcatgtttaagattctaccctgagtagaggccacttcaaaaatagaaactttttaatagttctctgtttacaaggtcaattctgttaagccataaaccatcccatttggaattagtactataattatggttcttatttcttacacacacacacacacacacacacacacaggttttttggaaaaaaaacatgttaagagaagacatttaaaagtttaaagaacttagatgttttattttgtgagaagaacaattttggggcaagtcgcttaactgtctgagccccgttgtaccatctgggaaataggaaaagtggcatctgcccttgctccgcacttgggatgggagagtcaaatgagaaagactgaaagcaggtgtaaaatctaaagtactaggaaaaacaaggtgttatgatgtcttgataaacatttggtaagataggagtcttgttacacataataacatttttctgagtaatctagtttggtttatttttctgtggggtttaagagtacattttgataactgagagtttaaaacaataatttcagatgtattaaaaattgtacgtgattattagaagtgacgaaaacttctgggattatataaaattgagttttatacaacattctctttgactctaacaagagttaaatgttaggaatcattgatgtaaactattcttaaatgattccacattccaagcaaatgctctggagaacaaataggagaatcatctgtgagattaactttttactgatgccatgtggagtaagattatcgaagcatcttacatttaagaattttacctcagacttaaatagcacgttaaataaaacaggcagaactaacaaatcctgatatcaactttaatttcaactttagctcttttacacttttataaggccctttcctcttataaatgtaaacctattttttaaatggaagctaatttgttaagtccattctatcagaggtaaattgaaaaatgccagcaggcaagataaatttgacagaaaataggtaaaatcaaagttttattcatgtacagtggttaagaatgaagatattaagataaattattttaagtgaggactgtccttttaataggcctcactctatagccttgtctcatttttcattttcacaaggttcttgatgtattcttttcattatataaaacgtgccatatttggtcttttcatgaaatgtatctgatattctcctttgacagccattcacgtgaaaagaaaaggtcctatttctgtccatcacctacatgcacatattcatagaaatcatagatttttggtaaaatatgctatatacttatacagcatcttaatctcagaaacccaaagggtttagatccataactgtaccatatttcctttctgtatgttgagagatacacatggtcaaatttcctaaaacctgaatctaactcaatctaaattatatgatttccgtttctacacagtggaacaagtgtgtgtgaaataaaatcaccagcccagaggcattcacccaaataaatcttggagattttctgcaacatttcatccctctacttctatatctaagtattgctacttctagttggatgtaaaatgcatccttctcaatttatttttgtttgtgggggatggatggaactaactgttcccccactactttataaacaaatataaaatgtggatgtgtaggtattttaaatgctaacagtagaattttagtatctagttaataaccctattggttggaatttaaatcttttcaggaggaaaaattaatcatccattatatcattcatcttgatgctgtcactttcttcttgaaatcagaaaaacatcgtagtttttacatggtagtttttccttgttggaggacagttgcattttactccacactgttaaatgcattaggccatgtaagagaaatataattctgtaattattcagaactcagttggttgtttatatggtattcagcaagatacttcccccccacctccaacttcttataacacaatttcaaagcaccaatcgtcttcctcttttaaagtaacaccatgactgattgccttaaatttatatatgatcttgttctaatgtcctttctaaaaataagaaaaaaatattccacaagtaaaacgagagtatgatagatacttcaccatggtgctggtgtatgtagacttgcgtgagggggaggacatggaatggtatgttctccattcatctctagttttatttcctagatgagttatgggtgaatactgtgacaaaaacaaaacaacaactaaaatggaaaagtcccaggagtgaacagaaaccaggacttaaactgcttcatcattattttattgtattgttttcgttttgggtttttttttttttttttttttttttttttttttaaggaagttacaacaaggagcagctaaggacagataaattggtagcagattgtggtttatgataacgacagtcccgaaggaacttggctttcttggtgacgttgaagtaaattgcattactcaagatgtatactaagaaggatagataatgaggtgtatgggggaaaggcatgatgactatttttatagtattgttgactaccaaaatgaatggaagggaaggcgggaccaggtggagttccttgggttaatttcgatgtaccttataaatgacaaaatttccacccacttctcttagagggataaaaatatttgaaagtgtctgaaacaattgccgaccactatttcaattccttttcctaacttctagtacctttgatttactctgaattcctaatttcttgttaaatgggaccatatttgtttataattcacctgggttaaaaataatgttttcttctgagaagaggaaagaggaagggagtgctctagcttcttcatccagaaacagactcttatgtaaaacccccaggagattctataagatatcagggaagattcacctaaagattaggaccctttgagcctgacaaatctcctgttgaatgccttgctttcaaccaaagctgagataaaaagtgcgcgcatgtgcacacatgctcaaatacacaggcagaaagctctcagctacaagacctgcttccgtagtttacagagcacctgtagcccatttcccctgtgttttttaggcaaatctttgttatcatggtgtatgacagccacatataatctgagtaccacttcctcccttcttaattttccaccatttatgccaattagaagcaaaataaaagggatgatttctggtcacttaaaatcggggtgaagcaaggatggaggttgtcctgcaaaggcattttaattctaaagaaaaaggagattagtggcctctacccatcttagagaatagagtgtcctgacaccttcccttcctccttgctcagtattctccctctccctagtgccacattgagaggagattcactcctaaaagagtgtgtcattttaagttgactttcttggagctgagctaagagccattgccaaggccagtgggcgtaaattcagtccgcctgacgggagatgaagggttgtgggatttatgacttatttgagttctcatatatcaccctctgtgtcgctcgcttatgatggccctgccaaaagataaagaagtgtaggacgctggtacgggctgtggtgacaggccagggacaaatgtctctgttgggtaaattgatttgaatgactctagtgaaatatcaggttaggctgaaaatatgattgggtttaatgatcctgctgactttgtagactgttgggattccaaatcctggacaagttaattaaggcattctatgaagggggtgtgtatgaatatttgtaaatccatgtaattattaatgtcaataaataccaccatgtaaaaactcagacctgttctttcacataatatattgaatgtccattgaatacagggaacattacttacaatttatagagtatttatctgggaaaaactgttgagaacgttattttttctccacatcccagagtcaacaagcagagaccgaaaggcataaaaatgtggaatgaaaagatagagaagagataagcagtttattctctcctggcaaaatttagtagccttacccttaatagtggagaagaaatttttatgtgaaattggggttgttttaggccactaacccaaagatcaaatggattgctttttcaattacaaaaacacatatattgttaccttattttttgaatgtggctattcagttaaaaataatagagtttagatttctttgtaggaccaaaattttttcagcaggtttctgtttttccacttaaaattgcttccaaatttctgagtttacttctaataatgggtatgctctccttgctatttttatctctaggtaattgttgactgcttgtagttttttcttgttgggcatgaatgactggcttcatcttccaaaagtgttacaaaacaccagttatttctttgagctttagacttttcctttgcagaaaggagccttatttacatccaaatgaattcccaggagagttttccactgatgccgactggttaacagaagtacaggcgagcaggaatccctcgctacctggcctttcgttccctggttccatctggatctctgggaaaattttccatctttatttgccataaagtatgatttatttatttcaacgagtggctaagagccctggaatgccatctttaatgagtgtagggaggatggtaaattgggtttagagaagaatattgttaaatatgttcaacttttagaacccaaacaaaaacacaaccagtgtcagtgtttgagagtgctgtactcatctgtgaacgtaacagagaggaaaggtgtctccgaaagaactcttcattcttaggagaggccccagaataatcacaaaacttggaactgtatctatggaatatagaggtttccttgtcttggagtggattcttagagtaaaacatgcctatatccttctgttcttttatcaacttcaactgactgtgaatgatgtactcactgagaaaaatccatttgctcaggtctaattttaggtaatttctctttctgtatgttaatggaacccataactgttttgcctactggtttccaactgaggattaatataacagtttccactcaacaattgtattgcttttttatcccccttatttccttttctttcttcatatgagaatattgagaataagagagattaggaaatttacactgcttctgagggacaaggcagcttttggacccaattatgcatgcctctgaaacacatgttctgcaccacaccattttttctgttatgtttgagagataaaaagttgtccgtctgtctacctctccaggctaatgtctcaccacattcaatcaaacttctccttccccaggccaggattcatgcagtccctacctgtaatgtgctttttcatattcttttttattttaaatagagacagggtcttgctctgttgcccaggctagagtgcggtggtgcagtcatacttcactttaatctcaaactagactcctgggctcaagcaatcctctcatttcggccttccaagtagctaggactataggtgcatgccaccatatctggctaaatatatattttgtgtgtgtactttttgtagagacaggatcttgctaggttgcccaggctggtctcaaactactgacctcaaatgatcttcctgcctcagcctcccaaagtgctatgattataggcctgagccatcttttcattatctttcttcagatctcaaattatttgtcactcactggaagtgtacagctaatctgaagtggccttccacagttcccatctcgctcattacctggataatttcctttatagcaatgaccacattttggtattgttttggatattggttaccttgttaaatgcctgtctgtcttatctcctccaaccaaaagtaaactctctaagatcaggaatcctgcctaagtttttggcctgcatatcatcagtgtcctgcatatagcaggcccaatagttgttctaaaaattaatgtatacctgaatgaataaaagctcttagagtgacagaaatgtaaacaaatacttctaacgctaagaaaagtttgttacatgttctaacaaagatttaaccaaaatgttgtggctacaaagaaaaagatgggtgaagaagaatggacaaacactaggggaacatgagaaagttcctggaagaatattgtcatatatgaattgagactggtgcatggtacaatttcatatataaagatagtggggaaagcattcttggaaaagtctcttgttgtgaggcattacccagagttctttgtcttaaaaccaagagaattaaggagcatggacagaaagggtgaggttggagtgaaagtttaataagtgaagaaagaaagctttccaccacagagaggggtcccggaagagggttgccatttttacagttgaatgcaaaagaaactgatgagggctgggtgtctcatgtgcataaggtgtgaatttctggtagctccaccttgtcctcctaatgcgcatgtgggctcttagcttgagttactccatattgctttgttccccttactgcacatgtgttgaggtggaatttttcattgcaggcatgtctgggcaagtcacctgtttagcctttcttatctgtgtggctgtgggcatgtcctagttaggcaagtcccattttccaagttcccttatctgtgcctgcaggctgttctttcctttgagagaattcagccaaggacccaccctaactgcctgcctgaccactttcttcctttctcctctctcataatgatgtaacagtaaaaatacctgagttcaaatcctgatttttccttttaatagctgttgactttgggctatgtgcttaaaaaacattttttgcagagctttctcaatacttggcacattattgtcactgtttctccctggatcttagttttttgggttgctaagtgagcataataatccatagttcagaaatttttgtgaaataatgtatgtcaaagagcatggtttttagcaggtactttcattcatagagatagtagctgagtttaggtgacccgttaaatttgggaaaggattatttaaagtcaaggagcagatccattatgacaccataattagaatggataaccacatccgcagaaagtgcgctgcactatgagtaaatgtaattttgttcgtaaagtgctgggcctagggttaggggagataagttcttaatatgtcttaatatagccttgggttctgggatatgctaaaaaattattcaactcattagtgtctcagtatccttgtgcttaaaattattattataaaaatacctgaatgtgaacttaacctcttcttgagagtttcagtaaggaaagtgaggctcacttctttctggaacattaaacttaagcaggaaggtgccacatgaagtattatatcataatggaagcaatgtaaaaagaagagtgagtcacttcatcaacttcacaatgcaaaggtgctaccataagtcataattctaatacaaagatttatataaataatgattctgggattagccagatctcctaatgttctagggtttgtcatcatgaattgtggtatcacttagtaagtacatacttaaagagaagaataggaggggagggaatgttagaagaatagtgaacaactaaaaaaatgtgagagatagcctggagagaaaagcaaaaggacaaggcaacacaggaaaaagcaaagtggagaaacagatatgcctagcaagaggaaaccaaagttagcccggtagggtattgttgcaaaaggaaagccggccttgtcatttatctaaccaaacattccactcctcagtgatggggtagctgctctttgaaagacaagcaactgtgatggggacctgtcagtcttccttacatgcagctggttctctaaatattccaacgattcctatcattttctgtaggagtacctgcaaaactggaaggctaggctgatggctttttctccattaagcagtaaacacgttaagcaagcttgagccaggttctggaggaggtcatcttgcaaggataaaaaacattgcatttattggatgaatacttaatgcacggtttgccttatccctaccttagagatgagaaaactgaggctaagactagctaagtaatttacccatgtttgcatggcttgctgatgatggatccggatttgaattccattttgtctgactccataaatcatactcatgctagtacactgccctggcctggatgggccattttacattgtgtttttcttttatagacattaatatgtgtaataaatagaatgggagtatgtattattaaatgttaattttgaaatataagattgttttcagatggaatatccttttcattctttatgatccttaatgctgatttgaaaattagaataggaaaggtatggcaagtgtgtatttgtgatgggagtagctaacactgctcactttaacagtaaagctctgccatctgggttattgcaaattcttgtaaattggtatggcctgtcctgctgtcctggaaagggagcaactagcacaagagaaaccaatcaaaatgcagcaaaaggattttttttttttggtaagattttgcttaattatcactgcagtagaatggctagccaaagtcagaaatcttttatttctgctcagtgagcagcccaataaagcttcagaacatacagcacaaacaaatgccatttcatttttctttacttcttaaaaaaagttaatcaggaatttgttagaataatcctgtgttaaatcaagcagccagacaatgaaataggaattaaagaaaatgaaagtggtgggaattatagaaatattaaattatttcaaaaaccctaccaagtgaattggttaataagcatgtacaatttattgccctatgggtcctctttttacaggcatctttatggttcatcagtttgctcccatctacaccacctgcctataattcttgacaaaagtctgttttagatactgaaagtatccactagatttgagaacaaagcaaccctgtagcgtgagcccagagtccagaaggatgtgggtggaggcggatcaggatccaagattttagcaaaagatggcttgcttaagtgaagcagtttgcactctgcctctttattcagttaggcctggtgtcccttccagcaagaaaagcaactggaggtcctgaaattgcacactcacccaatttccccaaattctttacttctgaggactattgaatcacagagatacagcagtagacttcatgaagttcatctagcacctaggatcttgggatctatggcccgggacagctcctgctgtacaggtcttgggtaggctgccatcctctaggtggtggcggcagtgtggcttgtggttctttttgagtgtacactggctgccttacttgcgagaatctagttctatcaagtgtcagttaaaggccgtttttgtctctgattgcataacagggtatgtttgagagagacatcgctgagagaaattcaaagctaccatgtgaagatcctttcctgaatatagtgtggctacctcagatcaggattctcaagcttggcagttttgacattttggactggattcttttttgatgtggggaaactacctgtgcactgaaggatgctttgcagcatctgaggatgacccactagatattagtagcacctttctcccatggtaacaaacaaaaatgtctccagacatttccacatgtcttctgtagggcaaaatcccactggctaaaagccagtgatggagtttgtactctttgaaataagaccactgactttttgtcttccacctaattacgctcagtaagataaggccttcttttgaggtagactttcaacatctatctctgattctttttgagaaaacacgttgcattttaatcttttagtgaccgattgtccccaaatgtaaaatagaaagttgagggaggcagtagttatatgcacatattttttgagccagagttccctgagtttgagttaaggtgtcctgagttttgagttaaagttccctgagtttgctaccaattagctatgaaacctgggccgagttaaaagttagacctttacagtcttaagtctccctttttcatgtgtaagacaagggagaataatgattgtacctttttcataggttttgatgatggttaaatgagttgaagtagtgaaagctcatagcacaatggctggcccatgttgaatgcctaatgaatgtttgctataattactactgttgatgataatacttttgaaaacatagttgacttgttataattaagccagtgtttacatctgctttaccaaatacttcccatggtttttatctcagaaaatagactcaaaagtgaacacacacacacacacacacacacatatataccacacatatgtacaacctgcatcgtctaataagctcagtggttccatatactatatctttggccaaatccggggctttctgattagcacctctagttttttttttttttttcttcccactcctgctataaccattctcagcattttcttccagttttttccttctagaactactgccaggtgaactacaaattattttcttgatttgcagcccatgcaccaatgagaaaatgcctatggtgtcttttgattttatggttcattgcttaggccttgtcataaaaaccatggcgtctcttaaaagaaaatataaaacaaaaacaactttctcttggccagagtttatcaaacctatgcccataatggcatagaaatataggaaatgagacaatcctactcccccaatccccgttttctgtttatttgtttgattcctgccaaagcaaagtgaccttgagggggcaccggctcagtgtttgctttttctggcgctacccacacccctccttcttcatctcctactgctccccattcagctcctcaacaatcggcaatcactctgcccttctgctccaaatttatgaccgggagcaagccataaacagagaaggccaatcctgatcctaggcactgcaccttcctgtttgccagaggtatgacagcttgatgggactgtaaagaataagcctgcatccccacaagccgcatgaatcatgtcctaggataatgactagcaaaggctgctgcagagactgcaggtgactcagagccctgaggcagggctttccctaaaccacctagaacaaagggttcccatggatgttctctctgtggcgtcatctcacaaatgagaagacctcacccactctctgatctataaaagcagcctttttattctgtgatccatgtgaaatggcaaagatcactccagcttattgatgctcagagaattatgaaggtgccacctgaatgatactcctataggaaatatttggtgaacaagataacgttttttcatggatactatttgcctcctccagttgccgcttggtgtgtatattattcgccagtgattgataatgcctcgggaccacctagtgatcttgttcagtttctaatttagttgatctgaggtggggcctgagaatttgcatattttaaaaactcccaagtgatgctgatgcaaaacagctagaagagaataataattcaaataaatgttcctggtgtaaaggaaagataaatatttcaggtgatggatatcctaattaccctgatgtgattgtatgaatgtatcaaattattccaggtaccctgaaaatatgtatatctaatgggtaccaaaaacaataaataaataataaaaatctgctttcaccaactgatctaggtttaagcaatggagtaacatgacaccagtataacaccttttgcatttctgaaagcttccttcccctcctctttcccctcccctcctctcctttcctttccttctagatctgacagtagtagctgcagcttatgctttagatttgagatacacagttgggatctatgatggtccctgagaaaggacaatgagtagaagaagcaaggtgcagagaggatctaacaatttttgcatggacatgagatttggagcaaggtctagaagctcatatcagcaaggagtaagtatgcttgtggcttaaagattatggtcttcaagacttgctcctggactggaaatattcccctaattttttgcctaaatgaaatgtgctacaggcctgagtatacctaaatcagcttcatttttctgtcaaatccctccctgtatgcttcttccagtgatatgtcatgcagatgtccacaggggacataggatcttgtagtgcaaaaaacatgagactttcatcagacaatcagtcttgactctcagactcactgttgattctatgacctagctcaagctacttaactctctaaggttaaatatcctcctctataaaaacctgatagtatgtactaaagagggtatttttgaaaattacatgagataaaacagcctagaatgctatctgatgcaatagtcatccagtaaattttaatatcattctactttgaaccaggttgtttatattaaatttaacagaattaagcaacatacagtagcgatttattctgtgggctctggagtctgcctgtaagggtttgagctctagctcagcgacttctttactgtgtgaacattgatatgtttactttaatctctctaggccttagttttctggattttgaggcttaaatgagttattacttgtaaaacacttaggagagtctctgctatgtaataagtgttcccaatatatagattttatttcatctagttgaatttagagagtagcaagccactcccttcccgccccacccccgaaaaaaaaaaaaaacacaccaccaccaacaacccacttttagtgtggcaccatatctaagaaggtattctccaagacttctttatgtgaagtagttcagccttggcagagttaaaagttttcagttataatcttgacaaaaattaattgggatgtatcatcaatctagacaatagctaaaattataaagcttctaggagaaaacatgggaaaatatctttgaaagtgtgaaataggcaacaatattttagaatacaaaagcactaagtatataaaagaaagtatcaatagattcaacttaatgaaaacaaaaattcagctcatcaaaatatatacctaagaaaattaaagggtaaattttaaaatttttgttccccagacatagactgggagaaaatattttcaggatatatatctaaaaaaggacctgtattcacaacatatgaggatctcctgcaaatcaaaaataaacacaaacaataaaaataggcactttataaaaaagatacgtgaatggtcaatagtcccatgcaaagatattccacatctttagtaatcaagaaattgtatattaaaatcacagtgatgtatcattttataccaactaaaatagttaaaatttaaaagacggacaacaccaaatattggtgagcattagaactactgaaattgtcatactttgcacatgggaatgtaagatgataaaaccactttggaaaaattgcagtttttaatatagttaaacataaatctaaactaagacttcgtaagtttacttttacatatttatccaaaagaaatggaaacatatatacacaatgacataaaaatgttcacattagctctttaatagtctcaaaatgaaaacaagacaggtatccatcaagagtatggataaacaaaacacagtatattcctatgatggaatactaatattcaataaaaataataaactacaagtaaatgcaacaacatgtatgcatctcaaatacagtatatttttgtggagagaaagacaccaaagagtacatactatataatttcatttatatgaagttcaaaactaggcaaaattaacctgtgttattacagaaaacaatactaattgcctatgagtattggcaggaaggggcatgagagagctttgtgggatggcagaaatgctctacattctgatgggagtgttggtttcaggggtacattgatttgttaaaactcatccagttgtatataggcattccttggagatattacaagtttggctccagaccccataataaagaaaatatctcaataaattgattgacaccgattggcacacagctttatttcccagtgcatataaaagttatgttgacactattctgtagtcttttaagtgtgcaatagcattaagtctaaaaaagcaacatgcacaccttaatttaaaagtactttattgctaaaaaatgcgaatgattatctgaggcttcagtgagtctttttttttttttattttttgctggtggagggagggtcttgcttggatgttcacagctgctgactgatcagggtggtggctgctgaaggttggggtggctatggcaatttcttaaaataggccgggcgcggtggctcacgcctggaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaaaaaaaaaaaaaaaaaaaaaaaataataataataataataataatatgatggggtgtgctgcattgactgattcttctgtttacaaagaaagatttatctgtactatgtgatgctgtttgatagcattttacccaaagcaaaattttcaaaattggagctaatcctgttaagcccagcagctgcttcatcaactaactttatataatattctaaattatttgttgttatttctagaatgttcacagaatcttcaccaggaataaattccatctcaagaaaccactttctttgcttatcatacgaagcaactcctcattcattcatgttgtatcatgagattacagtaattcagtcacattttctcctgtacttctgttctagttctcttgctatttccaccacatctgcagttacttcctatgccaaagtcttgaaccccataaagccatctacgggggttgacatcaacttcttccaaactcccgtgaatgttgatattctgaccttctcccatgtatcatgaatgctcttaatggcatttaaaatgatgaatccttttcagaaggtttttaatttactttgcccatatccaacagaggaatcactacctatattagctatagccttacaaaatgtatttcttcaataagacttgaaaggtgaaattactcctcgatcccttcaatttgtaaaaaatacaatatatataaagcacgatgaaatgaagtgcaataagatgagatatacctatacctaaaatcatgggctccactctgtataaattgtaccacaatttaaaaatgtatatcatatatatatttaaatattataataaaactaattttgaattattcttgattctaggcagtctctctgcaggagtctcactctgtttgttagactcttttcttccaccagaatttctgtcctgcagctcaccattatctagaaaactgagaaacaggaatatcataacagtaaacaaaagtcacttagttgattacatgcatctctcaaaagcctgtaccttctgctatgattagattattccagaagcctcttctggaggaatctcttacatttgcccttcatctatgggattctgcactttcgcctttctgtttctgtgttgtcctgagatatctcatgtagaaatgaattgatggccctttatactgcggttggactcttcattcagattttttcaaagcacattataaactctaattcattaacgtcatcataaatggtaatgtcctgtgaaaaagagaggtggtggcaccaattaaaataatcttcttgtagtcacacatcaaatcaatgtcagtgcaaacacttgaaccaccagttaatgcagccccatttctttttatattgacaacagcacagtggttgaagctgaaatagaacctcagttcatacttatagaatatgccatgctgcacttaacacatggatctacagggagaaggaaacagaagtgaacatggactagatgagaatctgatggacgatatgtaccacgtgctttgaaatagccataaggatgtctgcacaagaatatccatgcattcgttcttagaatttcagggccggttgtagctcagtcattttgccattgacttaattgaaatccaaatcaatgcagacacttgctcaaggtcacatagcttgttctctcccagctcccctgactgccggcctcaagcccctgcctccacagactgtgggctacagattccccaagagatttccttattccctggattctcctaagtttgcataacagaagtacttaaatgcatcacttcatttgggtatgggattttaaataaataatatgatacaaattctctcacactgcagagagtctaataatagcttacagtaatagaatgaacactctgtgcccagaactcctttgaatattttacataacattaacttaatcttcacaatatcctatgaggggatactattgttatcctcattttattgctgtggatgctgacacatagggaggtttaaaaccctgccccacataatgcagtttgctagtgatagagccagaatcagaatgttgaaggttggttctagcagccacacagtaattgctctgacctatctcctttctacaggaaatggggtagaggagattcgtttcctctgaaaaaaaaatagctaaaacctcaatgatgaaaacctatgagtgactaatgagtatgacagctaatactaaatggacaattgtcactgtgctaagtggtttatttcatttgaattatcacaactcaacaaaaaaaagttattttcatctttctcttatacataaagaaactgaggcaggcggtgttaaaggaacatgcctttagccgcacaggtggaaaagagcatgaacccagacaggctggctccagggactgcggcaatgttgtaataaaatggcatttgttcagtccagttttaattgatgagatactaaacagagtcggcactaaagaaaatttccttggagaaacatttatgcttagctatttcagagctggaaagtccctttggtttgatataaacggccttcatttttatggagctggcatcaaactgattttagaaagaactggcctttctccaagttagccctggtcagaggaacctaacacatttctcagtttaaactagtaattctcaaggaagggcaaggtttggagagagagcagtgcaccgctaagggaggtatcagtacctggaagaggggaagcaaatacatgttctgaaaacaaaacattgctggaagacggatatcgaacttgacctaagattttcttttccatctcccctggctaagatgaacaagtttgcattgggcaagtagagtcagcatttacactggtatcttgtgcttggagtgaaaagcaaaatgaaacaaaaagaggtttctttttctaaaattgttttggttttgatttgcgtttagtcataattcttaatttatgtaatttttaacatttcataagacagcatgaggattttgtttttgaggaacatccattttaagtttgaagaaaatccatttaaatgcagttgggcagagctgccacatgcctatcccatccctgttctgatggtggccctaagacgtttcgaagagcttggattctacttatccaaaactaattctgtacatttacgggatcatcagaatcatgaaaaatgtttctagggattctaggtttttagtagagagagaaaatgatttctaggataaaattcagataagccttgagctaggaaactcatagttcatgttgttacaaagaactaaagctgatttttcagagtaccagcttctcagaggacctgagacttgcggatctcatttacagattccaaaacccctcgcagttacactggactgatttttggcttggaaagagcagtgggatacatcctgcactagcccttgtcctgatggattgagacacaaagcttggcctgagcctctgtgtcaccagtgttagagatgatctttgtttctcctgcagggagctttctcactgccaaatggcgtggggctttcctagctttaagatgaaacaaagagaatgcattctcccatagtcttgtctcatagactcccatctcatgaggaattatctcaagtaagtatcactttctaaacaggttgcaaaaatccattagacaggtaggattcacctcgcctgcccattagggatcagaggctgcctgctgagagcccatatctgcagtgttttctgggtttccttttttgcaatggctctcataccctgatgtcacttgtttggtgtgcatgattgtgcttagccaaaaagaatgtgcagtagtcacttggcctttaagtagcaggtagtgaaagacagcagggagagtgtaacgaatcttattctttcagaaaatactaagattattttatttcatgtttcactctcatcaactatttaattacattcattcattcattgatttaaaactcatcatgttgccactatttgcctgttctatgctagcactggagatctatggatgaagaagacaaacaaggatgctattctcatgtgcattacatttaattgtggataggaaattaaagcaactaaactcactgagaatcagagctaacatttgcccagcacttagtacatggcaggtgcagttttacagcttgatgtatgttaactcatttaattcttctaataagcctataaggcataagctattatctgcttttagagataagaaaatgaaggactagagactttagttaactttcctagggtcacacaggtaggaagtgacagagctgggatttgatccagggctccctggctccaaagctcttgcttttagccatgatactataatgcattgaataatgggcgatatctacctttccttgatggtcaggaagaaaggtcaaaagaaaggttgttagagctaaaatctgaaagaggagaaaagtttttcagataaagagagtgtgcgtgtgtattttgtatgtgagtattgtgcgtgttctatgtgtgctgtatgccgtgtgtgtgtgttgtgtgtgtgtgtattgtgttgggatagagcagcaacacaacagtgtccctagcggaagaagtaatgtctgtgatggtaagggaaaagagggtgaaagtgagaaaagagtgagagagaggctcggacaacttaaacaactggaaggccagcaggataatggttatggtagaggtggagagaaatatgaagttggaatgggatgggatcagggacacatcatgccaagtcttctatgccacattgggaatggaaagtcatgaaaagattttaagctggagagttacctaatttatcatagattttaaaaagattcctcttgcagctgggtcttaagaattagtggctcttcattgatgagttcatgtcctttgtagtgacatggatgaagctggaaaccatcattctcagcaaactatcgcaaggacaaaaaaccaaacaccgcatgttctcactcataggtaggaattgaacaatgaaaacacatggacacaggaaggggaacatcacacaccggggcctgttgtggggtggggggaggggagagggatagcattaggagatatatctaatgttaaatgatgagttaatgggtgcagcacaccaacatgccacatgtatacatatgtaagaaacctgcacgttatgcacatgtaccctaaaacttaaagtatataaaagaaaaaaagaattagtggctcttgcagttgttcaggcaagagatgaaggaggcttgcccttggatgaatggcaagattctgtgtgtggtatgaaagtctagagcttccttgatgaccatctcctaccccatgcatttacagctttctctccttagaaaaggatttttgacataagcaaaaacttttcacaaaaatttgtgtgaaatcttatttggggatttgctctctgtgcaaggagtcctactccagcaggtttcccagtcaaaatatgcctttgggaatgcagagaactgaaggccctggctgagcaaaccccagctggagagacagactggggattctatctgtgtatagcatgaagaatttattctaaacacttggatatagagccaatgccacttacaagctttcctttaagaatcctaggccagttgttaacagtttttaatctccttaatttctttatccatagatacctgacaggaacagtttggactgtggaaagacaataatggtccctttctgaaacagtctcctacttgctgaaggctactggaatagaagagaaaatatagtattttctgaaaatgtaaacagatgttagtttaccatttgtgagctgcagggttcagttaaagtggatgttgtatgtaaatacagtggtagcttgggagctgcagatgtctctaataagcattcccaagtgcactgtgttccattagtatgtgggattccactaccctaatcccactactgtggcttactctgggctccttctgtttctattcctgcaggacacataaagacaccttaggcgttagctgtctctatgtttccattccaccaaatcggaacttcatgactttttcaccttctctctcagtcataagaagacggctttttaaaggatgccaagacaggtggatcatggtaatagtatactccattatagcagttgttattcattgaacacctactgtttgtcaggattgggcaagtggcagtatacatcatcttatttagtctgcacagcaggtttaaagggagataatattactccgactgtacaggtgaataaatggaagttaaaataatctcggcttggtagtgatggaatcaaatgatgtaattgcctcattgtgaccagctaagggcaattctgttaggatctgtgtaacacattttaagagaaacattggcaaatgaagaaaggttagaggaaaacatctaaggtcatttaagtatacctatatacatttctctcatatgatatgacaggcttgaaaaattacacagctcattacgagcaagagagcagtatatatatattaacattctaatcttaataggaaaaactaaaggatgctgtgggaataaatggaaggatcatcatacctagccaagaaaatgataacttaggtcctggataaataaattttaagtagggaaaggtgggctggagttaggagcattctaaactcaatgaacaacatgcacatgcacttggagacagtgcaggtcaatttaggagctcacaggccatttagagtgacagaagcagagtgtgcaggtcaggcagtaataagacatgaggctggagaaatgagtaggaagcagatcaaaggccttgaaatgtcaagaactttgtaccttatgggtactgaagaagtgaaatgtttaaagaagccgaattatatgatttcttttgacttcaaaatggaaaatacatgtcgatattgggggagaaattaggaggttcttgccataatacaggtggcaaatgatggtagtcttcaggtaatggcagtaggaatgcatagaagaacacagatatgaaagattcttagtctggcagacacctggaagcaagggtgcataggaatagctaacagttaaaaaagtatttggagagctatcatgtgaaacagagagatgatttattttttctgttcatttactgagggcatagtaaggactaattggagaaagtcatagggaaacatattttaatttcaataaaatctgatgctccaaaaattgaaaacataacttaccattcatctctgaatgtatccgtgcattttttttttcattcaagttacatttttaaatgatgtgcaagttctatagactgggtaacagtgtacataacacttaacaactaactaaaatcagtgaaacacatatcaatataaacaaagagctatggaaattaatcctgtccggggttcagaggagttattaattaagatggtaaaactagctgaagggataattagagggaagagttgtgtggggtctgcaggatctacaagtggaattgcccacagaacctttagatcttatgaatctagagcttagaaaatagtcagggctggtgaagtatactggggaattttcagtgtaagcaaagaccatcaaagcaaatgtctctgaagaataagcaagtaatacaaataagtgagatggacaaggcataaggcaataagtactgggactatggaaaattggcaagcaggtgccccttccaaatggcaccactgccagtcagctccagtaaattgttgctctgtgctctcagatctccacagtttctaaataaaaacaaaacattggatatttatgtgatgcttctagttaatatgatatctcacagcatgtccttgatctaactatagcccaaaggctgtcagattgccttgtatgttataagatgattgttgaagctgtgagtaagactgaaattttctcaagcgagtagaccactggaatgtatacatgggtaatctttctcaagtgggtaaccaaatgttatttggtatgtaaacttttctatttccacatctgaggattcatgctgctataagtgatgtctgagaaagtcatgcagcacattagccagcaaggcataaaaggcaaagagagagataagaaagatgatgttaatctagagcctaatgaaaatgtgggagttcataaggagtgatcaaatacgtaaggtgataattgtggatatgtttcgatatcagaaaacattgcttttctgtgtgatagtgctttctttataattaatgtggatttagtgtgtgttatttttagccttttaatccctataaatgtgccacttcatattctacgactgaaaatggcactataaacaaaatggtttaggaaccagtgtagagagcaggagccaaagatggaatccagagtcacagcatgagggatgagtaaggaagatgactaaactggtagattttagaatgagctatagcagtatcaccaaaaccaagagtggagagaacttcaagaggaaagacacatttggaccttttaggtaactgaaaaatggcaagtccattgggtttaaaaggtaaaggcttctggtgacctctgagagggcactctaaggggagagttggcaagaatccagtttgcactgcactgggcagtgaacgggaggtcagtgagtggagtgattgccaactgctccttgggcaagtttggcaggaaagggaaggagagatgtggtgccattccaaggatgagacgaggttaaaaaaaaggctttactcattttttttctagtggagtagaatttataatatattaagactaggagtgataattgatgaagcaaggtacggaatgaggcataaaatggagagatcagagttagagcaattgataattatttttctttcagacaggttaaaaatatgaatctttggatgtaaccgagaggaaaattgagggagcttatgcctgatgcctctacattttctctaaagtaggagatgcgggaaggggtcagtagagagttgtgggctggaaaaaaaaagtttggaggagctgctgtagggaatttaacaggggtgattaaaaggattgctgaggttcaaactgaggttggaaaccattaagcagcaatgatcagtacagttgtgagcatttctccaacagtatcaggaagtccaggaacaggaaggggaaaaaagagggtctgtgttgctccaggtttttagaataacaaaccaaattcagcagaagatcaaagtgaaacagacaagcagtatgtaagtggagaaatagacaatggaacacaggcttgagaaggacataaaaggagtcaggagaagactgattttctgagagcaaagagaatccctgagatatatatatatatttttaatattagaatgagagattcttgcactgggtaggactttgacctgagtgaactttgaggttcctcctaattccaagattctttgattctagacatgagaaaacaaagctagtccctatgctgttgtcataactgtcatggtatgtgatatggtttaactctgtgtccccacccaaatctcatctcaaattgaaattcctacatgtcaagggagggacctgtagtccgcaagtgttgagggagggaggtgatcggatcatgagggcggttctctccatgctgttctcatgatagtgagttctcaggagatctgatggttttatgaacgtgtggcatttcccctgcttacacttctctctcctgctaccatgtgagaaggtccaagattgctttccattcaccttacgccgtgattgtaactttcctgaggcttccccagccatgtggatctgtgagtcaattaaacctttttcttttataaattacccagtttcaggtagtatcttcatagcagtgtgaaaatgaactaatacagtatgtaaaaatggaagtcctgtatatacctgtctctctcaggattggcctcaaggaaccttaccaagtagatgacatttctcacttgttcctctcacttgttcctctcacttcctgttgtagtatcatcttctatttattctccttatcaccagcagatcaaaacaatgagggcattgatctatcataagaaggctgccttcaggccctattctttttttttttttttttttttttttgagatggagtctcactctgtcgcccaggctggagtacagtggcaccatctcggctcactgcaagctccgcctcccgggttcatgccattctcctgcctcagcctcccaagtagctgagactacaggcgcccgccaccacacccagctaattttttgtatttttagtagagacggggtttcaccgtgttagccaggatggtctcgatctcctgacctcgtgatcccccagccttgacctcccaaagtgctgggattacaggcatgagccaccgcgcctggcctcaggccctattctaataaaacttccaggtagatgcttgttctccttctctgtgagtccaaacaaggtctctagttattgattctcatgttattgcagcttctacaaatttcaccctcaagtcagctttttggcttttctgactcaagtcacaagataaccatccttttgtttcatttttgtaaattctcataaccccaactggatggtagatgaatatgaggaagaggggaaatcaaaagaatgagagcaatgagcctattactcttgagatgaacagagggagagattcaacaccaaatgcgtccctcttctgaatcccatctctcgaatcagacagcacttctgtgtacttcccaatatccatacaaataccaggaaacttattttacttgcctctggccttggtttgcaggtttggggaaacacaggagtcaaacagaatttttttgggtgaacccacagatttcactctgaggaacagctcccttgctgttgagacagctgggtgcactaagcaacacatttgaaatatgcctcagactttgtggaaccaggtagtctgaaatcttgccaggactttagtgcctcttgggatacttctgaggtagggcaaagtcccattcaatgttctgttggaggagagaatctttagtgaaatctcaagaatgaaagccaagaagccttaagataagagcgagagattcaacagcaagtactatctgtaagaactttgatttcattgcatttaagcttcttttcctagtggactgtttttagttgaatacttcttgaggataagtgttgtgtcttctatacttatatctgcagcttagcacagttcctgccctatggtacatgttccttatatgtacatggaaattagccaaatgtcaggatgccactttttcatctccatctctattcctatgatggatgactggtaaatacttctctgactatgtatgtgtagttcaaatactctagtttttttttagcataaagtgctgtgaaatcccaccatcaaaagagccaaagtaatatgatgaaaagaatttggtttcagaattaaaaagaaagcacacatttttgagttctcgctcaaaaacaattttgtgagggtaagttatttaacttctccgtgtctcagcttcctataaaactagaattatgagatctctcttataggtttgaaataggatgaaaattcctccctctttttttttcttataacctctctcaaaaccttgcctgtgtctctatgagtgtgttgtgttacagttactgctataatttctctactagattagggtggagaagttcccatggctgttcgctctctcagaggaccctgggcaaagttggtgctcactgtgcatcactgattatatcaaatactgtgtggcatgctcaggccttgttggtctctctgtaccagtgtctatcgtgggacataataattcatgatgaacagtcaggcatctacttagtggcttatacgtagaagtggctctcctttcagaagccagaaattaataaatggtctacagtcagaaggagatccttaattgattaattaattcaataagaatttattaagtaccttctatgtgctaaacactggggagacaacagtgcataaagagatcccatctttgttcatatgaaactatattctagaggaagagacacacactaattgaatactctcacaagcaaaagtacttttgtaatggtaattcatgctacaaagctgtagaccttggtgctatctgatacagagatctgatggaatcagaaagttcaggaagagatcgtctgagagttcctggctagagataggaaggaggggcagagttaaccaggaaggggaggcaaaagtatcacagtcacagagaacagtgtgcaaagcacccatggcaagggggaatgtgataagggtgtgtagtgaatgaagccatagtgactggaatataggggacaagattgaaagtaaaacttacaaggacgaccattgcttgggagtttgggttttattagcactgcagtggaatgctgtgaaacaatgaactggcattgtagaagctggcatagcctgcttttttgaggacatccaacacccatgacaaggtctacggcatcaaggattaccttggtttgtctttgctaaccaaactgggttatacacaagttacgagttgtccttgtcccaactcacaccctcaccattggagaagaatgtggagtgcccctccccatcccggcccatcccttatgtcggtggactaacgcagcatgcctaatgccagagtgggcagaaagaataatagctgttgtttcagtttacctgtactaatttatcacaccttacccagagactccagctccactttctgagttttctctgtctggaggtgaaacacacaagcacataaataagtaggaagctgttaggaaatcctctttgtcactactgaagcatgttcatttatttagtaaaacgtccataatttttaaattgctttatttagccactggctatttggtatcttcaaggggtccccattaggagctgtacttccccattacctgcaaaaacaaggcaggcttttgatccctggaattaattacatgcaaagattttcattgcttggagcagcaagcagctggttcctacgggacccaggctgaactctcttgccaatttccctctcatgcttgtccctccctccacacctacaccctttctttctttcattatgctcaatgggttcaatctaatgagggaaattgtaattaaacatttacaaggttccagttttctctatgactgcccttaagactgtgaacattcacagttcactctttttccaaatacagcacaatggcaaagtttccaggaatgtccttactgactcaggccccccagaatggtattaatccatttgaaaacaacttcacttgagttattagagctggggcaaaagcagggagggagagatctactcgttagggatgagggagcaagagcaatgatgactagcttttgtcaggacacaaagtgcgtctctggtgcttgtgcagatcagttgacaatggtttatagcttttctaccttcctccctttcctattaattattcatacttctcctaccaagagaggggtcttgttttccttttaggtgtaattagagtaatcaaagggtttgtaacactcatgtgttttatttctcattctctattcaattttgtttttcatgcaagagaaaaatataaaacacgaaacaaaaaccccaagtctctgggtgttgtgaattcttgcagggaaaattggttttaccatattagcaattggcagcaataattctgaggtgaaaaacctgaaattactcccttaaaggcagtaatttgtatagtatgtattttgagaaagggggggaggagtaggtgataatttaggtgaatgttagcagtttatctttatattttgtgataaacgaggaagccaagtgttggtgtgttcaactgtggacatacatttgcatatggttttgtttctattgaatagattttggtttgaatgacaaattaaactcccagcttccaaacactgaattcttttgttcagactttacacattcttgaaaggaaaggtgcccacatgcacttatcctttaagggtgaggttaggcaagcaaggaattgacagttattttatgtttttttgttttttgtttttgtttttgagatggagtctcgctcttattgcccaggctggagtccaatggcatgatcttggctcactgcaacctctgcctcccgggttcaagctcttcttttgtctcagcttcctgagtagctgggattacaggtgcataccaccatgcccggctaatttttgtatttttagtagagatgaggtttcatcatgttggtcaggctggtctcgaactcctgacctcaggtgatgtacctgccttggcctcccaaagtgctgtattttaccttttatattaacaaaaccttcttcttgcagttcagaacccataggaaatattattggaaaggtatttcaccacatcatcacaggcatttctatggtgacgaagcgatgtgccatgaacaaagttatgccattttttaatacaagccgaggaaagagaaaaaaaccaggagcaagccactgcttcagggattggcaacctctttatgtttgctcaagatagagcgaaaaactcctaaggttttaccattaaagaaccaaataaaattgtttaacatgttggaattgtgggtcctttttgtatattgacttgagaaaaaataaaaatattgatacagaaaaaagagaatgcatatgatctttttatcttagccaatatattatgttttcttgtttttgtatatctacatattcataaaaacaagtatgtgtgaagaagtttacatcacagtgcaagtgtgatccttcatataaaactaaagcaagtgaggatgaattcctaaataattaaacggtaaattacttgtgtttgtatcagctcttgagccatcttaaactactaatcaatttctcataatcatcagtgcttttcatctgtgagcggattatttggtcaaacatggagacaatggcacagccgtgagtagagcccaggtgtttttctccgatttctccacagaactacaatgccagcagaaaggtagagtggagtaataataaaaaccaggtttaagagaacactaagtttttttttcagtgttgttcacggaactgcaagtggtatagaggttcaggaagtcattacagtcttcataggggtgcaatagttctcacttctcctttcaagaagagttgtaatggaaagttgaggaagaacagtagggacacagggacaggtggtgtctccaattggtcatattctccaagttatttttggtctatagttggttccctaaatctcacttcttctcttcctctagctttagggactggactcagcattttggtttcatttcttttttgaaaagtaaaaagaaaatttacaaaactataaaacaagttatatatgtatatataaaactagcatattaacaaatatatatgggtaattatataaaattatttatacatatataattacccatatatatttttcataattacccatatatatgtatatgtatatatatatataattacccatatatatgtatgtgtgtatatatatataattacccatatatatgtgtgtgtgtgtgtgtgtgtatatataattacccagaattaaacacctttaggtgtaattagagtacattaaaatttggcatactttcctttagttcttttctaaattataaaagtaacatatagtatatttttcttctctaaaaatattgaaaagttaaagtttccttatccactttctcctcaaccagagctgcttctcccaaaatcccaagggaatcattattttgagtttgctgtagatacttcaaacgtttaaaatatgtatttacatgcatatatatatatacatctagaaaaatactagcatatgttattttatgtagtttattcagttacttacatagtacagtgtactatgtaagtataattcacatcttgcttttttctttcaacactgcatttttgatgtataggtccctgatacactgggtattcttcagacggataacatttgatttagattctgaaagagggataagattttgccaggtcaagaaaggaaccggtcaggtagaacattagtttacgtattagcacttacttcataaaggcatggaatagactgcggaaaatcaaggttgctggactttagggtggaactggtgagagaagagacaggagactgagtaaatgcagaaagggtggccatgtagcctatggcagatattttgaattttcactgagaggcagggatattataagtgaaggtgaagtgtatcactttgctagagctgctgtgacaaagtgccacaaaccaggtggcttaaacagaaaatgtgttgttctggagactagaagtatgagataaaggtgctggcggggttggtttattctgagaaccataaagaagaacctgccttgttctctctcctcttcttatggtttgccagtaatctctgccattctttatagacaagtcaccccaatctcggccttgatgttttcgtgacattctctctgtgtgcatgcctctgtccaaatttaccttcctttatttttacaatttttattttaagttcaggggtacaggtgcagtatgttcagatttgttacctaggtaaacgtgtgccatggtggtttactgcacaaaccatcccatcatccagatattaagcctggcatccattagctcttctttctgatgctctccctctgcctccccttttgctgtgcagaagctctttagcttaattagatcccatttgtcaatttctgctttggttgcaattgcttttggcgtttttgtcatgaaatttttgcccacgcctaattcctgaatggtattgcctagattttcttctagagtttttatagtttgggattttacattttttaacccatcttgagttaatttttgtatgtggtgtaaagaagaggcccagtttcagttttctgcatatggctagctagttctcccagcacaatttattaattagggaatcctttccccattgcttgtttttgtcagatttgtcaaagatcacatggttgtaggtgtgcggtcttatgtctgagttctctgtgcttttccattgatctatttgtctgttcttataccagtaccatgctgttttggttactgtagccttgtagaatagtttaaagtcaggtagtgtgatgtctccagctttgttctttttgcttaggattgacttggctattcaggctcttttttggttccatataaatttaaattttttttctaattctgtgaagaatgtcaatggtagtttaatgggaatagcattgaatctataaattactttgggcagtatggccattttcatgatattgattctccctagtcgtttatttttatcctctctgatttctcagagcagtggtttgtaattctccttaaagagttccttcacttcccttgttagttgtattcctaggtattgtattctttctgtagtaattgtgaatgggagttcattcatgatttggctctctgcttgccttttattggtgtataggaatgctagcaatttttgcacattgattttatattctgagactttactgaaattgcttatcagcttacgaagcctttgagctgagccgatggggttttctgggtgtaggatcaatgtcatctgcaaacaaagataatttgactccctctctttttattcaaataccttttattttttcctcttgcctggttgccctgactagaacttccaatactatgttgaataagagtggtgaggaaaggcatcgttgtcttgtgccagttttcagggggaatgtttccagcttttgccctgcagtatgatattgactgtgggtttgtcatatatgactcttactattttgagatatgtttctttaatagctagtttattgagaattttaaacatgaagggatgttgaattttttgaagtacttttctgcatctattgagataatcatgtgatttttgtctttagttctgttaatatgatgtatcacatttattgatttgcatatgttgaaccaaacttgcatcccagtgatgaagccaacttgatcgtggtggataagctttttgatgtgctgccgaattcagtttgtcagtattttattgaggatttttgcatcaatatttatcaagtatattggcctgaatttttctttttttgttgtgtctctgccaggttttggtatctggatgatgctggcctcatagaatgagttagggaggagtccctcctcttcaattttttgaatagtttcagtagaaatgtgtactagctcttctttctacctctggtagaattcagctgtgaatctatctggtcctgggcttttttagttggtaggctattctctactgcctcaatttcagaacgtggtctattcagggattcagtatttttcctggttcaaatttacctttcttataaggaaggcaatcatgttggatttgagtccagtctaatgacctcattttaactttgttaccttggtaaagactctaccttcaaataagttcacaatgtctaactgtgagttaggaatttaacacatgaacccattcaacacatgaacctttgggggcaggacttaatttgacccttaacatgaagtgataaaaatattttttagacttgataattgtagctcttgtttgatggctgaagtatcaagaggattatgagaacagacatgaggctatgaatatgttgaaggattggaattttggatcactcaaatgtgatccaaaacctctggacacccttaccctttctagatatattttttccccttaaagaactcaaaggagaacagagacctggaaaaatatctgtggatatctggaagtaagcactgtactagaggttatcttgtatttgtctctagtttttatgttcgattctcagaggcaggtatttcattgtacaaggtgcaataattatggagtatacattttatttaatcacataggaagtggtttattataaaagagaaagaatactttaactttaaacctgttggacaaaagggttaagtataactttctcaattacttaggcaaatatattcttgaaaataaaaagttagaaaagagggaaagactgagaccctcaatgttaaataacattttataatgatcacatgctgagtcaaaggcaaaagcaatttctaagtcgcctacttaattctctagaccatgcctgctatcttatatttatatcttaataaatgtacatatgctgccttgctgttttggggacaatgggaagtataaatttgatctttcttgaattctccacatttaaagtctccacttgtcacttgaattaacatagtattttagcatttaatttcctggggataccagatgttttattttgtgagtttcttttatttatgttatagttgtggtttaaacaactatatgttcatttaaaatgaaactcaaaaaagaggaaagaatggcacaactcaataaatatgtagtttaataatattcagtgaatacgtatgcacagtgaatggaagtctaaataacgtactccagtgaagaattattagatgttgcccgtctcagctggattttcagttatactattcaagctggtgggaggtttcaggggaagaacaggggagaagacaaagcagaaacagccttaggcagtataaattctgaatacctttaatttgattaacttgttaatactagcaggagagttactttgttgtattctagggattataacatggcatcatttgaaatgatatggttcccactgataaggggaggatgaatagaagcatacactgaatttctctccagggcattgagttcctttggcgacagcactgttggctaaatatgaaaggctgtgagatgaaatggcagcaagagaacagcagaggaaaatgtaaggcaaggatgggaaacacatgagaagtttatacctgaccatctcttttctatcattggcttcctatctcctattcttcttctttgtcaatctctgtagcctccacctttgctcaaattggctcagtgatatgattttaatactaagcccacacccagttggtatgaagacattaagtaattaattaattcaataactatttgctgatctgaacaaagtggacaaaaaaccctgtctctgtggaattttcttccaggcatgaggggcttgggaatgggtaacaagtaagtaaattatgtaacttgtttgacagtgctaagtgctacaaagagaaactaggtagataaaagaaatagggacttgggaggttgaaattttataaaaaaaaaaaaaggtcagagaaaataccacttttctgatgagttaaaaagctatgacctgctaatttttatgtatttattctgtgtccattaaaacttccagaaactttctcttgaagtgacatttgagtctcaagatctggccctggtgattatattgtgacacactgtgatcattacaaaaatttttatcatcatgtataactgtgatgctattttgcttgcagcccagacaatgtgatggatttattaaaacattctgataatcataagacagtgattctaggacatgtattatcaggacctcttctgtacctgtgtttggagttgccatagatgaaagtcatatgataagagaaaagcaatatgataatttgtaagtgagctgcttataataagcaggatatgacagtcaacatttttcctttttacctttccttccatctctacctgttttctttgttatagactttgagttttgtatgtgtcaggtttcattcatttgggaaaccaatgtcacatcaaattaggaaggatgttatgaccctctaattggcctttgcattgtacacaagcctcctatgtttgttcgggatagcaccacgcatccttttaaattggtagtttgactgtcagtttccgtaatgcccttgacagtaaaacaaacacaactctatgtgattctattatgaaacattaatcttctgactgtatggtaaaaggaaggggtgagagtttctctccattcccccaaaggaaggaagagtaagaaagaaattaaaaatgtaaaagcactcccaataacaggtcatcaagtcacagcttttcattgtggccactctttgtcagctgtgtgtgtgacaagaaacaaatcacagctccatgatatttgatagccttgagtaattaaagagtcttcaatgctttttggaaaatgttgtccaatattccagccacatgcagtgctcccttaataactcaataactccacatttctctccctgtgtgtgtttgactattgctatcccttttagagatatttgcatgtaatcaagatagagttcaaagatttaccattttccttactattattctatatttgaatatccctcccacttccatttttttcttccgataggggaaataagttaaccaaaattcaaacaaaaatcagttttaaataaatattcctaataagaattattataactactaccacacatacatttatggtaggaaaatttagaatctgtcctggaaaaaaatacgtccagattatttacaaagatttgctttcagaatccctcttgagataaatagacatgttgggggtgattctgggatggagcaaacatgtagtttgggtcgcagtttaacgatgtagccgtagtgtattaaggctatgcatagcaatttctcttgccctggagtagttagtgtcaaactctttttacccattaaacatttgaagtagatttattagctctaaggattcttggttcttcctgaaaaggaattaagaatctttggacagtggacttcttgaaaatcctatcaaatacccctaagtatgtttctggtagcctctcggttgtgctattcagtgatgaataacacagagcttgattgttctaatttagcggaagaaacacattttttttaatgtggtttttgccattttctattatactttaagttctgtgatacatgtgcagaacatgcaggtttgttacataggtatacatgtgccatggtggtttgctgcactcatgaacctgtcatctacattaggtatttctcctaatgctatccctctgctagccccccactacccaacaggccccagcgtgtgaggttcccctccctgtgtccatgtgttctcattgagaaacacattttttaaatacataaataaatatcacccttttgtcatgtatcttcataagcaattgacccaaccaatggatttgcagtcagtgaaaacaactttggatagatgggtggatggatgaatgaatggatctcatttatttgtgggagctaaaaatttaaacaattgaactcatggagagagagagagtagaaggatggttaccagaggctgggaaggttaaggaacttggagggaaaagtggggacggttcattggtaccaaaaaatagttagaaagaataaataagatttaggatttgatagcctatcagggtgactataatcaataatatcttcattgcacatgtcaaaataactaaaaaagcataattggattgcttgtaataggataaatgcttgaggtgatggctaccccatttaccctgatgtgattattacacatttatgcccatatcaaaatataacttatgccccataaatatgtacacctactatgtacctacaaaaattttaaagaatgtgaatggttgaatagataggcagatagataataaagtaattactatttatttttgatttcagaagattttaacagggcccttgattatcattcatctgagatctacccttgtctgtatggcttatttgggttgtaggtaagagtcattcttgaatgagtgggggtttctgattatttttaaacagccattcaagaccaatgcagatacctaggaggaaaatgtttctgatttttatgaatgtgtatgaaaccggtaaatattcataacatagctaccaatatatgcttctgcaagccaatctaaacaaattgccagtatcaaagattctgttgatgaggaatagacagcctgtgtttgcagtcttgttaaggtggttaacagtggtgtcctgattttttccaaaaccttccagatttgggctgctgagtagatgatgctgacttccgatactgcttgttgttgttgtttaaaccattgagcaggttacgaacctctgaacttaaacgaaagaaatcagtggtttcagctggaataaaaaagtaatactatggtatagcataacggagataatacaatttttgtggttttaaaacagagaaaaaagtccctcttttaatgcaaaatcacctgtaaccttgaatgtatcaaccagtgtgacttagctgataatttaggcctatttcatagagctgttatgagaactaagtaaaatcatgcacatacaaatgattagttacttttaaaaactgtaaaatgcttgctgttattgttgctggattgaagagttcattgtgatggtgccattcaatgactatatgactaagatgatcatcctttgtactctgtctccccatctctcctccctcccttgtttttccatgtggtatgtgttttctctctctctctctcttttttttttttttgagacggatagtttcattcctgtcgcccaggctggagtgcagtggtgcaatctcggctcactgcaacctccccctcccagggttcaagtgattttcctgcctcagcttcctgagtagctggaattacaggtgcccaccaccacgcctggctaatttttgtatttttagtacagacagtgtttcaccatcttgaccaggctggtcttgaacttctgacctcaggtgatccactcgcctccgcctcccaaagtgcttggattacaggcatgagccaccgcgcccggcccgtctctaagttattttctaagctaaaagtcatgctactgcaaccaacggatatccccccttttttggagatacttggtaatgtagaaactatttcagagagtcaaaattctacagatagagtttagaatgcacaaaatctagacatggcattgaggcatctagatattgcctttacctatttcctgtaggaacttgctccagattagtatcttaaagacaaattggcatttatttttcttacacacattgcattgtgccatgtaagaaaattacagattaaatcagcattttcctcctgcttgatgtgaataaaatcaatgctgaaatgggagtcctagttaatctatgtgatagaagttactaggaccagtgtttggtggcttaggtccttaaagaaattggaaagctctttgcaatacagtgtgttaacaacagccttttctttttattcccttccctttgcaactgttcccagcccttctttaaaaatctaagtcagaaatatattgaagggctttatttctatccatttttttctatctgcacatggctgttgatattccttcactgtcttggagctatcaactatcagtcttttgtaaagtagcatacatagtaaagtatcaagaaaacattttctcaagccagactgcctgtgctcaaattgcagctctgctacttactggctgagtgaccttggacacgttatttaacctctctgtgcctagtaaccactacataggagggtattttataaggattaaatctctgtaacacacgtagaaaagtacctgccatatggtaggcacaatatacatttttgttaaataaaatgaagcttagtagtttacctgcattgttcacattatctaacacattaccttccacatcgtaggtacacaatgaatattattagtcatgacttatacatgactaaatgtattcttaaattggagtggtacaaaaaacatatgggtccattccacatttctacaaactagctctgcagtcttgcacatcaaattttagtgtctttggagcttccttctcatctttaaaataaaaatatttgcccaatgtatttcaaagggtaattttaatgatcaaaatgataatgtacttccaatgagttgaaaaaattatttctctatatgaaaggtattataacatttttatttctcaaattactaaatcagttctaggggaaatatgctagtaaaatagttaaggcttgacagatataactggtccagaggtcggtagtcatcatgagtactaagacctagatactaggggtctgtgtttgttcttgagaatacagcaaagtgtttcaaggaaggaggcttctcctttacttaccaggcctgttcagctgtatttggctacttcttgttatggaaggaaacctgagcagaccttgggaatccagtgttcctttatcacattcctcagatctgttaggctggacgccaaggacagtagtttgaaggtgtttgtcttgatgctgatggatgttgcagtctgtaatccacgaactgaaacagggcttctcttcattgcagctggcatatcttgttgtgtttatgagtctgacaggcaaacatatctgaagcatatctcatatgctgatctgtgagggagataagccccttgttttgcttgactggaaacaaaataagcaggtggcagaaaaccctgcattgatttctgcttgggctaaaacacccagaataagatcaagtcccccttgggcacactccagcctctgctatttgatcattgatcatttgacttaagtttgcaaattgttgtagggaagtgtaagtttctttctgctttaacaaagctacttttacttattttaattttataagctattagcactattttgtgatagaaaaaactaaaaatcaaatggtgtcagagcttaaaaatctcttacttcatttgccgtgtaatctttatgcatttgatttttgcttcaggatccttacctataaagcatacccatttcatttgaccactagatttttacagaataaaaatagttcctttctgaagaggaactatgaaagtgtatacatgggttaggagatggagctgaggactccaaagtaatcagtccctgataagaacttgagttttgatgcacacattattgcattttagagattttggtctcccagttagattgtaaacttattgaaggcagtaggacattgacaatgcataaatattagttaggaaaatgaaaaataaagtgttgcttaccaattcagagattcagaagaatgtggataggattttttccctctcacctgaaatttcgactttataaactctttttattactgtccttccttttctgatcccttgatgattattaattggttccagtggtgtatatttcagatatttaattaagtcttcctttctgtccaactctctgccaaaacatatttttcatttttatacctgcaatgctcaaacataagttgatgccaaatgcatgctgtttgattacattccatccagatttacttccaagcaggacgaggcctgtagcatttatttcaagtagctttacaaagagccattcttggccctcaatgtgtgtggcaggcggggaggcaggagaggaaaatgaggtagatgtccttcccataccttaactagtttttgagagaaatggaaaatggcagatcagatgccattggccgtttgcccaattaagccatagcagtgttagctaagatgtgatcaatatggaagacttggtctgcagagccttttttagctgtgctcctgtactagtcaagcacctcctgcaactttgtggtaaattcaagcacctcgtgcaactttgtggtaaaaaccatcctcatgagttagagccttgtcttataagaaggaagaggacagcttctgggtgagacacgtgctggccatcatgctgttgcctaatctgtcacctcaactattgattcccagctcttgattctcattgttcattcatggagttgtttctaaataatggtgactagagaggaggaaatggtgttatattagttctctattgctgcataacaaataactccaaaacgtagcagctcaaaaatcaacaaggcattacctcctaatttttgcaggtcaggaatccagatgtggcttagctgggtgcctctggcttagagtccctccataaggctgcaaccgaggtgacagccagggcttcagtcacctcaacttgggagagatctgcttccaagcccttacctatggctggtggcaggccttagtcattgtggactgttggccacagataatacttcattggcacaagagcctttctacaggacagcttacaacttaatagctgtctttgattgagggttggggagaaggtggaagccattgttgttttcaatctaatcttgaaagtgacatcctgtcacctctactgtattctattcatcacttagaagtgagtcaataagtataggacatttaaggggagggaataatcaagggtatgaataccaggaggctgagacagttgggagccaccttatagactgccttacacaggtgtaaaaagcatgaaatagacattagacaaatgcagggtctgctgagatggcgtgtaaaaagttctatcacagggcttgccacagagtagagaagcattgcatttatttcttgccacccccagcacattgcctggtgcattgtgggcactcaagtacctacatgcccatgaaactgtgtctagtttactaaaaacaaagagtctctctgttccaaaagagattaatgtttggtgttatcctttctggacaattttcttcctatgcttcatttctccagttatcgtcaagggaatggatttaagtctgaaataaaatcactcaaaaataaggaatagctgaagcagacctagaattaccttggtggaattaccttcttaagaacaattagaagtttattctttaggtcaggaatgctgttgccaatcttccacagcaggtgataagaattaaattccctcatgaccgaggaaacgttctttctgctaatctggttccacctggaggttcaacaaatagaagatagagcacacggtgtgtttagtcttaaccacatagcccgaggcactggggaagtgtccacacgatgtttgccttctgtgaacctggaaagcaatttttttctagttttcctttttttcctcttcttttcctattcatctgaattcttctgtagttaaattattaatttctctccctacagaatataataaattactatccttgttaattcttttatcaaagatatgtactaggcttctgcttccacatgggccatttgaaaaacagtgcttcatatgatccctgaactttttggcaattataaagagagatcacaaatgagtaaggttgaaaattaaactataactggaatgaaatgtcctataggactaaacctatcagttgtattgcagatcagccccttataattggtgatgtggtatgagacattttatataactataatatataggccataaattattattatatcagtctgtggtataatattgcaccttagggtagaatttgctccatttacattatattcaggcagaaaaaatgaaaacatctgtcagggagagtatagccctattgatcaggtatatataagtaaggtttacttatataaggctgagaaaaggggctttccatttgatttcagttgttttatagacaagtttctagtttgagggagctatttagaaatgtatgtagccttatgtagaaattccaataaagctttcaaaaaataaagctggtatttatattggttgaaatggcaagataatgagtctaaaagattttcccttctgatgttattttttttgttgttcagaatgacacttgaaagatgcctaggatttctactgctgctcttagaatcacaggatctcagggtaaaatcaaactttagaggtcattaatttcaaccagccataaaggtctttttgtcaaacttatgaccattcaagatactttggtgtcaaagtagctcacaagataaaataaatcactcgcatgttaacccataggaggttaaacttttgacagcagatctgtggtggtagataccatgttttctactgtcctattggaaatgagtgttagaggcccatttccactacaaatactgcctagtggctgacttacatggtaaaaatccatccaaccttgctctgcatacattccagaactctaatgcaaaatgatgcctaaaccattttaactctatccatgcatgaggacactaagtaagatgaagcttgttttgatatatacactttttaaaaaggtagaagaataagaggtggtaaaataagttattcaatttattgactatagtaacaacttggctctgattgttaatgtttgtccctgccatgtgatatatagttgtgtgagattaaaaacccccttgggtataattttatttacaccaacacatatattttgaagagatgaatgaccaattctgggaatagttagaagtaaagaatttgaattttctgcagcactgctgcacgttaggtaaattcctctctttgggcctcacttgcaacaccaataaagagaggaagttatactagatgttctataagccccttccagccctaacatgctattagcccatgattcttgtgtagggataccagaagaagatgaaagagagaacctaactcattttctgtcaccagtccttataattcatggcattgtgtatttctccttgagtcaacattgcttcttttagtgacacaagcaagcctgctttctccagctcctcaggaggcaactctgctactgcagaacaaagatcattctcttcctggcactcttctgattcctggtacctgtattcagtttcacattccctttcttgttgaggatgccattgcctatagaaagatactttaggtgaattaccaggcaaacgttactaaagcaaagataactgataagggggactagaatcttggaatttgtgcaaataaattcctttgtgaaactgcagactgattagaaaactgtcatagtaaaatactttaagcatgtccttttctcattttaaaataacaactggaaggaaaatataaatatatcactgaaataatggtttctccatgaagaaaaagacatttagacaaaccaaaagtgtatattctatggtgtagtaaatcattaccttactatattaggttaatacttgataaaaccttgtagtgagataaatggtgatatggagaacttaaatcttcaaatgtatgttttaagccccattatagctattttttttcaaacttacctactataaagttttgtccagagatattccaaaaaagaataatagattggtattaatgtttctgcctcttttactctttggaagacgtgccaataggcaggtaaagagatcaaaaagaaaaagtcgggcagggtgcagtttctcacacttgtaatcccagcattttgggaggccgaggcgggtggatcacaaggtcaggagttcgagaccagtctgactaacatggagaaaccctgtctctactaaaaatacaaaaattagccgggcgtggtggtgcacacctgtaatcccagctactcaggaggctgaggcaggagaaatgcttgaacctgggaggcagaggttgtggtgagctgagatcatgccattgcactccagcctgggagacagagtgagactccatctcaaaagaaaaagtcaaactagatcaccatttacttaacaaggagctgttagtgtattaagagtattatgccattcagtctgattaaaccacctgaaggaacagtggaacctcttcctaatcattcccatgtgagacttcctgggagacagctgggggcagccagaagcaagtagctagagaggactgtggatttctttgtgaggaaatctgaaactggccactttaaggcccctgggttctactgaggttaagcgtctaaagtgtccttgactcactcaatttcaaagcaaattcaatttgatctcttgcctaataataaacactgggcagaagcagacatggaaggatttggaaaatggtgttaaaagatcaaagagatctaaataaactattttgtttgaactagagttaccaagtagaatagattgttttaccatagatggagactctttgagaaggagttaaaatttgtgggagatccccaaaataatggcagttcccacacacacttttcccccagagtgtatataggggatatataccactttctcacctccttttccacttcttatcattgttagatctctagaaagttcatgtagcttctttctcctttgtcgttatatgtttcagatacctcaccagcttcctttgctttcatttaccatatcatagtggtaatttcctcaattcctatatcctacaagagcttgatgaatgaaaagaaggaagcctgtgacaattattttattcaagcctccaaaacagagttttgccaaatgcttgtcctacttctccgtgcgcttgccatggtctttgttttgcctctttttcttttggcagttaccccaactataactggaatttcctgattgatgaagatttagtggtccaaacacagtcagttgtcttttggccagaaggaaatatacattatataatccggtggtttatcttcttatccctcccccattaacttttttttgttttgttttggtttttgaatctctgcttcccttctccatcccctaagcaaaagcataaccagcacgttttttagcatttagtagatacaagcctagcattgtgctaagtattttgcgtctattatctcactaacttttcagaaccatcaatgaagttagttcctttatcatccttattttgtagataatacaattgagatccagtgaaactatagttagcaagtgtaggtgcacatactaaaaccaaatgaatgacttgaaatcccaagtggttaacatttattccagaatactttcctaatctgtgcctggcactgcactagttaatgaaaacagagtgagaaaagatatgatgtgtccagccaggtgcggtggctcacgcctgtaatcccaactctttgggaggccgaggcgggcagatcatgaggtcaggagaccgagaccatcctgaccaacatggagaaaccgtatctctactaaaatacaaaaaagcagccaggtgtggtggcatgcacctgtagtatcagctactcaggaggctgaggcagaggaatcacttaaaccctgcccagaggcagaggttgcagtgagccaagatcgccactgcactccagcctgggcgacagagtgagactttatctcaaaaaaaaaaaaaaaaaaatgatatgatgtgtccaagctctttgtctaatgaaggagacagatgtcaaaaagataaattactatacggtacaaaaatgctcttatagaggtatgagcaatgttctatggcagacaaaaaattagaaagaagacacccattttcctcatagtaaaccaaaaatgatctaaaatattccatgtttgttaaaaagcaagatctttatggttactgttaggcactgcggtatgcctccctggattgtcaataccaatgccatatagatagaacaaatagtttgaaaagacatgaggacaaaacagtctccctgtctcccaaataatagatccaaagaattctctggatttgaatttaatgttcaagagaggggaaggcataaatatataaacatatatgtttcatacatatgtgtatacatatatatgtttcatacatatatatatacatatatacacatacttatatatacatacataaatatatttatatatccacttaaaacatatacaaaactacctatacatatatacatctatatatcacatgtttcaagaagctgttttctactaacatcttcatgtacgtaaaatttaggtgttttataaatttatttgacagagcacccctaaaccttttatatacacacctcatcagatggaagtaatatataaaggaaaggcactggcttcattcttctatttttaaaaggagtgaaaacatttttgcatttgccaaactcctgtgtatgcaaactaattgtgtgtgtgtgtgtgtgtgtgtgtgtgtagacacagcaccatttttggtgaggatggcacaggggctctcaaaagaaggagttctcagaatcatagcaccaaaacgttgtgagtttgcaataatcagagtcatggtgagcatcatggaaatttagaactaaaagagatgttacagattatctccagtctgagtccctgccacacatgagaaactaaggccaagagatgttaaatggcttgaacacagaatgatcagtggaacaatacctagagcttctgtcttccaaatgagttctttttccaccttatcatgcacgttacatcaggcatgaatactggaaatctttctaatgtagggacatccaagcaaaacaagttgcatacatgtcataaaaaactttaaaaaattcagatttacttctggcaaattcattcaggaattcaaactcagataattaaattaatttcttaatattcaaataaagaccagatacacattgacatcatctctcttgtatattcagagtaccagataaatgggatttttcactagggggacaggattgctacactacaccattgccatttgcattcacaacacgggatggcggaagagacattgatacaacattttttctgcctccttcatttttaaatggatggtgacatgcttcacagcagcatctccaaacaaaagatgacaaattcccatttattttccatcagtggtactgtgtgagatgttgtactaagtctaagcttgttgttcctgaggcacagaagtctttttcctgcagcatatagcattactgtaaaaataaccattccattgccagtcactctgtcaggagtattggcagagtgaagaagacttatttgatttcactaaagctattagtttgaaattctgatctgtaaatctggatgggaaccacacgagggaaaggatccctgccagaagcaatgggtcttgtacattctcaaaaacaaaggtcagatgaaaacactggattgaaaatagagccctagaaatgaagcaagaaggaaggaaacttatattgagcgtttgtaatgttccaagcattctgttaggctgtttacattatgtacttgaaaccgtcaactggattcatcttttccttcctttttccaccattgctggcatgtgtgcaagtgggggacccagggaatagagactacaatgtaaaaaatggtttcgctgttatcgttgtcatgttttcctatgtaaaaaataggataatgtgacttttgctgttgatagatgtttcttcaagatcccagtagagtattttgtgactggaaaatttctagaatcttgaaggcaaaaataagtgaaactgtagagaagtgtaggaaaagtcatcaggggttttacataaaacagtttttattaaatctcctttggaagggagaattacaactatctgagctaagttttgttgtgatatgaacgatagtgactgctaaaaggatagcatgggaaagttttttgtttatttgtttgtttttgagacaggatcttgctctgtcatccaggctggagtgcagtggcaggatcacagcctactgcagcctcgacccccacccctaagctcaagcgatcctcccacctcagcctcctgagtagctgagactacaggcctgtaccaccatgcctggttaatttatttatttttttttttgtagagatgggggcctctatattgcccaggctggtctcaaactcctggccttaagtgttcctcatgcctcagcctcctaaaatgttgggattatagatgtgagtcactgcacttggccagcaagggaaagttttgaggagtgatggaaatgttctatatcctaattgtggtgatggttacataaatctatacatgtgttaaaattcatagaactatacaccagaaggaaaaggaacccttcaatttcactgcatgataatttacaaaaataaaatttcaaaaattccagtagtcaactctaagccaataatatgttggactatgtctaacaaaagggatattatttaaaaatattgccaactgactatcattaaagcctaataaataataaaaaagtactgtcactccccacatgagacaaaattgtcatctttacatttatttcttaaaattattctttcctggcatctgtaatcatctatggcttcttcatttcctatgcccctctgctgtttggaaaatcagaaaatagaaggcattttggcattcagggtgataggtaaatgcccctattgtaccttctaataggtcaaatatggtgactttggttggttcttatttttgttatttctccagtcatcaatcgtattgatttttttaaaaacaaaggtcaagcacatgttcgtaggtgacaccagttgcttcagtgagttggtcccttctgcttactgttctggtttaaaccccttgtggcattttctactgcatggatagtggtaaatggggttgatagtgacatagaaatgaacttagaagtaagtttatagactgttggggaccatctgttaatgtaaatgtttaaggtaaaatgcattaaggcttaagagctgacgagacgttttatttgcctcctgcttttgggattatgcctggcacctgcttgagtctagagggttcctggttaaacttgggaaacctggtttcctcttttatctgcagctgttcgttttctgggatggaatcctaagcacttatttgaattgtatttgttgaagtcactgggttatacagtaaaaataaggagtcatgttggtttttgttcgaagttttaaagtatgtaaattaaatacatttatatggctaattgtcatttatggttacctactgttaaatagttgtttaatttgttgtcttcagcattgaaaagttaagcagtatcccttagcactatcaatgtcagtcaagataacagttcatttatttcatagattactttgattaaaatcactattaaagctatttgaattatattataattttctggtgatgtcataataaagaagtttttgaacgtgcccattttatttttaacgcttcaatgtgtattactggagaagaaattgaagtaacatatttttactgttaatgggaaaatggtcttcttcaaaaaggaaaaatcaaacttacctcctagatataaatcaataattttcatttctagcattaacttagtagtttaatgacttgggcttatggaatgattttttttagaccacatcagacctacccaagggaaaggaagcacaaaaaatagggaatgatacgtagaattagatggcgagaagaaacgaggagagagagggaaaaagtctgaatgcaagactattgaaataagtgagtaacacacttttccagaaaagattcatattggagttttctagaagcctctgagtatgatgaggaaaaagaagtgattaaaatttgaatggtttccctatgggcggataaaactacctgttcagctggaatgattctgatgaccttgcctctgaagcttatcctttgagatcagcaaaaaagttcatgttctcatctctcatttgagctggagttgattgatgcataattaagatccctaaggaacaggtgcaaaagctgcagcgcttctagattcatccatttctctctactttttaaagaccagtctcatgattctaatactataaacacttggtggcttggtattgggggcagagagcttccggtaggatgacatgagataggatgtcatcctgccacagggaataaattcttggatgaaattctacaggtcatttagcccatctcctatattgcacaggatagggagctggggactcctgaggcaaagtcattttctcaaggccgtgtatctggttagaggcagaggtaggaaggaaacccaaatctttctatttttagaccatttgcctctctactaggccatccctcgctttaacttgggatcttaagcttcccttgtaatttcttgagagtaggttttaatcttcctactgtatgctctagaaactatatgctgggggaaagctgaggggatagcatagagtaatatccaatcttgaatcctttctctcattttaaattgtggtgttttaaattagcataggtaacatagagattattactcagttgaccactttgcacttgatctgagggacattgcagagtcatcacagattcttgagttatgaggtcagtatttaatgaaaggatacgtcgaaggcttttccttaactttcaaggacctgtggggatagtttctactcaatgcttctttttattcgctttcctaataaaactaatatttaattataaaattaaaatgaaacaagtttggacttccgtatgaaaagtcttatacttgatctgtaactacaagatgttagatgttcttcatggagatgacaggcaaaggttacttttacagttctatgaaagtaaaaagcttttaaaacatttgaatgggaattggtaaaagaagcagttcttaattatgtcaattgtctgtaagagctcaggtgattatggtaaacacacctgataacaataacttaagagagcaacaataactttacagcagacacacctgaatgttggtgggagttctgagctaaggaacccagaagtggccaacctgaagatcaattccttgtctacgaggaacatctgatcccctggcctgtcccttggaacatgggccatacaaggagttgaggccctttgttttggattaaatgaaggtttccaagcggacgtggttaggaggagggtactaagtgaaaatgtgatgtaaactgcctgccttttgcaagtggttctcctgtctagcctgctacctctggactctctcccctgtatgcaaggccccagtaaaaccccaggtctcatttgctggctctgggtctctccttcagcctcttgaacatgctgccatccccggtggagtcaataggaagtcggcacaacagacaaggaagagctgtcaccttgcctgataaaataatattctaaaggggaaagtacatatttataacaactggcaagccttatgacttaaatgaacagagctctgctctatggaaacacagaaccaacagtgccaggtatgaatagggaaaacttcttggtagtggtgataccttattagagtcttgaagagggcatatttcctggtacagaaaagggggaacactcaagtagaagagtaaagcagaaaatatataactctccattttctcaggaggtctaactcattacagttccatttaacccaatcaaaaccaatgctcccctttccctcacatctttaccgcattcttttaaagaagcatacgcacaactctttgagcaagaaatatcaggcaaccgctgccatcttagctaaaaaatcttttatgtttgagaacttacctggaagagtcctctggagagagaataagaagatgctttcagttgcacttggagagaatgtgagaattaatcgcctgcttgtttgggaaataacaactagttgtttctggttaaagcaacaccagtatttggatgagttggagcaacgtcagaatgattggaaattgctcaaagctcacaatggtacttgaagtaaaaggatgaaccccttcaagaacaatgctaggttctcctttgctacatggagggcaatggcgcatgataggccagggagaaaagaatcaccagatcctttgcctacttctgccaaatctgttgcaatgtttcagataaatcacttgaactatctgagctttgaagtgcttcagcttccactcaataagaaaaattgtttgaacctctctcattctgctcaccatcttacccttctccttgaagatcagcttaaaataaagtgatttgaagccccaggtgaaatgggagccctttactacctcctgctaaaggtggtaaatgactgtgcccaactttgacctcctctagttagcaacatcattctaaacttagcccagacagaaaaggatgacagcaaaggtttgaacacttttaaaggcctctccctttccccagagttcttatatatctatgtatatgtgtataatatgtttgaatattttattataattatcctccttaagaaaaacaaatttcttggattttccctatgacttgggcttaagaagtctcttaacagttcctcagatgtagtacctgcggaagggaaggattaggttagaatatattcaaagtttgtataaaaaagagggtaaactagtcatttaaatgtaaacatataaacacttactttttactgtgttggctttgatattctttaatttctttgttatatcagccctttttttatgtcatgttgaaaatgtgccttcctggttaaaaggatggatatttggaaacaaggcagtttgaatcacagcacaactatttaattttaaaagacacttttttctaacctatataattcttaattgttctggacatgtaggctatttcagtgaaatttagaaagcaaggccatttcctacagctaagccctttaatgataattatgacaccaacccccaaagacatggtttcatggctaacagatcactctcagattttgtggggatagagtgttggtagcaggaagcggcagaggaattcaactccttcttgagcttcttgtgttttataatcctccctatgtcccacctgttttgtctcagaggggataagtcaatagagctgctgctgttcacaaagccatgcaggtaagagacatgtaccccttgcttcaaagtcttagtaaacttatagagaaaatatgatttgattgcctaacaatatatttataatttacataccaaataagtgaaacgtaaggaaaaaactgctttgagctcccgagaatgctagttgatagcaaacaaggaaggtgctttggtaagaaggttgtttgctttgagcttccatggatgagaagaaatcaagtaatcaaagaggaggaagaggaggaataaaaacatagttgagaatggaacagtcagagacatgtgggcactatcttttcagataggaattttatctttcttccttgttcaacagttatttcatacacgaatgagaaaggccaaacatagtcatgaacgtttgcttttttaccttctgcctcttcagtttttcaagaaacactaaactcgcacctaggaatattttgacaagcttagaaactttttcaaaaaataactcttgtatatggcaagatgttactaaaatcagattttttttttcccatggagacgatgactgcagaacttttcattcacaccctcaaactcgtgcagagagaagccaagatctttcttcttctgcacatttttggcatcattcagtggacttgaaagaaacacagaaaattccatggagaaatatcttaaactccagctcacctcttggcttctttcaggaatgcttatttgacctgaattaaaatgatgacttttcatctctcaatctgaagcataaataaagtaggaattttgcattaggattgtgttttttaaataatcataaaactcatattcaagtacttccttgaggcctctaaactaacacattttggattgctataaaaatagaatcagctttcctttgctaacatggataggtatttatatatcaattttatagaggactgactgtactgtaactttggaaacaccttctctttttaataataagaaatgttggctaagggcttgtctttcctggttctagattagctatgataatactcatccccttatgcagaaaagctgcttttagacttctcattgcttcccagttaatataacatagggattattaaagtctctgagtatgcatttctagatgtgtatagcattagatgaaaattccttaggcctttggaaattcttcctttcccttttagagaagaagatattatcctggctatcatacatagcaagttatatgcatataagataagttcccttttgccatgaaatcaatcttccagttacaccctgggtttgttctttcttttctcatcttgttcctttgcttttcacttctctaattttacccatcaagtgatcatgcatctgtttttcaccttgccctacaaacctctcttagttgctttattctccttccccagtgcttctgtcaccatggcttcatatctggccccacccctaccccatcctatgcactattcaaaatcttcattcccagccatccaccaactgtcagcagaagaaagtccaactctccagcctctttagaaagcagactttattccccacactacataatgcatagtaggggctcagtgataccaaatatgcagatcacataattaagtccatagcactgcctaaacatacatggtatttgaaggaaataagtcctgtcatggatgttgactgaaaatttcccagcatttacagcctagaatttttaatggaaacataaagccccaaatttggagataaaggagctacagaaaacagcagatgtcccagagcacacaaaccatgtggccaagagcaaaagggaactcacaaggaggtgtctgtattacgagaactcgtgcccaaattccttttctgtgagaaaacagtaccatataatccttttgtctcagtaaaaaaaaaaaaaaagtggtccaaagcagacagaatggaatatgcattctccctcctttacccctaaaacattctgtcttgatcaatttcatttttttttgtcaggtgcactagatgttataaaagcacttagcttattgcctggtacatagttatttgaaaaactttgaccatggaaaaggctgaagaaagctaagagtattctatataaggtctggaatgtcaagataagaaatttgcattgatctaacaggtaataagaagctccataccatattctttttacctgtatgtaaaaatcaagaggagttaatacaagtagtattttattaccaaaatagaagttgcatctggctcagactcagcctctgattcctcaggaggtttttcccacccctttccctattcctgctttccagctgatttgaccgaaggacagaaggattaagaaatcaagtagcttatctgagaggttccccatggggcgctttgtcccaggtgttcctgcttggagcttacataatcaggggctttctgcatgctgagggtattattgtaaaggtgattgtttaagtcagtgggtgacggtgtcaggataattatagccaggagatatatgatcataaagacctagttagtaccccaggagaccccaagacagggcttctgcccatacttttgcaatcacacattctgaagtaaggtggcaccatttaccaagtaggaacaaaagtgaatgattagggagaactgtttgttccagtgctctggggacaaaaaaaaaatccatgttaatcttttctaaagtgtccacttttgttatgtttatatttttgttgaggttctttgttcacttgcaactaaaccaacacgtagaactgaatgtgatttctactgatctagaaaaaaataaagttattattaaaaaggaaatctaaaggatgataaattagctgcatatttttctgttcgtctattgttttctattttctctatcttaaggttgtttataatagacagttctacatcaaacttgagatgaaattaaagttgtgaaagatttatgatgtgtgttccagttatggccaccagttctaatatgcagggaacacgtttgaaacgggatcacagttgactattaggatacaggactattcttttcagcagaactaaagagaagatcagagacctctctattttttctctccctgcctcttcttttgtaatcacatgattaatacatgctattgaaaaaggtttcaaaatgtaatgaagaatatcaagaaaaacatagaagtcctttctgactatctgcaaccttagtcgcctctcaagtgggaaccactgttaacatttcaatgtgcagatgtcaaaaaccatttgctctgactttacaaacaggaacgtgcatgcacacacacacacacccttgccctaaaagttttagttttaataaatggtgtatacagtcaacatatgtcctggatatctctccctgtctgtacttgtagaaatatgtaagttccatttaaattcaaagtcaaatacaatttgaagttttgctgaagcttctttctcaatacatgcttctagattgtagtgaataagtgactgaaatcagctagccagtttctaccacaacatgatagcttggttttatggctaaatgagccccaggaaggagtgtgagaaactcccaccttgctccattgttcatgaaggacttgcatggtgagagacccttgggtctcctttcatcccagttttatagtaaaaagatcaaagatcttccccaaagtctctgcccaactgggtccccaccctgttaccttctgaggagtctaaccctgagtactgctgggctttgcagatcctagagttgcgggttatgagtgtgtccagagaaccagagtatgtcatctggattcactcactcattcacacattcatttattcacactcaacaaatatttataccattattcatagggcagacagtgaacattaaaaatgtgaaacaataacatacagtccattcattgtcaaaggatactacagatcaaggaaagaggcaacttcaagaaagtatgattagtacattgaccagccaaatgtagaagcttctgtgtcagacttgacagggtgagggaaagcttcctggacaagaagacatctaattggaatatggaaggatgcttagaatctagccaggtgtggggacttaaagggtaaagcaagtgctacccagaaaacgtaagtaaggcagatctctttggcctgaagtcctcatcaaggagtttaagctttattctgagagtcatgggaaacaactgagaaattttaagaagcaaagggacctgatctgtaagatttatacaatggagaacaatatggaaaaggaaaaagacaccattaggatgctgctgcggatgctggggtgagtgatgttgatggctttaactaagggaatggccctgggaccaaagaagtgtgcatgttttcaaaagtcatttcttgctttctgcgagcgagcctactaaactgcctaagcacaccggttaagtgtggcaactttgagaaacagcataaaccatgggtgacattgcaaaactgaaagcacttggtgcagaggttagataaatatctgtttctagggggatatacatgtgtgcattcattgttttgttttcaagagacaattgtgcctgaggctggagcttgctcaccctatcttttggactcagagtatggggcctggtctattttctacatgaccgggctttagttcagaactgacgagtcatatatcattctgattgattttttttttcttttttctttttttcccctctcaaataaaggggttgcaggggtgagatagagattgctatgaaccatcagggcaactcaacccaaatatgcatttatcaggagccccctaagtcaagctctcctgtcctcacttggtttgtctactcagagctgagataaagaaataaagggttaaatgaggtcagttagtgggtaaaggacagagaaaatagatgaacagcccagcttggactgctctgatctctgccggggagaaatggttagaaggggacatggcagagttacaggattaccaatcagtgtcctaagcagtggggtagagctaacccctgaattgcctaccgtggcttaccttgcttctgaattcttgggtttggtttcatctgtatcctctgttttagccttctttttagtgccactccaaaggcaaggaccacaaagcataagcatccatttttattaaagcagaaaggtgaagacttaaaatgtgcttctgtatgtgtgcatttttaaagcaaccctttgtaagaatgagtggatttagcaaagtagatgcgattgaatcacaatggaatacatgcctcttactcggtctaaagtcccttggttctgcaaagttttttattctcttttcaaaccttatgcaattgtgacttcatctaaattattgatacagttctaagggattagtatcttctgacggcagtctgttcaatatatttgtattttttacccttgaaggaatatgggactgttagggttttaaaagaagtctgagtttttgtttgtttgtttgttttgttttgaatgacagtaaatatccattaaaaagctgtagatttgcagccttgatgattagctctctcttagactccagcaagccttactgaatttcctctggagatcaagtattgaggggcaaaatactggggtagagttgaaagcaatagagaagatttgttgacaatatcgatgattaaaaaaatgagcctttttaaacaagaaattcctgctcatacatttggcttctgagagagagaaagagagagagagagagagagagagagagagagtgtgtgtgtgtgtgtgtgtgtgtgtgtgtgaaatggggaaaaatatcaatgcatcaaaatggacaggtcattttgttgaatgtaactgaactcctaagcattcagagattaggagtattcataatttctgactggcatgcattatgctaatgtggctgtcctctgttgtatgcttctgctgagacagccactttactcctgcttaattttctccctaatggtagcagtagggacttgggtatctacagtgagcttttaccaatttaacttgctgccgctataggccgttataaattattattcttatttagcacttgaatctataatttctttctttccctcatgttctataaaatatagacttagacctaagttagctatgcttttcccttcttataaatctaaatctttcatttgcaacgagctaaagttttggatgctcaacaactgtaacccctgcttggcagactagagagttatcaaggaacttcattcattcattcattcattcacacgtgcttgccttcatacatttattcatctctgaatgcaataacatatttacagagcacctactattttttttttttaccaggcaatgctttaggtgttgaagataaaacagttaacaatatcgatttgtgggaagaagtactacctataatgtctagaaaatacatgtgagatttgaagaaaaatagcttctccatactgatattctcaaagtagtttttctccctaattatctgtacacctccactggaattcttgcgaaggttactttgccttctggattttgaaaagttgtctttgattttattactttctccctaatgtcctagggaaaatatttccttccttcctactgattattgttttagaatttgaaaattactggaaacctatatatgagtattttgttataaaaattcatgtgcatttgaacaagcacaagagtacttcctatgctggatgctagattctagaaaattttaaaaattttttaccagtctcccagttgtgatattcccagttagttaattgctttttctgtctctttctgtttcttcctgaggcccctcctccttccctgcctctctcttttttgattttttaattttattctattcttttttttttttgtagagccagaatctccctctgtcacccaggctggagtgcagtggcaccatctcggctcactgcaacctctgcctcccgggttcaagcagttctcctgcctcagcctcccgagtagctgggattacaggcacatgctgccacaacctgctaatttcttttgtattttagtagaggcggggtttcactgtgttgcccaggctggtctctaactcctgagctcaggcaatccgctcaccttggcctcccaaagtgctaggattacaggcatgagccaccgtgcccggcttccgcctctcttttttttaatgagcaatcataagttattatcaactagcatgcaggtaataattttcttatcttgttacttgtgttccaccactaataactatgagactgcaggcagtttttaacttctctgagccatggctccttccctgtagaattatgcagtacttcttgtgaaaattgagataatgtgtaaaaataaaaaaaaaaaactactagcactatatcagccaccatacttggctctcaccagcattctctgtgacccaatcgccagagctctgatacttattccagactcctggcaccatgtttctattgctgctgcccatattcccctcccccaacagatcccaatcacccttcttgcttgagcctattgctcaagctttctgttttgcctttcatacctgtcagttctaaatcttttccaggtattcttgatctctcatgtcgaccccattctgccactgacaaatctagttctgagagtgtgcttcagagaaatttagatttttgagataattttgatatatagtaatgagaatctcagccttatggcagcctttatgctttcagccaaggtggaatcctggccaaaatgattttttttttttttttactttctgccatggtgcctggaatttcttcaatatagactcatttcttagctcttcaaaggcttccaggtttttagattttccttctaagcctcaaatcctgttggtcatcaccctaaataatctatcacttatcacctgcaacatgctcaactgagataggtcttgtagaaatgaagcatagcctgaagttgagaacagaagaaacaggaggagaaaaagcaccagaagcaaatttattctcatatcccagttttgagaaaagctagcctactgtaaccctaggagtttggcggctgctaatatctaaaaatgcgctggctctgtagcttggaagaaaaagaggaacagccattctctttctgctttccaagggtaagcatggccaacctagtatcctgctgtgcaccatgaagcatcatcaggtgcagattaggaaatgaatttacattaagtttcaagaaagaatttctgacaatgtaagctgaattgacaagaacaaagttctgaaggaagaggccaaaccattactgaatgggtgatttgtggctgaactggatgaaccgatagcattccatggctagaatttgtgtcactggttcattctgtgtttcctcttattttccaaattgcattcaatcgatatggcagaaatgaatacccctatatacaattatttcaatatatcttatataagtttagaaggtgaagcctgtatatatttttcatgtaaatgtagtattcccctgcaactcagtgcaataactacccacagtgctgatacataggactctctcaatttgtcccccatgtcagaaatgctgtgcaaaatccccatagctgactgcaaaacctgccctgaagatcaaataaatgatatacatacgaattcctaataagtgctcagcaggttgtttgggcttatattagtctcctacagctgcctctcgggaagggataccccaacaaagtgtttgttaatgcttgccacctttagagaagtctcctgggatgctgcctaaacctacactgtaagcaaagtggaataacaagccctttgaaaagtcacttgggaagatgacaacccataatggtcactttggctaggatttaaaatgctttattattgtcgaattaaagcaccctggccatattgctctggatataccccgtcttagccaatctcaggtttacaatacaagaacaatctcaatctgatttgcttaatgaaaatgtatccctctactttaaaacagggagataccccagttccttaaaaatatatgttttattgcatatgctttaaaaaacctatttacttagcagtttcattttgtttgcagcctcattgcattttcttctctaattagcagatacatgcatcatctcttggagatgaagcaaatatttttcttttcctcattgggtagtttcccaggaaagaagctcacggcctcactctggctccgggtttgctgtgtgctttcccacacattctcaccctaccacacttttcctgtaatgttgctgagttcggctaatttagatcctttctctaatttaagttgctttcatttaacttggcttgagagtgtctgatacttacactcacaaacaaaactatagagttttagaactcagagcagtgcttcccattgagatttctggatgccacaatggtgcctgcaagaggaaactcatcggagtgctttcatcagcaaggaactggaattcctgaccagtgataagacaagatgactgtggcagcttcagatatatttacaatttgacattcaaaggccaaaggggaaaaaagatttttcccctgtatctcactatttttcagggaggaaatttttcagacgcttcctatcccacccaacctccagtagagttctccttaggtctcattggttaaaattggatacatagtcaccctttaatcaatcgattgcacaggaaaattgaatttccatgatgactatagcctaatcatgatgcatgtcctggggctgacccattttcctgagcacagaatttgttcagtgtaaccagtttctgagctaaaggaaaattcacttaacaggtagagaagaatagatgtgagtaggcaaccatacaatagtgtttgttttgaggacaattatgagtaggttttttagatacattgtatgtcacttgcaagtgtataagcagagtttgctatttttttgagatattttttgagtaactgtcatttctttgtgagatttaattctagaccctaattctctcactgcacagagagggagaggcatgggcaaatatatgggattcctgagggaaaatgtaggcagaggggtgtagggtggccatacaatttataacttaaagcaagacacttctgagagtcaaaaggagagctgcgaataactctaccaagtcaacaggtataaattatcctagacaaactaaactgtatggtaaagtcagatttatataagggagtatatttttaaaatgttatggggaagctaaagctaattttttaaagtttttgtaggtggagaaaatgccacctttatttaggatcataaaaaattccaaatttatatgaaactttttcatgtataattttgtttaaatcctaagtcttatgagacatgagacattgactgtaataaaaagtgcaaaaacctctcagatcttataggtattctatgataaatttggaaagtgtaatattagcatctataaaatcaaaatattgcctgttggtttctgttcactggaaaattataaatgttgatcattttgttttacacaatgcctgtgccaagtcttcctattgtcttcctcaaggcctctaacttgccaggttttagctatcagtgatattagtaagaatctttttggtcttggccgtgatggaagtctgaaaaacagcatttggcaagggaatgacccaaacagaataattttctatagacaaaatgtgtttaagttgatgaatgaaagatgtgaatgctcatgctaggagaaggggaaaagcattggtatttcccttaaagagaccataccagggtattttatttcctgcaagtggtttaattttgtacattgcttctctgctcacagaatgttctctgtctgtcataataaaggagagccttttcattgaaatagacctctgaatctgttttagcgactgcagtgacagtctgtatgtatctgaaagaatgagaggcataagacacctacacatgttcacatctagggtagtattttcaaaaaatggagttactttgaatccccgatcgtctctttcttttactcaatttcaagttaatatctaatgtaaaacttttataaatagcaaagagacttatacttctctagctttgcaatatttagtcttgctttttcttgttggcacggtgtgccctttaccaaatgatccatccaggtgattgatactaaaacatctcattgatttcaagtttacgtgtctagatattagatcctagaaatgagttgttaataaatatcagctttacatcaagagtttaacagaaacatattcctgaacaaatttccattgccttctaaaagggttatttcttggtctgcagagctgctaatctgtaggttgcattcagtctaggctatcagaatagggcaccccatgggacttgatgatagtattgtcacttagatggcaaacaaggcatgaaataccttttcatagaactaaacaccctcaaatggggacatgaaaccctgtacctctgggcacagtcaaaagttgctgtattaagtcatgtgtttccggtacttctgggctcattaacccacaggttgtttcttgctcccagggatcattctttttggtccaaaactaaataaaaaaaatagatagatcttatggattgatgtgaatgttgaaacagaagctctactactaaaatagtggttcataattaataatcccttgatctttactttgtttttttcctaaggggcagataagaaagcaagtacaaagcaaacttaacactttggcagaatgtaatgtatctgactttctaaaattctgtatgccagaataactggctgtttcccattccttgctcttgatatacagccaacagcctagccaggagccatgtcgaaaaggaggggaggcactcagggcagtggtttttcatggcctcattctttatagtacaatagttagtgtcccactattgtacttgtggaatgactctgaaattgtcacaccatttatgtgtaagaattgctacttctctttatttctccaattcaagcttaagttttcctgaagtttccccaccttctggagtggcaggaaatttagcaatttccttttctcataatggagctatatatggttccccagctagccacgacagaaaaacgtcgggatgaggatggttcttcagtcatggtggagacatattttctgtgggtcttttggctgtagtgctttgggccatgccctgtgttgtctgtttgaagtactcccactccaggtgtgttcagtgatgtgtggtcagcaacgctccctctgaccacgagacagcttctgcaaacatcttctccatcctgtgtgcggcatgaagccagagcactggactgtgctaccttgatatttgctgtgggttgaattgagtcccccaaaaggatatgtcaaagaagtcctaatcccttgttcctgtgagtgtgaccttatttggaaggaggttctttgcagatgtgattaaaatggaagctaagatggggccattcataagatggagagtattgtgggtcctcaatccaatatgactggtgttctcaaaagaaaagaaggtaaacacagagacaggcacagagaagagagtgccatgagaagatatggacacacacagggaaaaatgccacgtgaaggcagagacagaggctggagtgatgcatctacaagccaagatatgccaaggatcactggcgacatcagaagctaagagaaagtaatggaaccaattctggagctttcagagagagcattgctctgctcatgtcttgatttgagacttctggtctccagaactgtgaaaaataaatttctgttgttttaaaccacccagtttgttatggcaaaccctaggaatataatatagttcccttctgccctggtatagttccttacatctttctcacccaaagacgtgactaggatcatttaacctaattcccctctgttgagtatttgagaacataatgagaaccttcctaggactggagaagataaagaaaatgctacttcaattttatatttttcttgttatctcaccctgctaagcttacattttcaggaggcaagtaggtattgacagttcccaaggtcaaacttcctggcctcctgactttgttcactctggcatattcttcatgtagaatgtctcttagaacacaggcttttcaattattttcagtaaatgtttactgagtacctcccatgtgcaaggcaatgggaaaagatagtctagatagtcttagtcttcaatgagccaacaatccagagcgacatatagagttatgtaaatatatttaccaagtgttagaggagatcggtgaaggtgtgaatagtttttataaggcaaaaggagtggtggtgtcataaaaatctttacctctaagggttattttgaactgtgtcttcaaggatagggaagattatatcaggccaattaggcaaggacatcataggacaagggaatattatgataaattacatggtaggtttgaaaagaggggttggcatgcatgattaaattataggtggggtgaaaaaatggtagtaagtgagaaaaaggtgaattaagatcaaattgtgaaaaatttgtgagtgcctacaatgggccaggtcctcagctaattatttttaatacattgtcttgtcaggtctgagaggtaaatagttgcattacatagtggataaacctgaaaataaaatgacatgagtaatttgttcaagaaattcagatggcaggtagtcaaggccagagttcaagcttggcataagtcccaagcccctgttcttctctgtacaccttgctgcaaaagtaaatggggaatgcttcagggctcttgagaaaggtagtggcaatgggttggcccaggtggaggattcactggactttagaggttatatgcagagggctgtggcaaaacaggaagaaggtgatttgggatttaaaaagaggaatcctgttggaaaggaggggccatatgtacttaggtttgatgatcaattaattgattgatggttgaagggaataagaaaatagtgcaatgactgtaaggttctttgtttgagtaatgatttgaggatggtgccattaccccaaggtgaattagagacaggaacaacacgttcttgggaaaagataatgagttcgtttttagcttctttaagttttaagcgcctggtagaagatgtccagcagaacattctaaattttggcctggagttcgggagggaagttggggccagagatccatttgtgatttatcaacatggtaggacagccagtgacttttactgaaatacaagtctcatttctgacattccattgcccaagttcctgcaatgattacatgaagctattagggaataaaaaaagacccacgttcttaacatgactttgaggtattgtttgatctgggcctgcctgtgtctccagcctcattttgaggtatattctccttctgtatttcagttctcaaatgtatatgtgaaggtcctttctgacccagttgcccgataccagaatgccttcccaacatacatacacatctgtacacaaatgcatgtgttcacaccaacacacatgtgcaaatctgcacacatacatgcacatctgcacaagcaatagacacatgttcatatgtgtacacatgtgcacacatatgaatagattcatgtgtacacatgtgcacataaatacccatgcctgcacatgcacagatgtgcacatttcatccagtaattccaactaattcctcagattctcatctgaaacgtttttgttatcagggaagtcttctgtgacctcacagtcaaacaagtttccctgttccttctatgccatagcacttattaaattgtgttgagtatttagttttctgtcttattagaatggaagttccatgtcaataggacatgtggaaacatccacatatttcccttcctctggcactctacatggcaaaagtgggcagtagtctttgtatactacaggcacacatgaatgaattcatagacgaatggatgaatgagttaatgaggctatgagtatagatgagatatagtaaacaggtagggggaacacagggcacaggaatatcctccccactccacagtggacttccagcccactcgttctcttctatgataaagactatgactctggtaaactttgaagtctttctttctaacttcttgacctctaaaaggaagttggagttttcattaatgccgtgggtcaggctctgtggaaaatacaagaggaaaaccagacagtcctttctattagtgtctgaattatctcattaattgataccaatgttgaggtaatcaacttctcattaagacttctcattagatggctatttctctcttttaccttctggcagggagtttagagcatttaatcatcactttcctatttatcacttaaaggaaattcacctttcccccagttatcacatcctaatttttctggggtttgtaaaattttaatcttatgatagggcttttttttttttcctttgggtaagcctttagcaattgctatatccaacatttcaaagaagctgtgttttagtggactgaggaatttactcatcaagattttattttgccaacactcattcattgtatggaataataattcggcagttttcatgatatttcatgtctgggcccagttgctcctttggccagaatacactgagactgaaatagcagtttatttcttgcttaagtaatatggttttcttgtgaccaaaagcataggaacattttatttcaccccagacagacacttctcaggtttgtgattttaattataacaaaaactggatgaaaagaatgacttgatcatggcatagatatgccaccatcagaaaaaataatccacagacagatcaatagtatcgttttcatttatgaatactattttaatgtcttatgcacaggtattatctctacaaaccatctcaagccaaaaaaagaacttcttcagtcacacgtgaattgtctacctttccataaaaatgttctgtcaagagctttctgcataaaagagtaaaaattttcaaataacttgtaattttttattttacacaaaatatctgggctaaagaaagtacattaaagcaacttgcatctcaaaacaatacatttctctggttgaagttttagtgaaaatcgatttattcctcctctgagttttacccaatgggtaaagttgtctaaatatgggattccttagaatccatcctccttcccaagcatttccccatgtttccttccacccccaaattcttaccccatttcaggcagagctgagcaaacataagccttctctgaagtattgagggaaagtctgctaaacggctaaactacttaaggagctaacagaaaaggttgtatcagagaaacagtggagaaacacaggtttctaattatatctggcactggagagaatgtcaaaggtactgggcctggggcaggttcacaagagtgaaagtaagagatttaaaataggttctcaactcctgataaaaacacgaatatttatttatttagtctagcttttctttcttctcttatcgttatgattattattactactactacttttctgacttttcttttcctaacctactagtgtttaaacctcccgaagacagaggtcagttctgctttgatcaccactatatactcaacaattaacatatattgggtgccgagtaactgcagagagactgttctctatagttttaaacgttttgaattaatctctccctattctgtcttctagcctcttttcttccccttcagtatggtagcatagactgtcttttccatgttcttgaggtcagtacatttcaggattataatctctcagatagtataatatcagctcataatcttccaacaaaatggccttggatgacggtaggtagcaggatgaagagagtctgcttggactgaaacccaattcaagagttggaacccatgttggcagtatagatgttttatcttgataatatttctttctttcaatgaaatgaaaaagaataagccagaagaactgctttacccaagcccagattcttcaaatgtgctttctcttgattcctgtaggaagacactgaacagaattctgcatttctaagaataaaaaagaaaaaaaagttaagtgcattaaaaaaagagcaaaacaaagaaaaaattaccaaactaataaaatagtacagttggactacaccaaagggaattttcatttgattctacataattacttcaccttactctcctctggacacatcatataatttaaatgaacaaattttaaaaagtatctttctaaaatagccattaatttggggactattatataaattttaccataattgattgtgtttagtacttccctatacagaacattcttttaataagatgactgaaaggcttataaaattcaccaaatagaatctctttatgcatgataactggtggtttcaagcaaaagtatataggagtgaatatttaaaatgaaaacaaccagttaatgaagtatattttgctatttatttccaaataaaaacaagccttggtgtctaagacttagttaactaatttgtgattttttaaaaaaagtatagatgaaaaggtagctaggtagaaatagaaatagcttagaaggctagatacacagatggcttccttatgcagatttaggaagcaaagtaaatttatactaactaaagaatatgaaaggtaaatgacaagctctatgtatcatgactgactatgctaattatagcttataatattctgctggacctaagagccctcctcagctaaaaaacaccataaagttcatttaatacaaccttcatattttactgatgagggtactcaggacttgagagagtagagagcagacacacctacttcctaaagccagtagtgtggtcttctttgaggacattgaagttgagacatgaaggctgagaagtggctgatcatgtgatgagtatgtgaactttgagggggattaatgcttggcagagggtgaaagtggcatcaacaaaattggtaaggcaactggccagactgccagcatcgaaggccatagtaagcaattaagatataattccaaaagctatggaaacattggtgggttttaactgagggaatgatgtaatctgatttatattttgaaagggtactctggttgctttatgaaacacggattgtaagggagggagctagagaggaaaagggaagattacttagaaggcttttaatagggaggttaggagaaagtggaaatattggatgtattttttgggtagtgctaacaacatttgccagtggttcttggatagggaggtagagagagaattaatagaaagggaggaattgagggcatctactttctttttgacttgaaaggctgagtagatgatggtagtgtttgccgagatggagaagactggggtagaaacagaaatatgttttaggttagtatttatattttatttgacttgtattgcctaatccaagtaaaaaaagattaatcctcacctagagccaaatatatattttattttagtcaggaccaatataaatgtgccaaaggaaatgattaaatatggttagtatctattccctatatagtaaacaaaataataatttaattttcacagtggtcagaggccatcttaggaactatatgtgaaggtagaatttgtgaacagggaaggagtagtagctacgtgtcactgtgttttatatgataagtgtgtatatgtatattaatgtgtatggggacagaatgtccctatgaacttaggaaagtgaattcccttgggttagaagacaatgtaaggtagccctgtattttcaagggtgatttttagaaaatcctaatcatttttcctgaagtactttgtgtgaatactcatgaaattatagacagaccaattctcttttgcttagaatgaaaatcatctgttatgccttcatcatcagtgaatgttttgggaacttcaagactatatccatcatccagagttttggcacacacacaaaaacatcgtttgtgctagccttggactttgctacctgacaaatatagtaaagcactcaatggagaaccatacattagctggatatgtaggacatcaaacttaaatgttatgtaatagctatgaagggcacagtttctcttatagttttaaacattaaggagtactgtctgaaacttgaaacttaaaattaaaactagtaaatggcactcttaaactgtccacatccatggtaatcacagttcaatacagcatacttttttgaatgccaccaaatggaataaaatttttcctaaaatgaatgaactctctgcttctagtttaatatagcataacaatacatacatactcaaaaataacttgaagggagaaagaaatttttcctttctagaagaaggggaggcaatttgtgatgcacagtagagggaggagaaatgagagaattaaattttttacgctgctgtcagaaaactgggagaaagcttaaagagaactaatggggagatatcattagagaaaacaaaaactcaaactaaatctctaaatggttgagttggacagcattggagcactcatttcccttgtaatcactctaaaaaataggctactgtctacgatagataatatgacaatttctgttcaggtagagcgtactatttcaatgtccaaagacgttattcttttaagtaatagatgttcagtgaatgttacattggtttttaatggactttccccagttggttgcttatttcctgatatttttatgttgtgtattcagaagagtgtggactggcttcagctaatcctcataaattgtctatccattagcagatttaaactggacttggggctgccatgtttgtggattcagaagtagccttatcaatcaattagccttatcttcttgtaagtttgatgattcactaatcaaacttagaagaactagataattctatttctaatgtttttatttgttgtattctgtagacaaatatttcagaataattttctccaaaagcctgagtaaacaaaggaaaaattttcagcaaaggcagaaaagtttaaaaacttggcaaggaataactcagtatgacaatattggtgaaccttccttttattgtcatacatgaaggaaatgaatatttaaacagattttttccaggcttgtggggatttggcaaccccaggctctgtctgtgataagatcttactggcctgagagtcctgcctagattcattaagaatttctttctgtctctctctttcatacattatatatttttcaggtgaccattttagcaattgtacaagctatttttaatattaaattatgtagcctcagctgcttataaggagagtttaaggagaatattagacatatttataagtatcgtttgtcatgcaagggctaattaaccttgaaaataagcattggcctaccttcccagtacctacaataaagcacactaggccaaatctctatgaggcggtagttttctatttaaaaaataataataataaggtataaaaagttactaacaaccatgcacttgttcccctcaacttaaaagttaaaaaaattagaaaagaaaggcaacatggctaataagatatgtaaattaaaaatttcctactcttctttcatttgtcactatgttttgtttgtaggtagattcaaagaataccatacttgtcatagacaattatttgtattatgttatattattttaatttactcagatctgttgcaatgggaaaaaaattcaggaaaaacaataactatcaataataaatataaaagcatgcattttcgtaacagaaaaactgaagagagttaagacacattgtacgttccaagagggttggaagaacacacataagaaactacaaagagcatctgcgagacggcttgtgtgaactgatggtgtgggccaaccttcaaattgcactgtcctctacaggtcctttctagatccattcctttatcatctcaaatgatgtgcagtaataatgctgcttgcagaatgaactgaattatcatctaccaactaggatgtgagttccatgaggacaccactgtcacttttgtctttttattcattgctttgttccaaaagcttagaatggtgcataccatgtagtagaaacttaataaatacttgctaaatagatggatgcatttggcatttgctgttttgatgacaagtaatatggtctatagtttagttaatatgatgcattaaggtcaactgcctggtttggatcattgttctatagttatgtaaatgttaacatgaggaaaagatgaataaagggtcctgggaattcactatttttgcaagtcttctttcaatgagaaattattattttatttatttatttatttatttatttatttatttttttattttttgagacggagtctcgatcagtcgcccaggctggagtgcagtggtgtgatcttggctcactgcaaactgcacctcccaggttcatgccattctcctgcctcagcctcccaaatagctgggactacaggcacccgccaccacacctggctaattttttgttcttttagtagagatggggtttcaccgtgttagccaggatggtcttgatctcctgacctcgtggtctgcccgcctcggcctcccaaagtgctgggagtacaggcgtgagccactgtgcctagccagaaattattttttaaaaagttttttgggaaattgagaatggagaagggaaaaaggagtaaggacatgaaaggctgaggaccattgactctggaatagtgcaggaagacaaggtatgggcaagaaagagctgatgtgagtgctggcaatttgcctctggaaggccaaatagcatttgactactactcaatctttttggaaaatcttgaattaaaatctcaaatactcactgtccactgtgaaatttcaatttcatcagtattcttttacctgtgctgcttttatctatctgctgatggctgctagtgctagctgcacaaagccctgagttctagaccttctctccctgcttaaagtttattaacaagggctgggcacagtggctcatgcctgtaatcccagcaccttgggaggccgaggcgggcagatcacctgaggtcaggagttcaagaccagcctggtcaacatggtgaaaccccatctctactaaaaatacaaaaattagccaggcgtggtgatgcatgatatagtcccagctaatcgggagactgaggcaggagaatctcttaaacctgggaggtggacgttgcagtgagctgagatcgcaccgtggcactccagcctgggtgatagagagactccatctcaaaaaaaaaaaaaaaagtttattagcaagtataaatgtatcagaacttaacaggtcaatttcttgtattattgtgagactaaaaaaaattgggaaaaaaggaaagctttgaagagaaaaaaatgggtagccatcagaatcattttgtgaaaggaacaaatactaataagttaatctattgttctcaacaacctgttatccataataggaaaggaatccagtatgtgcatgactaagttaactactcaaaactttcaaaaccagaagccaaaagaagttatagtttattttaagcaatatccacaaaacctaatatagtccacttctgagtaatcatttaattatggtattctatcattttatttttaaaaaatatgctgagtacataaacatgactaaaatatcaacacattctttcttcctacacataactattaatcttaaatgttccaagagaagatgtttaaaaagtaaccctttgcagaactagcccttctctctggagctgtaggcctctcttcttcccagccccctccttttcttttcttttatcttactcgtcaccttgcagtcatgagtattgtagcatgtaggagtggactgctgagagaagggaagaaggatgcattttgcattcacttgtacatcagccttgaagcctggctggcggcaatattgtggacaatagatctttcaaacaaatagacccttgtctgttccttccttctgtaattgttggcagagttctttgttatgtgtctggtttcttgaaactttgaatgaataaactaggacacgggattaatgtaaagaactggcatctttgctgacttattcaacagactgtgtgtacatagaaaagagaaataagcactttcagaagtgttgtctgcacatgcctgggattttacaaaatttaaacaatgtgaaatgcagtaccttgaaaaaagccaggctagtctctggactctgtagtttactttctaaataaaaaatatcctattgaccataagcaaatgaacaattcacctgttagcatatggaccaaatataggccaagatatgtagtggtagagttacaagtaaattttttgatgtgaagtgtcatagaatttacagccaaatgaagtgagtacctctttgtagcagggtaatgatgaaaaagattaggcaaagtttaaagttgagacgcagttttcctacctggagagaatggacattgttacctaaaattcacattgtacaatggagtgatacatgagttgttcacagtagaccgacctttctcagcctcagctctgttgacattttcaaataacaacttgctgttagggactgttctgcacattgtaggatgtttagcaccattcctatcttatgcctgctagataccagcagcactccccttccaattgtgcaaataaaaaatgtctccagacattgccaaatgtcctctggaagtcaaaaaagcattcctggttgagaatcattgtactagaccaaggaatggatcatattgaccagaaggaagttgtatattattaaaaaaaattatccaactccagaagaagtatactggggcagtctaacttggggaccttttgaatgtctccaccatgggaacaaaggctaagtaaagcagtggcccattgctcagtccaacagcactcctccatcaattaccccctcttgactttttgtgtctttagtctcttaatcggcctcgacttcttttccttgacctttaaattgtctcctttatcctaaagcaaatcaaaattactcctgataatgcaaaggtataaaattactatgatgtcttcacatcactactaacttttttgaaaagtagtcttcattctctacctctacttcctcactgtctactttctggaatacatcccagtttggttttttccccctatgtcactacttaaagtggctgcccaaatgctacaatccaacttctcaatgatcacattaactgaactttttgtgtacttatctttgacttccatgcaacttttgatactcttaatcaatggttctgaaactttttttgtgcatcaggatcactggtgagttattaatagttaaaatacagatttctgaattcaacacccagagttcctaattccgtcgggctaggatgtagactgaggatttgcatttctaacgagttcccagatactgtccacgctgctagtctgggggatcacaaatcaagagccatgccttgattattctcttcttgagtgcttcagttgacttttacaataccatagtttcctgatcttgacgcttaatgacatttgtagtcacattttctggtttcttctaccctttttctctaaaacagggcaatgttgcccctcagagaacattggtcaatgtctggagatgtgtttagttatcacaaataactaggaggaggggaagaaggaagagaagagggtccactgctactgatgtctagtgggtagaggccaggggtgctgctaaacatcctacagggcacaggacagtattattcacaggacaaagtattattcgtctcaatatgtgaatactgccaagatagagaaacactgctctggatgcaggcattctctccaagtagatatatattctttttttttgttatgagacagggtctcactctgtcacctaggctagagtgcagtagcacaatcatagctcactgcagcctccaggaatcgagacctgttgatattttagtcatgtttatgtactcagcatatttttttaaaataatatgataaaataccataattaaatgattactcaaaagtggtctactatattaggttttgtgtatattacttaaaataaactatcacttctttaggcttctggttttgaaagttttgagtagttaacttagtcatgcacatactggattcctttcctattatggataacaggttgttgagaacaacctggtcaatattttggagagatgaggacttgctatgttgctcaggctggaatcaaactcctgggctcaagcgatgctcccacctcagtctcccaaagtgctgagattacaggtgtgagccatggcacccagcaaagaatggcctttttatcttctcttcagtctatacctctctcttgtcgacctcagacatgcccagcacttcaactctcacacgtctctggaaatgactcccagaggtattatctttaaatacgacattactcttgggtctggcctgaatttgcaactgcctgataaatataagcttaatgagccaccggcatcttaagtttaagatgcgcaaactaggccaggcacggtggctcacgcctgtaatcccagcactttgggaggccacagagggcgaatcacctgaggtcaggattttgagaccagcctgaccaacatggagaaaccccgtctctactaaaaatacaaaattagacagacgtggtggcacatgcctgtaatcccagctacttgggaggctgaggcaggagaatcgcttgaacctgggagacggaggctgcggtcagccgagattgcgccattgcactccagcctgggcaagaagaacgaaactctgtctcaaaaaaaaaaaaaaaagaaaaaaagcccaaactaaacatatccttccagtaagagaatcctttattgccagtaatggtaattatttgataaggtgtgtctctacccccttttgaccttcataacttgtaaaaatggtacaagatgattcttttaagaaaagtataaaatcacatgtatggttcagaaataccactctggcaggaatttgaggaggtgacagatattcaagaaaattgaaagagaaactttccattccatgtgagattatctaacttttgattggccagggagaaatgtgtcttattattccaagtgaaagtaaatgtatctgcctgcctagatctcagcctagtattgattggagaaaatactgatctgatgctttatgcttcgagaaagaaagcatattgagtatatgatcttctcacacatatgatcagtcttttcattagatttgttttaccgtgatgtattttgttcctcaatagaatgccatgtatatgattgttactggtactcatagtaaatctaataatatccaccattttcagagcacttactaagtgtcagaacaagtgctttgcatgccatcttatgtatactaagcctatggggtagattttattattgtacccattatgcacccatggaagctaaagactagagagaatgagggatacacgcaaggtcacctagatcacaactggtataattaggatttgaagacaggctgtttgacacctaagctgatacttccaaagactattccaatagcacaaaattcaattgctgtggggacatggttctcagaacctggtcttcttgaatcactagaccgatcctcctcagaatttaagacctgggtggaaagggaaagaccatccagctcaccccatgtgcctctcaggaatggtgggggttgtcctccattactgaaagaagcagtacagccggctaatggatggagacacaggggagagattttctttgtgggagttcattacagaggcatctgcagacctctaactctctcctgcatgccctttctctttcatagcttccatctctaagctgtaatggatgcaaaattactgcagcattttgttctgccgggctgaccccattacgcatacaccacagtcataaagctctggcttagttactgtttgcatgttcaagactactctgaggcagggaggtgtgaagtttggctacattttcaaacagagtggatgccttcttcattttaaaaacaaggaatccagcctcctttcagagtgaatattgttttgattactgctggactaatccatacttatttaccccttaatgatgatgtttctctggtgtgtgaagggtctttaaataaatgttagggcagtgatgccaggaagtcatcatttcacatgcattagttgcagaagtttgggagacttcatttccaccccaacatcctgttgtcttgataatattttattaagacatagcaaaagatatagcagggtcgttagataatggttaataaaatataagagtttggaaaggtagtgattctcaaaagttattctcagtcttccttcttctccatgccttgtcaaagatttctgcaactttcatctcaccacatctggtgagaatacttatcagagaaagtgagcaaactggttttggtaataattgacatacctttatctactaggagattctgattttaattcattcagtaaaaaaatattctgtttgttctatgcacatttctaacacttgagacatattcaagaataagacacacatagtccttgtcctacagcttacattctggtaatatttgtcagaaagcagtcacatgattatgaaaaggttacccaaatttctgtatattctatagtttatcctatatcttcttccactatttcacacatttcataaaagatctcaacatataaatattgcttttagcctgtgatattgtctccatggagggaaggactcagatggaaataaggtatcacagaagggtgcagagtgccttttcttttaaagtaattgcaaaaataggagttatattggttatcagaacatgtttgtatttcattattaagctggtaaaaagaaccatggatatatggacatgttctggatcctagatacttaatagaaatgatcactagctgtccctaaaggatttttattatacttcctaaaagcatggactatctcttctgaggtatgccccccaaaatgtcagtagcaataaatttgtaagaacatttttaaggcagcacagacaagtgtgatcggtagaagtcatggtgagtgggagtgaggaagggctagtagcaaacaagaaaaagaaaagaaaaaaaagcattttcagtctttggcagcacttctgtctcttccagcatttgtcagaatccagttattaacctgtcagcctcagacagattgaaggagacaccacctttcaaggtgagcccttaagaaaagaaaaataagaaacagtcattgttggggttgacagagacatgatcccaccaaggcctgggctatgcttggagaggaaatgatactcaagcctgagtgtgtgcttaggggtcaagagattaggcttaggggagtagggatatggaagtagtgatagcagtgaataaggaaagctatctgtttgaatttgcttgtgcaaagaggcagaaccatttcaaagatacagggtgcagattttagtgaagatgttagagctgacccctgctgggactgtggcatttcagtagaggaatggtgaatcccttcccagtggggaacacacatcatccacatacatgagggaaaaaaaaaaaaaaaaggaatgactctttttatcaacaaaagcatgcccttatctatgattgtggtgtcattttcttttaacaaacaaggatagtttttaaccttagtttgctcacaaaagcttcagcaaaaaacaagggacatcaaatatttctggatttccatgttctgggcacatagtagggctgtgccttctgaaacttcctgtatagaatggagccacatgatcatttgcaatcaatgagctgtgaaggggaatggcatgtgttccttacaggccaagcatttaagtgttgatgtgagagtcctcagagcacttttttttcttttgcctttgtcatggtgccatggctaccagcaactttcagacagtggccattgcatcaacctcaaccctgaagtgaggaaccgtggcaacatgcaggcaagcctcaagcccgcccacagtagacaaacatatacctttattgttataaaccattttggacttgtttgttactgcagcataatctggctcttatagtggacacatttggttagatacaagtgtaagaagttttattttccttgatgaatagtgggaaagtgtgtatataatattgtaaaccttttttagcacccaaattaacacccctatgtacccaaagtcctatatctgggctgcagtatccccaaagacattttgtttgttttattttagtcctgtaagaattaaagtcaactttttaaaaaaatgcagtgctaagagagacacgacaaaattgagacaatttattagcggattctttcttttctgaggggtctttttgcatgtaggagcagtcattaccatctgtaaggtgtctaaagctcaatttatttaaatcatatatctgaagaccaaaacttttaaaacccaaattttgtttttaaaactttataaaagatggtaaattcctcttcaaaatttaaacttcaactccaaatttagtatgggtgatttctcataacatttcaaataccttttaaaatacataccttttatacttaaacttaaatctatagtaaattatgagtttggttcattttatcattatatctctatgtgtttttgtattttctgaggattatattagattaataccaatgaatctattaaatagttgttgcttctctaatatgaatcaaatctaagctgctgatcaggctgaggtgttgtttttaaatcattaaatttatttattgtgtcaagacataattgcctttcccaaaaagtctaaatgttttcctataatttgctgtctctccacaagtaatacatttttaaaagccatacttggtgagattatatgatccttgttcattattaaatattgccttttatttaacactattaaaaagatatattcttataaacagcttatttaaagtcaggaaccatctggaagtttcatctcccaaaagatgagatgaatccaaatagttctttctctttctagcatgtcaaactaatgtgtcatcctagaatgcatctctgagccccatttcactaggttattaggtgtgaagcccagatctagaccaagcctgtctgctcttggtaagcctctttctttttttcattttttctaatactgtttgatgtatttcctgttatttttatttactgttttctacttatccaatagtaacatggccatgcctatactttattactttgtaaacaagtacctaagtaacagctaaactaaaacatacatgttcatatattttagcattcccctaatcattgaaatcaataacaattcaatatactctattgtattcatatttattttatattaccactatgttttatgtaataatattctgtatattaacttttctgagcatcactatgactttttcacaaacttagcttgttttaatcaacagtaaaaatgaagagtgatgttgttgttagcaatcttatttagtgttcaaattattatcaaatggccagcgagatctcttttaaatgggctccttattctttcagcactttatttgatatttgtggccacatacttgtattttgcaataaaaaaaaatttagattctttgcaattattttcttccgctaagcagaaaatcaacaaaattccagagaaccttgtgcaaatgagtgttgattgtggccatggtgcacctgcactttaagtaataacaaagctgaaaaatatatttcttttagaggtcatgagttcacactgagaagtgtgaactcctcatgagttccatgagaagggcataactttaggtaatttcttgtaagctcattgccactatgtaaaccagcttatgattcttatctagttggtcagtatactataaatatcagtgaatattcagaatagaagctgatagaaaaatcaaaccatagaaaagcagggagagtgtgagaatatattcaccatgtgtacatatatgcccctaaacaaaagcctgaaagtatctactctaaaattgatttatcctcctcactatcctttttaaattttttatattattcaccttttcttctttgaacatattttatttttgtaatgagaatgcaaagatgttaaattttttaaataactaaagaaaccgttccagcaggaaatagcactatgtgttgttcaacatacatagtgaatcttgcatacacagcatattaataaaatctcaaaaattgcttactctttacaagtaggagatattttgctttttgtgtccatactttccctttagaatgaggaggattctaagtaatcttattgtatcacatttctacttcattgcattgctctctaggggggaaattaacagcagaagacttgtcacttgagttctattcatgaccactctactctgagcattacagatggaatgcagcaaagaggagatacaattctaggggaatatgggcccatagatctttcaaaacaaagaagaaaagctttctcacaattgctatagcaaataatgctttccactgctttagagtcatcactgtaagaacatttgatccacaagtgaagaacaggactatattccatgtggcttttcaaggcgactgagagcacctgctccctagaatccttcagccacattgatatgtgtgtcataaaactgtgagatcatgatcccattgatgtgatatgaatcaagaaagccatatgctctttgctggtataaatgatagctgcatgagggcttaccaataagtgaggaatgaaatttgaattttggaaagaagtttgtagctacatgaataccttgcagcctctcttttcaatagtctcaacatttttactgccatgcgatttcttctatagctccatttatatccaacttaaatttcactctaaacattttcattttttattttttattagacaattctcttttgattatctcgttttataaaatggcacatgggtttatcacttggagacaaagaagcaataccctatatgctgtgtgtgaactgagcaatacgttcagtgaccattaactgacagacttcacaagaactcatgagattggtcaatgatcacgaagtgcatctgtaattcatgtagctaatgtggactgaagaactaagagcaaaacatacacttcgtgcaaatacccacagttaatatagcatagaaacagaaatttaagctctgttgttagaaggctggagttatgaaccaaaccatagtaactaaaattcatgcatattacaaccaagcaaaatgcagactacctgtgtgtatatgtacatttagtatttttttgtttgtttgtttttaactttgtagcttcagcacaccatgccacaaactttgtgccttataataccttggctgaatatcttctcagaggatgatcattcacttttacctttgtttgccaacttattccactgcggctctttttgtcttgcaatgcattctgtgtactggtgaagaagttttgaccacgaatagctgacaaatatgtgcaggtggtcatgcacagaagcagaaagaaaattcctctgtggttgttaacgtgaaggttttccaggggcttggggcactggttaaggaaacagattaatgagcagcaaacaggaattgatgggagtcctctgacattttgaggatatccctacacatcactgcaggctgagggaagcttggctgaaagaaactggccagaggcatgttctgactttggctgacttggaaagaatggcagtgctattaacaatgtacacatagtgggagaatttcctctcagtggaatgatgctttaatggtcccatataatgctaatgccattagcactctcatttccagatactacatgggatacataagtagaagagttaggaatcgttttctgaaaagacattctaatattatttggatattaaataaaaataaatacctctgttaagatattcagacccagtattagtgtaagtgggtacagtagaaagaggccttaacttggaatatgtagtgattaggtttaactcacagccctgccaattattagctgtgtttgcccattcatttattcatacatttgtatacattcttttattttcttacaaatctttaccaagtgcctattacgtgccagatcccacaccaggctttacgcagtcagggtcaaatcacttcacctcttcaagtttctcacctgtaaaattctgagacttttttgaaatctattttttaaaaaatacatacttgattcaaacagcagctttataatttgaaaacctctattttactcctgtttttctttggaggccaaaggtgactctaaataatttcatgaaagtaatgaaaatataatctttagtgattaacttcagaattaagagagtaaaaagtatttttcaattcatcttcagcttatgccatcacctcagcaagaacaatgagtgtgcaacaattcactgttttgtaggatgctaattagagggtagactcctcatggaaaaagcccaagcctctggttgactcctgtccatccagatggagctacaatgaaatgattttctatggctgtgtgtgcgtgtgtgtgtgcgcgcgtgtgtgcgtgcgcgcacacacacacacaagcctgggaaggaagagccccccactctgtccattattcaactcaatgtttactgtcaagatgagttttccaatttccattgtttcccctaaattgagtctctcacatagagtttagagctggtatgtctgctaggaaatagctatataataaaacatccatataatagcactataattcatccagttattcattccttccctgaaaaataggacctaaaatgcatcattgtgtgtaggtttcaattaaattcagaggacagttattgactgactactgcatgcaagctggctggactgagagtattgagatggataagaaactgtcccctctcaaggagcttaaaatctagaggaaagagaggtgtataaaatatataattgaaaatgtttgctgtaatttctaagagaacacacctggggatgtgaaaatggacagaagggaggatttagctctatcttggaggctgggatataagtcagggaaagcatttcagtggagattacgcttaaagtgggagtactgtatacatgaataagcagagcaggccaggtaagcaaagttgtggttggggaaagatgcattccagacagccagaatgttttgcctcattggaagattgtttttctcacccttagcaccctctgcttattcgtctctttgtttttaaccatttctaagttgtatcttaagactctaatcaatgtaatgggatggctgtatccctccccactccatcccatatcacaccaccgaatgagcaacaaatcttggcgtctgaaaaatgtagcacctgacgccaatcaaaacttctgctcacagctctaatgtaggtctgggggcttttctgtgttacttgaaactagtattgattgcatcagcgctcaatataatgccccagtagtcatccttgctgctttagctgaggaacaaaaggtaaaatcaagctaaatgaaatgaggtaaatgtaggaccagaaaaaccagaagtcttcattgcctgctctcaggcatcatcaaaacaaaaggctctctggctggcaaggtcagtaagggagacgagagaggataggaatactcagagacaatatgttgccctgctaagagcaggtcatggtccttaatgtaagccatgtcatttgcttacagtctttattatttaatctctgacagatggaaattggttgagaacaggtaatggtacagagtcttctgtgtgtgcttgcatgccagtgagatctactgggagaattaacttctactctcccagcacaatcggtggtcattttgagtgaccacatcatttatctccaaaccaggacaccttggagaacacaagaggatactgttaaataaacgtgagtgtataataaacacacagtgggacttccccaggcaaacagggactcttaggggatgtatgatcaccttaacatgttttctgtctggagggaaatttccaaggagaaatataagtaatacctggaacatgactctagaggtaggctaagactgcagggtattaatcaatgtataagtttataagtttataagcatgtgaaaacttcaaatttcagcaatgattctctaaattttttgctgagacagataaaatagctgtttttttttctcacacagagtacattctcataggaatatctgaattacatgcagttcctagaaagcaagctataattacattattcaagaaaacactgcagttcaggctaatgtttttgtatatttgttttgtacattttgtacatgtttttgtaatgtgtttatacatatgtacatagaaggctttacatttggtgatcagcatttaaattatttacgtacttaaactattacaaatacactacttggcacactctttccccagatcttcatctggctgtcccttttcatcttctagatctcgactcaacatctccttcttaggccatttctgaccactataactgatccctgtcacgttctatcataatgtccttttgccattttcttagcacttattagtgtataaaattatcttctgtatttagctgtgagctttcctcactagaatgaaagaaattatggacaatagttccacctaccttgttcagtagtacacctccagcactttgaaacctgtggggaaacaacaggtactcaacagatagttgttcattggatggactgatgggaaataggccatcttgtctttattgaacaacaacttttgcaggaagcattctcctcccttcatgatttttgtgcataggtaagcacctgcttagacaactccagttcctgctctcacacttcaccactggattgttgcaatgcagtcttaaatagccctcgaatatggactcaaccacatcttgcaacaagattgtcatcagcacccctttcactatgcttggcctctatatactttactcttagccttctcctgaattagtcttagcccagtaacatcttgtgctgatgtcagtcttctggttgaccaagtaaacgtattttttcatttcctctttttttgctcgtctttttcatctctcgctgatgattgtcaactgcaatgacaccgtacttttatacactgcatgatgtatacttactcagaatttttcttattgccaaataaattatttcatacgcttatgcaactcctttcgttaaaagcatgttttctactttgttctcattattaacagaactattttttcagttatcttactcattgcttttgcactgattggacatcacagcattcaaaatgttcacaaagtacctaaaaaattgaacacagaggcctctgtggttagggtgactgaaaaacttaactggatttttaagtcagtctaattttaattaacttaaactttttttttccatagttcagagcatttatttatttttttaaatttattattattatactttaagttttagggtacatgtgcacaatgtgcaggttagttacctatgtatacatgtgccgtgctggtgcgctgcacccactaactcgtcatctagcattaggtatatctcccaatgctatccctcccccccgccccaccccacgaccgtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtgttccatggtctatgtgtgccacattttcttaatccagtctatcattgttggacatttgggttggttccaagtctttgctgttgtgaataatgccgcaataaacatacgtgtgcatgtgtctttatagcagcatgatttatagtcctttgggtatatacccagtaatgggatggctgggtcaaatggtatttctagttctggatccctgaggaatcgccacactgacttccacaatggttgaactagtttacagtcccaccaacagtgtaaaagtcttcctatttctccacatcctctccagcacctgttgtttcctgactttttaatgattgccattgtaactggtgtgagatggtatctcattgtggttttgatttgcatttctctgttggccagtgatggtgagcattttttcatgtgttttttggctgcataaatgtcttcttttgagaagtgtctgttcatgtcctttgcccactttttgatgggattgtttgtttttttcttgtaaatttgtttgagttcattgtagattctggatattagccctttgtcagatgagtaggttgcgaaaattttctcccattttgtgggttgcccgttcactctgatcgtagtttcttttgctgtgcagaagctctttagtttaattagatcccatttgtcaattttggctttggttgccattgcttttggtgttttagacatgaagtcctcacccatgcctatgtcctgaatggtaatacctaggttttcttctagggtttttatggttttagttctaacgtttaagtctttaatccatcttgaattgatttttgtataaggtgtaaggaagggatccagtttcagctttctacatatggctagccagttttcccagcaccatttattaaacagggaatcctttccccattgcttgtttttctcaggtttgtcaaaaatcagatagttgtagatatgcggcgttatttctgagggctctgttctgttccattgatctataactctgttttggtaccagtaccatgctgttttggttaccttaggcttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagctttatggggatggtattgaatctgtaaattaccttgggcagtatggccattttcacgatattgattcttcctaccgatgagcatggaatgttcttccatttgtttgtatcctcttttatttccttgagcagtggtttgtagttctccttgaagaggtccttcacatcccttgtaagttggattcctaagtattttattctctttgaagcaattgtgaatgggagttcactcatgatttggctctctgtttgtctgttgttggtgtataagaatgcttgtgatttttgtacattgattttgtatcctgagactttgctgaagttgcttatcagctgaaggagattttgggctgagacagtggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatattgaaccagccttgtatcccagggatgaagcccacttgatcatggtggataagctttttgatgtgctgctggattcggtttgccagtattttattgaggatttttgcatcaatgttcatcaaggatattggtctaaaattctcttttttgattgtgtctctgctgggctttggtatcaggatgatgctggcctcataaaatgagttagggaggattccctctttttctattgattggaatagtttcagaaggaatggtaccaattcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcatagaagtgtttgtagtattctctgatggtagtttgtatttctgtgggatcggtggagatatcccctttatcattttttattgcgtctatttgattcttctctctttttttctttattaatcttgctagcagtctatcaattttgttgatcctttcaaaaaacgagctcctggattcattaattttttggagggttttttgtgtctctatttccttcagttctgctctgattttagttatttcttgccttcttctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatgtttatttctgccttcatttcgttatgtacccagtagtcattcaggagcagattgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtctattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatttttgttggtttaaagtctgttttatcagagactaggattgcaacccctgcctttttttgttttccatttgcttggtagatcttccttcatcctattattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctcgttattttgttcattagttgatgcagtttcttcctagtctcgatggtctttacattttggcatgattttgcagcggctggtatcagttgttcctttccatgtttagcacttccttcaggagctcttttagggcaggcctggtggtgacaaaatctctcagcatttgcttgtctgtaacgtattttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccctttgtgggtaacccgacctttctctctggctgcccttaacattttttccatcatttcaactttggtgaatctgacaattatgtgtcttggagttgctcttctcgaggagtacctttgtggcgttctctgtatttcctgaatctgaacgttgggctgccttgctagattggggaagttttcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcgcttcatttcattcacttcatcttccatcgctgataccctttcttccagttgatcgcatcggctcctgaggcttctgcattcttcacgtagttctcgagccttggctttcagctccatcagctcctttaaaaacttctctgtaatggttattctagttatatattcttctaaactttttcaaggttttcaacttctttgcctttggtttgaatttcctcccgtagctcagagtaatttgatcgtctgaagccttcttctctcagctcatcaaagtcattctccgtccagctttgttccattgctggtgaggaactgcgttcctttggaggaggagaggtgctctgctttttagagtttccagtttttctgctctgttttttccccatctttgtggttttatctacttttggtctttgatgatggtgatgtacagatgggtttttcgtgtggatgtcctttctgtttgttagttttccttctaacagacaggaccctcagctgcaggtctgttggagtacccagccgtgtgaggtgtcagtctgcccctgctggggggtgcctcccagttaggctgcttgggggtcaggggtcagggacccatttgagggggcagtctgcccgttttcagatctctagctgcatgctgggagaaccactgctctcttccaagctgtcagacagggtcatttaagtctgcagaggttactgctgtctttttgtttgtctgtgccctgcccccagaggtggagcctacagaggcaggcaggcctccttgagctgtggttggctccacccagttggagcttcctggctgctttgtttacctaagcaagcctgggcaatggcgagtgcccctcccccagccttgctgccaccttgcagtttgatctcagactgctgtgctagcaatcagagagactccgtgggcgtaggaccctctgagccaggtgtgggatataatctcctggtgtgccgttttttaagcctgtcggaaaaacacagtattcgggtgggagtgacccgattttccaggtgctgtctgtcacccctttctttgactaggaaagggaactccctgaccccttgcgcttcccgagtgaggcaatgcctcgccctgcttcagctcacgcacggtgcgtgcacccactgacctgcgcgcactgtctggcactccctagtgagatgaacctggtacctcagatggaaatgcagaaattacccgtcttctgcgttgctcacgctgggagctgtagaccagagctgttcctattccgccatcttggctcctccaacttaaacttaactttaaaaattgatattcaattcagtcactggaagacataagtatgtgtgaaactactcggatatatgaattactttttcagttgtaagttttgtgaaatgtatatacagataaaatatttctagtaaaaacagtgtcagaattgagatgtgctgtaagtataaaatacacatcaaattttgaagacttcatatgggaaataggatgtaaaatagcacatttacaattttaaattttgatcacattttgaagtaatattttgaatatattgggttaagttaaatatattattaaagttaattatacctatttctccttttttggggtggctgctagaaaatttaaaattatatatttgctttgcattatattcctcttggactgtgttggcctagatcgtttattagcttaggcaacataatgcaaatttacattaactttatttggtcttcatcatattaataataaaagcaaaacaaaacaagaaaccaccaggtgctaatagtcacaggctgagttccctaggaacagactctgagattgagtttagcatgccacataatttttaaggagttccctggggaaggaagtaggattgagcagagagaagttgagctgcgatgcaggcccaacaatgggctcagctaaccccacgaggagctctgacactaacatgacctttcagtttgtcctgagttgggccaagatggcaaagtctttctaccccatcatcaacaggtcattgaatgcgggtcactctgggaagagcatgatcttaggcaagatggtgctctgtgtctgaggccaaccctgaaggcgctggcagctgaaggctgtctatggacagcactctttgcagctcaggtcaggcagtaagtctttagttgcagggtgagctgggcagcacattacagtgtctactatactaacattttttgttgaagatttcccatgaagatattgattattgtctttttcagtttttaatcagatgcattggctaatacctgtttgtagctgaagctaagtctgtcctcttaggccatggtgtgaattgtgtgtttccctttcttccttcatctctggcttagctcctttcattaccttcatggcccctctagaagtttatgttaggtttttaaggccagaccagactgacttgagcccagccgtaattggagaccagattcaaggctctctcttggtggcaggtgacattagtcagactttattcttatctatgaaagttcataagtaagtgagcttttgtgtttttctgcttaactctcattactacctgttatctctttgaagacaagggatatgtaaaggtacatatatgtgtatagattgtgtatgtgtttgagtatgtatgtatgctttaagccttgttccaagattggtttatattagaaactaaacaaatacagcccagcacggtggctcatgcctgtaatcccagcactttgggaggccgaggcgggtggatcacgaggtcaggggatcgagactatcctggctaacatggtgaaatcctgtctctactaaaaatacaaaaaaaaaattaggtgggcgtggtggtgggcgcctgtagtcccagctactcgggaggctgaggcaggagaatggcgtgaacccaggaggtggagcttgcagtgagcagagatcgtgctgctgcactccagcttgggcgacagagcaagattccatctcaaaaaaaagaaaaaaaaaaaaaaggaaagaaaaaagaaactgaacaaatacgttatttactgaaggagtaaatatgtgtgacaaccagtggtgtcctcattccgtatctccatcttcagagaatgcttgtgtgccttcaaatttatgacattttcctctcaccccttagtggtgaagaaactgaaatattgaccccatccccaaaaattaataagttaagtgtaagtggtacctgtggtccatttgaaagggaatatctgaatggaatgggaggacagccacctattctcagcaggcagaaagggtacttgtcaacaggtaatatgggaaagctaagaaagattaagactttatttttccctatagtctgcctttctgtgttcccaattctttacactgctgtgtaatgttatggaatatgattctcaattaggaaacttgaacgaagacaaaaaaaatggtaagagactatcttctaaatatatccttagttcttcaggcagcaatttaatttcagttaaaagaaagaacaaaggcatgtcaatgttttggactgaggctaaccgaggactttcactggcactctttttagagctagaccattggggaagttgcagtgttacataatgctatgcttctcattgccatagagaagcagcagctgctttgagactttagaaaatcagcagcgacttgaactctgtgttgcttgtgtccagaaaattccaggcactttgtcaatttttttcttcattttcaaattatccttttgaggaaaatataaaggagtaatcccattatctctattttagagataattcagctgagtttcaagaggtttgttgtcttgcttcaagttgtccattagcagaacgaagaacaaaatcttgctttctgtctttcccagactgattctctattgtagcttctctttggctgttgatataatatcaaatattttgtatgtatgtgaaaaatttgaaatttcatttatttcactagtttaccaaatccctgcctttcactgctgaccaaggttagaactaatataaaactatttcctttagaatgcttagtgaatattttttgccactaaggctaaaacaccactgataatttttactctctcttgtatatgtttaaataacagaatagaaaggaatatgggaggtacatgatatggaatgagacacatcttgactaaaatattttagtttagagcaaattttctctgatcatagttattcaaaggatctgtttatttgtatgtggcatgatggtgtgtgtaacctcacaaacaaatgcagagcctgggaataagaaagatgacttatggtttcacctccaagattttgactctgaaaaagtcatagaacctctccctttcatagtttctctccctctctctttcatataaatatatatatttcacaataattacttgaataaatcctaggtacctctcctaaagagttttgaaaaataaacacatagatatgaagaaagatggcccaatataaaccaacagtggtcctactatccctgtcctctatgggcttgctaagcaataccccaaggtaactttcaagctgactttgatgtgaatgcccaggttcacgtataggagtaacatagaccactaagaggggtttcttgacaatccacagtatctctctcccccttacaaaagatagtttttaacatcaagaggacagttgttgactctcatttgaattattaaaccaaataagtggctgttaaaggagcaaagatctgaataataatcagttatcatttgcagagataattcaaatgatagctaattattgggcaggcactctacataaattatttcttttcattcctatgagatgggtactttatgaggaaagagagaggttcagagaaggcatgtcagttttctaagatcacacagctcattgttgactgagccttgacatgaaactacagctatgtttaaaaccagtgctatttctagtgtactatcctgcttccttgtaattatccaacacttttcttctttttctcctttttaaaaatcaggtagtatctgattgactttgtctttcttttttgccaagggtacactcaccaactgctgtccagagttaaatttatagtcacaaagcaagagaaaagtctttgtttccaagccaatgggctgggtttccagaggcataaatcctaggaattagtaatatcccatataaaatcactgaaggttggtgcctatggttatgtcagtggcctctatgatactccctaaaggcgtaatttattccacagtccctagacacattcgttcatgttctttgaaacagggcacacttgcctttcccagaaatttttcaaccaaacaggactaggacatagatcaaggtctgtcagcctatgctcaaagtgtcctctgcagactttgttgccactaaactagaaataatccatagtttctcctgtttccttttccgttaatgaccaactttatatacactcaaaatgaataagtgatacggtttgttcttctcctctacttctctgtttcccaaagtaatttgcaagttagaagaggaaatccattaggagaagctgaatggattaaaagataataggatttggagaacaggacccagtgaatcacaaattcattacattcacagctgacaattgctaagtcccggcctgctcctctcacaatggggccaaggtctgtgcagcatgctggtgtgcctggtgaaaggagaaaatgagcttcataaatacaaacgttagagtcaatcttatgttccccagggactgccagtactttacttggcaagaatagaaaaggaattcttaaggatataaaggcaaaaacgaacactgtaaaacacaaaccacaacaatggaaaactatagagccttgcttccaaagcttagtcatccatacttttctgaaatgccaggaattgggatatggaaaagagctcagaaaactacaggaggcatccatggaacaaccacagaattctcattctggaaagctttggcagggctatgttctcatcatttcactttaatcaccttttaccccttggggccatttgaggaccatgaaattctaagaatgggtagaaaatactcccccaaccaaataagaaataagattcttttgtttctatatgtcctggattctgcatgctgcctgctcggagaggagagccttacactggagtttgcaggcatttgctgctgtctcaataggtagatcttcagttaggtcccagcttcatgccatctgttatttctaaagtattttggccttcagctggaggaaggtgacaggagagtgttctgttcctgcagaaaatttgcttgtcatcagagtaactgtgtactgttgaaacagctactgcctacatttcactgcctcttgaaagctagcattttggtgtgaatcaattatgaaaagtgatgcacactgccccaacacgcacacatacacatacaccccgcctaaaaacctgagacataaacaatgtctagaattgtgggcaatcatgcagagcccttcaaacaatattaaaatccagccacttgtaaagagtgagtaataaaataagtttagggttatataaattgagtctaataaaataattcagattcctatggtacattacagttttatagtagtgcctttattttctcttgttcttctacaaatgcctttttgaatatttattcattacccatttcctggataaagatagtaaggcttagaccttttaccaggatatcatagcttaaaaaatgacagagctatttaattcatatttaaaatcatattttttcttttgcatttttctacttcctggcatatgtttttttctctgatattagggtataggacaggacgaggaataattaaagtccctccaaagattaggtcagaaagggaccataaaagcttttccattaggaagctggctttggcgtttcattgtcattggagaaggcccatctgtacctatggcacgtgttatgctaggaaaatacctcctgaatccttttgtagaaagcaataagatagcatttctcagaaagaaaatgctttgctaagcaaatactttgaaaaaaacaataaatgattttttaaatggcattacaatgttctttgaataggacatgggaacaggaatcaaacttggatatattgtattttcatcttattttatttcatttttattagtgacagggttttgctctgtcacccaggctgaagtatagtagcatgataatagctcactgcagccttgaccttccaggctcatgatccttacgcctcatcctcctgagtagctgggaccacaggcatgtgccaccatgcctggctaatgccttttaagtttggtatggacaaggtctcactgtattgcccagactgctttctaactcttgggcacaagtgatccctccaccttggcttcccaaagtgctaggatgagaggtgttattgcatatttttacaagtatcagacatgtatgttctgaaaggcactagaatcattgaaaataagtcactgtgaagtgcaatgactcttgaagataggggatagcagaagtgtgaaactttgtaggctaatcattatggccaatgcctaattaggatttatagtaccaaggcctgaccaaagtcataaattatcagacaaaattattggacagaaagtgaatgactgcatatcttgttaaaatcactagggaacttaggcagaaggtaatgactgaaatgagaacttgcctgaaacatcaggctaaaaatagttcttgatatatgaagatgatctgaaaaatgagccaaaatttgtgttgcaaaacagcaattcaagaattcaatcttaaaacattgcctatttttttcttcagaaaacaggatacaaaagtcagtgtgaatgagcaaagccattgagttgctcccaaagcagaagaaattagacaaagctattatggaggagatggggatggatttccacaagagagggcaacctctatgtgaggggtaatttaatgaaaaatttgcaggtgatgcacctgtcttttcaaagttcttttcatccctgcaatttcatactttttcaccttcaaggccaatggctttgtcagtgctgcctgaattgtgcctttgaatgagtaatgacagatttgaaataagaacattggagcattttaagtgtccagtaatatttgctcctggatctactttgaatggtgggtgtgtgatgactggtctccatgaatgggatcatctaatgccttttaaaaattaaagacatagtgtcatttggactttttatgatgcagtactatcttgtcacagaagacttcaggatttctcttggttagcaagtcaacagagacctgtgtatctaggcctgcatatatgcatgcatgttgttacttgatatattcggttataagaaaaggaagtcagtcctagtaaataacaccatccatatgagatttatgggtttcacttataaatattaaattaataaataaaatattatcctatcatacttagtaacaaaggtataaggctacaatattacacctgtcctgtaacttcacagatatctaatgaatatctagaaaacatctctgacttgctgcgagtgtgtcactaaagccctacattgaccatatatgtctttattctctatctgataatgttgcaactttcacattatttttgaaagttcttaattggtgattaaattcctgagaatttccagtaatgcataccaaatgtcctgagactttttagacataaatctgactcaccttcaaaatcaaaacaaaaaatcagtattactatgatttcaagtcataatctgaatttaactccacctttaaaattaaatgctgccaggatcacatgctcaaaggctttcttggaaatatggcttatacaaatggcatatgcatatatatatatatatatcatatacatggcatatatacatatatatgagatatatatgtatataatgtatatgtatatataaaactggcaacagaaacacaggaaatgatatgaaaaaattattttgttcatttggaacgctgtatttgttgtcatttttgaagacaataaaattgtcattcgaaccaaacccatttgtttcattatctattaatttctatctcttcacactgcttggattggagatagcaaacaggccatgaaaacaccttgggaaaataattcttgcacattctctaacaaaactggaaaaattactgatagattcttggtttggtcatatggtgcttacatgaactggagaactttgatttgagctagttcaaattttaacacactatccttacatacctacgtttgagagactgttatatgggatttgagagattttgaaaacatggcctttttcttgccgtttgtgagcaaggagagatgtaagctgtttacctctgtacccagcaaaataccttccaatgaggttagaatcactaggacttttcttaatgttggttcacccccattatacctcctgagtataagtggataatgatttttttaaatcataagagcgccatgttgcaattgttattatcaccccacctcactgtgtgtgtgtgtgtgtgtgtgtgtgtgtgtgtgtgtgaagttaaatgatctttaatagtggtttgttaccaaaaaatccatgtaagctcaagtcacctaaataaaaactactgtataagaaggaggcacaagtatggaaaacatataggaatacaagaaatgtttacttttggcccttttcctcttttaggccatttccttcctttccctctaccttggacagctagtttcaataaacaaaaccttgtccttattactaccacttttagaatgccttaacttgcccttaatgcctagcctttcaacaggtggattcttgtgtgtcctgaataaacatacaaacacatagaaacacacatacacaatacaaatgtatatatattttgtatagtatatctgtatatatttaggtacatattttaaaaacaaacacattcaagtaagagaaacattgagtggtaaaagaaaaattagcaaactgatataaggtgtagcagtcttacttatcaaatggaacaggtgtctttttcaaatttagttggtgcctttaattggccatttattcctgagtgtgttgggcgtagtaataaatgatatgacaacacagctcatgccagtggtggacttctacaaccagtggaatagtcaagaaaggtcaagctgtctccattgatttgaaagtagattgtacctacttatcacaagcaccttagttttcctttccttcttttctatgaaggattgtccccttgtccatatcacatgttatctatcatccttaatgtcactaataaattagattattcatggaatgtgcttagccctgtgtctggctccttgtaagcagttgataaatgtaagctgctatagttatcacactttgatccttaccacgtttccttgatatattgagggcaaataattgaatctgcattttattaaaagaacactgagactaatggaggtgaagaggttacctgacttctctttggctcaggatcagtgaacaatattataggtacttgaactaagaactccagtcttttaggccagtgattgctcctcagtatcaacatttaaaagtagttagttattcttgttttctgaaaccatcctgagaaaataaaggagataccacttctgtcttgtctcttctccctggttttaaacctgtgccttgtcataatgcaaaggccatgtatttatttaaaaattataaacacattttacctgaagtgacagctgaactgtggttctaaatagcctctgttggtggcctcaaacttctgtatatattcggtatattccattaagtgcaattttatgaaaatgtcataaacaaatcaatcactcttgacttaattttcagccaccatcagcttctattgagaatctcagccatcaaaatatccataagaccatatgatgaagtacatataaagtactgtgtgagcacaatgaaaaagcaatgagattcttttggggggttcacggaaagcccccaagtgagggtgccatttgaattgagtataaaatgatgaatagagatttgtccattgaaaagggcagacaggccaggcacggtggctcacgcttgtaattccaacactttaggaagccgaggtggacgggtcacaaagtcgggatacaagaccagcctggccaacatggtgaaacctcatctctactaaaaatacaaaaagtagccaggtgtggtggcgggcacctgtattcccagctagtccggaggctgaggcaggagaattgcttgaacccgggaggcagacgttgcagtgagccgagatggcgccactgcaccccagcctgggagacatagtgagactccgtttcaaaaaaaaaaaagtaaagggcagacagaagctggagatagagtgacccctgtcagactgagggggacatttgagcaaagatatgaatattaaaaaaacaatgatccaatatggttgaattgggtgagtggcaagagtggctgttggcaacctgtgaagtggcatgcatgccaggttaagaagttggagataatttggtagcatttgagctgcaatagatcgtgtcagagagaactatgccatgaccagatgtatgacttagataaccctgacagccatggggtggacaaatggctagggttgagactgcagccaaactcttcacaatttcaggagagaaatgatgaggaatgagattgaagaagtggccatggaggtggggaaaagagagcaaattccagaaaaatattgtggatttgctcagtggaacttggcactggatgaaatatacagaataagtgcaagggaggaggcagaagattaacttggatagatgggttgataactgtagccataactaagggaaatatattaagctcctcttctcaataaagattagatttaattacgaaaatatcatctatttatttgccatcttgttttacaataatatatcttgtatcttcatataaaagcagttacggcagccctctgcactgtattttcatagggttctgtttttatcttacttaactgtaaggtccttgagggcaaaaacagtcaagcctttctcattcatcctttgcaaacccagcaccctgattcccaacagggtagaactcagcacatatttgatgaattagattgaatttaaatctatatatagttataggaataaatgcttggaggattttcctatctctgtttcaattctttgttttagctcagtctttttatgttggctcctgtaagctttttgcagtgctgcaaacacttctagctgacaagagagaaaaagaaagtcagtgaaaaggaggagggggcattgcagcatctagattgaactctccaggcttgcctgtctcataattttcacctttggtggggaactgtcccagatttcatccaccaggctaaggttctgacatggtaccttcttaaatcaagcttgaagggaaattgattgaaaagaaaacaccattatgggaaaacaattcattttcttccccatgacagaaggtagacttttgtctatactgcagaataaatatgatctggctgattgctttaagatctggaagctcagaggagtcataatggctttgctcactctttagagggaaattaccttccattttggagacatttgatacaaaggttttggttagctttcaaaaagtaatattttttctccctgtgtgattatttatattagctagatataggtgcatgaaaacttgcaaatatttctgtgtgcagttgtgtgtttctactgaagtaccctccagacagggagtaagcagattttttttaaaacttttctataagccccttaaatattacagtcgtcccatgctttctgtgttgaaagaaaacaaatttaaactcataaaggtggagtgaaggcaaaaagatagaataatgtttacctgatgtttatagtagtagaaaacacttcattgttagaaatagccaagaaggcacttacgttgtgggacactcatccgtcccgttgacaaaagttggattcattttatcttgcagaaattgcaaactagcatcccctcagacaaaatctagccctgataatacgtatttggacaacatagaaattatgttggcaagtcttttctacttcaacacagtccccaccatgcccattgtacaatggctggccaaattcacacatttaagttcctagctcccaaaagacttgaggttgaatgccttgctaaaggtttttagtgcaactctgctttgctagaagatgaattcctaccttgcaaaaaactcggatgcatgtctcctgagattggaatggacaaggaacaaatgtacttgtttgtagtacttctagaatgtctccctaaatcatcttagaagcagaaatcttacccaaaatatgatgcttgccaatatattgtttaccacccatcatgctctgaaccatcatgcctcttgtctgggtagccttgctctatgaggcaatttgtggtataaagatttttcattaagttttggccagtgaagatgttgtcaatgtacaaagtcagtaatgcttcttgtgaaatggtcgcctctcatgccaatcttggaagcgtaacattttcttgaccactttagttctaatgacttcacgtttatcctgaactagaaatatggtatcttcttggttgtttattctctttcttcttccctctttatatctctccatccttctttcttccttcttttttcttccctctatttcttccttctttccatcattctctcctctttctttctctcattctgtttcttcctcttttttttgaaaatcttagcaagagttaatggacttatgatctaaaaattaggttattagaaatttttgtcataaaacctggagaattgatgtttgaattctccttggctagagtcaatcctttatcctttttaggtaaatgaattaagtctcatgcaatttcctgtgtgggagactctttagatgaatcatttaaatggaaagccctgtctgctcatcaaggggcgcgattttagagttttcctgagtattatgtgcacgcttagtacagtcattgagatacataaggcaaccatgtgccttaatctgtatgaagtctcagttcatatgtgattatttaggtaaagtatataactgaaattttacatcttttgatctctttgcaaaatttccctgagccacttaaaaataacctttctttactcctttttgtcttgaaacatttttattggaagacttcagacctaactttagtaccagagaccgaaagtcatatctcacttagttctacaatctctagtccacttttgatactcagaatagatagtaaaggtgctatttttttaccccagagtgacagactgttataaatgttgggatcctatgaagtactgtggagagtatttaatgagccgttgtagagcctacacagatacatttatataagatattgtttttataccagcctcaaatgctcctaggagcagccagacaggtcttcctcaaaaggataatctggaatctttacctttgcaattgttctatgatacttctctttcaatgcacaactcccaattaattccttggtactccttgcaataagagaaaattaaaagggactcatttgatattagatgggatcacacttatatacctattgcattgtataataagtaagcatgagtatcattctgttgtatagtcccaaacttttccttgaaataattggcaagaggatagaggaaagacatccaagatttattaataccttcatggttctagttacctctataaactagtgaaaccttttccaaatattgtagataaagaaattgaggcacagaggtgttacttaactgattcaagttcacacagctaataaacaacagaggcacaattccaaaccagctcttcatggctctaaaatctgtgttttttccataataagctgcctaatttattgcgcttttattgtggtaattattttacaagcattattgcatttaatcctcatagccttgttatgtaagtcccaatagtccccatttttgctgatgaaggaagtaggattcagagaaatcaagtagctctcatgttgtctcacagtgaataagcaatagattcaagatgaactccagagcctgtgctcttaaccactacagaaaattatgaaattacaaggcatggtcctgccttgtggctctagcatcaagttggtaagacaacacaacaccaaggctcttaaggaatcctctggacttgagtgtatgtatgggaggagaagagggtgttctaggtaggatagtaacatgacaaattcaaggatatgagaatggaatgttcagctttattttcattttagataaagttataatatctgataagatagcatggaaggaaggaacttcactctcctggagtgtagagttgtcaggagtggacttgaaaaaaagagtgacaaccatgaggtctgataggctttagaacgcaggtcttaaagagcctggagaaaagagcgtgcatcacaaatcctacatagacagcaaaaccactgcccaggtaaaccaaggccgcagtctaatcttggaaggagagagtaatttaggacagcaaagcagaatccatctccttgggcaaagcttcaggaaagccctgtctgaatctaagagggagctctcggaaggaaaggagaaggacatttgcagaaggaagagaggcagccttggcccttatgaactctgggggaggttcctccccctactcttaactgaatgtggccataagttgaacaccagtgaacaccagcaactgctgagactgaggagagcagcaacaactgagcaattaacctttggtgatgggcttgaagttctaattaagagcagagtctcttctatcaggtgggagggggaacagcagaaagatgtatgagggggatgaaaaagaccagcatgttagcaggtcagatttaaaagacatccaaatgggtgtaagagggtgagagaaaagaaggagatcactgaccaattaatttttctgtttcccagtcaaagtttcttctcctttctcttaaccctgcagtgactgctgtgtgcagaagccagcagctccggggagagctgacgttgaatgcttatgctcctctctgttgtaaattcctttcttcatttgctgagtatcattggtaatttctatgtaaattttctcagagtagcaatttagcagcttttctgttgacaaatgaggaataacttaatagtcaagtgactgcatgtcatgtttcgcaaggaggtggaagtagcgccttgtagatcgcagggatggatgctggaagtgggcgatcttgggaaagcctcattgcctcagtgccctatttaatttcgcccatttaagataggagagaataagcttctatacttgaggaacctagtttcttgtgaagagtgattgttaggaatcttttctcttttagcacttagttaacgaatacctttcaaaccaaatcaagaggcaagaccccctccaactttgtccagaagccttcacaagcagaggcatattttgttttgtatcaaatgcttctcattgtccatattcaggaggcaggcaacagtggggtcctttttgaagtgaccagggatggatgcaggcagcaaggcatcgttgctttccagatgccacctttactataagaatcgaagtcctttaaagtggactctgagaaacttcacctaaatcatttcccaaggtgacagctctctatgcagttttttctcctaactagaaagcttcctcttgccactgcgctgaaaatgggaaaagtaggtggatggggaggtcttttttaaagcccagatttctggaatttgtggtccttctactttcctgtctccagcagtgaccttctcctcatttattcatgacagaatcatacgtataaaaattcatgtattctggtcaccgttctaaattctggatggtgaaaaaaaatatgcagggcccctccttttatggaactttcattttaggaaggaggaaacagtaagcaagtgaacagataagttagtggtataaaattgtttaagagtgactggatgggaggagggtttactggaagctcagagggttcatggtagcccactctgcagagatgagagttaaacagtgttgtgaatgattgaaaagagccaaccattcacagatctagggaggcatgctcccagaagctgagacagctagagcaaaggcctgaggtgggaaagaacttagcttgctgataaatcagatacagagccaagctgctgttgtattgtaagattatttcagactcgggagtagggatgtgtttgcacttctagctctataggccctcatgagcctgttggacacattgttaaattgatgccaagtagctcaaagcagaacccagtcccttgtccctcatcttctttctgctgacttcataagaacatggttcactttcactgccttcctttgtggacatactcagcctgcgaattaaaaacagaactgattttctcatctcccttggatcctggggaaattaaggcctgcctaggcctcagttctttccctagattgagattaaaatagctttccttgcaatcatccagatgccaatttaataaacattctctggccccttccacatataacccctggactgccttactaatttcttagcattcttctccttttctccacaaatcctccctttaaagagtgtttttttcccatgcctttcttattcttttttgtggaaagcccaaattagtttgtttatttttgcccttaaagtccaccatatccaaatgagaagtacagaagctattaccttaaaagtaagcagtgagaatcctaacatctttttttccatccccacattctcctcaatatgttccctgtcctttgatgcataagagggtgaaaacctcacatgagtattttatgcactaccattttacaagtgtttcagtaaatattacttcatgtaattctcataaaaatcttgggagatcagcaacacaagaactggtaggaaactctgtaagggggaatgtggggatgcgagggaagccagatcatttccaaagtccaaaggtcagatcttcacgttgaaacccagtctgcactgacctttgacctggcatcaccattccatagctatttgttggtgtcagcatcctggatagggggatttttttttttttcaaattgtaattcaaaggctaacagaaaagagaaggtaggcttgagaaagcactagttttcttgggactctgacttattatttggaagaaaattgattgaaagcataggtgattatttgttccttgtatctttcagaaaaaatcaagtgctctatgacattactgagtatatacccaaaggaatataaatcattctgttataaagagacatgcatgcgtatattcattgtggcactattcacaatagtaaagacatggaatcaacccaaatgcccatcaatgatagactggacaaagaaaatgtggtacatatacaccatggaatactatacagacataaaaaggaatgagatcatgtcctttgcagggacgtggaaggagctggaagccattatcctcagcaaaccaacgcaggaacagaaaaccaaataccacatgttcttacttgtaagtgggagctgaacaatgagaacacatgggcacagggaggggaataacaaacagtggggccagtcatggggaggggaggaggagagcatcaggaaaaatagctaatgcatgctgggcttaatacctaggtgatgggttgataggtgcagcaaaccaccatggcacacgttcacctgtgtaacaaacctgcacatcctgcacatgtaccgtggaacttaaaataaaatgacacattactttccccactgtttttttttaagcaaaagtgttctcacacagaacacaggcaagcatgtctaacatgttccattctaagtcttgcccttgcatgtggttgaaaatgactatggactatccacatcacaaattatgggttccagtgtgtatatggacacttctgaattcactcaaaatttttcttactgatccctattgccagatgggggagatcagcttctatattaagcaaggatgtgtccaacttttgaaatggaatgaatagttaaaattgtgcatttctcactctggtggttgcctatagctgtctccgcccccacccccacctctcttccccaccaccttcaccagcagtagaaaagtatgtcatatgtgtgtggggtgggtacagatagagaaacttggcagaaatagggtgagagatgtgactaacaccctcagctaatttctgtgcatgttcccaaacagagatctgcagagaaaggagcaagagttccttgcattctaacccaagccaccccttcacacttccagctttagttcacttctccaccttccatgcatggttgccatctgacctggctactgagaagatcagacctcccagtaggagatccaccacataagctaaaaataagagctgctacttctctgcagataccattaacccaattagataaataaaaaaaaaaaaagaaaaagaaattacagcttcattaagtaacaccagaataaactccaagaaggcaaaccaaatcagttatacaatttaaaactttactcaaaaatcaaaatgatttgaaaccaatggtcacttaaatgaaggcagaagctgcatggcagccattattggagccagcaattcagcagaagtccaaaggtccagtgcagcagtacatgtgacaggtgatgttgcctgcatacacaaaattaaatggaactagttttcgagggtcttcttgtctccatgaaaagagaatgtatccttctgaaagtccttttgtttaaaaatatgatcaggctctgaaagaattttaggtcttgatactaactaacagaagacatgcatttattaaaaattgtatcacaaaggggtgaactggggcctgattgattgatgttgaaatttgatttatccccagtagaaagtgccaggatattaagcctctattactccacaagggataccattttgcctttggtgggtgaggtaaatcttcagattagaaatggtaaagcctcaagacttccaaaaacatacaggctcctattgtatacttgctgaagttcctataattatttacaattccctgcaaagaacattcttgggggtgagtcccagaacagaggtgagcctccagctgcaaaaaccatagcaagtatggcagggagcatctttgattcagaacagaacgccactcatcgttccatcagaacaggggcaggaggttcctgccaatactgattgatgccacgaatcaactggagttgttccatgatccacatggtccttggacttggtgctgtcctggaaactggattcattgctcaaggagctgagataaaagaaagcagcctaaccaatggccagctcaaattaggagctcaaatgaacagggcctcaaggaagtcagcctctgagaatctgagatttccagactctgataatgggaatctcacctatttgtccacttttggggtagatctagacaccgtgatgtgtcagcagcctcttagttgctgagacaattgtcccagagtgcacagactaaatctaaatccctacaatatgttttcaatgaatttatgccacactaattttctaatttgcaatttttaagtcaatatactttattttcttttaaaaatagtgttttatattttcatactataacatatttccatgatattaaaattggcaagtaaagaaaataaaatatgtaaagtcattactgtcatcctcccagaagtgatgtgctaacaattagacatatttcatccccagtttttttctacagacacttttgctttaccatattgtgtacttgggtctattttcaactctgagccacttgctatattgaacagtgtttctacagacaccgtgctgtttcttctttccttctttcactcaacaatcatttactgagcattttgagaagaactgggaggacagcgatagaatgcttttgcattttatctgcagtcaactagttagaaaccagaaacaactatcttgcatctcactatcttgttatttgcacctttaaaatccctttgcagaataggtgcatagtattaatttgataactaaatgaaaacaaaatggagttcatcaaagtggatttgttttgaattggcttggagttactggcagtctatgatgacatacgctactccccaccattgacacatgcattcaaatgcagatgctatattagtctgttctcacactgctaataaagacatatccaaaactcggtaatttataaaggaaagaggtttaattaactcacagttccatgtggctggggaggcctcttaatcatggcagaaggtggaggagaagcaagacatgtcttacatagcagcaggcaagagagcttgtgtaggggaactgctgtttataaaaccatcagatatcttgagacttattcactatcatgagattggtatgggggaaatcactcccacaattaagttatctcaccctgaccccacccttgacatgtaaggattattacaattcaaggtgagatttgggtgaagacacagccaaaccatatcagaggcacacacaattttatgtgtttgtgaagaaaaggcaattgtggaaactttacttaaaaagtgtaatgtcaatctcatgagttgaggacagttaggagaccctgaaatgacacctgtgggcttgcattttattcttggtcactgctaaaccatttttcacttccctctgtttcagtaacctaaaaatctagggttcacaaaacaatgagattaaggaagccaactgataactattgtaataggataggaaatgtttcctgatttgggaaggatgggcaaggaggtggagaatgagcttccaaggcagttttgattttccggaaaaactcatcttaaaactgattatctccccaacatgagacctaccaactgacctgtatcagcctaactgcaatgtatctgtctaaagctgttaaacacagctattttcaaaacatttatccattttcataaaagatttcttaaaattcaagctaggttttcttcctttatttgaaaagggaatatggtaattttaggaatatgattatatatgcatatgtggaagagaagcagaatacttaaaagacaagcatttcctctttttatttgagagagagaaagagagagaaagaaactcctaggcaatcagagcagaacattcctaaccttacatttgatccacccattgagctactgaataaatgcttaatatgtcagtgagcccacaagtttcttgtcctgggccctttaaactgatatatctcaatcacctttactgaaatgttatcctgagaagaccgtaaacccagggctgctcaccactgagtcttcttttatgaaggtttctcaggagaacatacagctaaagatctctaacatttttcctgagtagacctcttttttctcttcatgaggatatcataataaatgactcgttggtaatttatcagagcttgttccttccccaacccattctccttaatgcattttttaaatttatccagtatttgaaatgcagaagtccaggcttggtaggaacccagaagagaagaaggtgaaagaacaaaatgactgtgaagctaagaaatccagatttggaaggagtagcatcctcacagatgctcacagaagtccatatgacactccttgcattgcctggggctttatggaagaagcagggtcacgcaggattagtcattgcccaaagagcgaagagcatggaactcgccaatagcctgcaaactctttccttttggcttttctagcacttactactcttttatgacttttactttacttaattttcttatataccaggaatataaccaaccagggtagttgggggccattgtgtattgagcactgcccaactcaattcacttagcttgcaatgtgaatggcttctctcttctagaggtgctcaaggtgcaacccacataatcacacctgatagccatgttgtcaatgcccaatcacattttaaacacttggagggcagagactatgacatagagaaagatttgaatagctattcacagaattcagttgagctgaaaaagtcagaagaggagactagtttcactgactacaagaaagagtgatttggttttctgagagtgaaatcttcccccacaaacatgtactgtttggcaacatgtttttttaagcctttagaattgtaatgctttttgctgggtcatatgttctcaaattttgcctcaagccccatcattccctgttttattatggtaagcttattcacacatttatatacctgccaggctattgtaggtattttgatatgtggcttggcctttctgggcctcatttaacctctctagactgcagttttctcaactgaaaaaattcccatcatatctgccctgcctatatcatgagactttgtgacgattcaaaggagcaattcaggcacaagctgtgtaaaggttacagaacacaatatagactacattatcattaaactacttgatagtcttatgactatttttatggtaatgaaacgtaatccaatgcaacttcgtatatgtaagtaaaacttcttaattcttgtcttgtaaaactgaatcttcatcctttgactgatcaactgaccagcttaaaccttggagaatcttaaacttctgaacacattttacttctctctttatgttcccctgtggatctcttatgagtatacagagattgagagtccaccatacaggttacctttcactcaagaggttgtggcatcctattcattgtcaactactggactttttcctccccgtcgtggaaaattggtgtcacattgccacatggagcatcccttcttcactcttgacccttccttcatcaatggtggagcatcctcctgaagctggagaagagaaatataaagctatgtgtttcagaatgaaaggaccaatcacaagaaactctcaagccttaaaatacatttagcttttggatataatacatcacatctgtatttgttagtaacatattaaacaaaatgatagataaaatgtagattatataagaacctatgtaattgacatgatttagatactcattcaaagatgagtcatgaaaaaggtacggtattgtcattgcacagtatttcctatccctgtgacatatgaataccaccttcaccgtttttgtagtattcactcatcacttgcactgttatttacttaatagtcttctttaagttgatttattttacttaaatatatttattttgaaagcaaaatatataattctaaagtaaatgaaaagtcggtattacttctcataaataaaaataattgtaaaaataaaagctttaagaacaaattatgttgttatattttagctatgtattatagcctgacaaaagacaagaattagtcctcatttaaaaaaaataaaggagattggcagattttaaaaaggcttttaaagatatataagtgcttattttctctctgaggaaataaagagcaaaagaaaacttaaaagttaataattttgcataagtataatttggaatgattcagtgtattttttcattatgacttcaaatcatttaatgtatcaaaaacatagtcataaacattggggtcatcatctattttgattgtagagattttacttttatacatagatgttttcaacaatataacctaaatttctgggaagttatatcttttacatttattttaaaaatctctctcttccctcacttcttcattgaagtaataagggacttaacttctttaaaccaaagtttccattatagataataaaacaaccatcacaacaagaaactactaaatgattatttattcagatcccagaagaagtgctttacacggatactctacttcaaccctcacaactgctccataaagtaaatgctattagagtaaccgttttacagatgtgaaaaataagtcttagagcaatttcttagtttgctgtgatcacacagctagcatgtcaggcaatctgatctggcacctgcaatcttaacctttcctgaaataatcttattacttaaaaaagtattactaataatgataagaggctatatttcattattttttgaaaagtatgtttatggtctatgtcacaaattaagagtgacaatcagaaactcctgtaccattggaaaatgaaattttacaatttggattgctgttcaggaagcaaggttaaacaaataaacaaaaataaacaatgacaaaagccttttaatgaccattctggatttttttttcattttaaaaatgaatgctcaatgtttcttcctcctagtgtattgctttacttccttaacagaatcctattttattaagaagactgtgaagacaaattttagactgaggttctgagagatgtcttagagccagagaaaaatgaaaaattccagaagtctacagaatccaagtaaagaagactttgtttggaattggcagcaatgacttccactagtagcttaccatgctagtgtaattaatctcactcccatttctacttctttttatggcagaatttcttaacctcagcactgctgacatagtgggtcatatacttcttcattgtgaatggctgtcctctgcatggtagaatgtatagcagcattcttgggctctatccactaaatgcccagagcatcccccaagttgtgacaataaaaggtatttccagactttgtaacattactctggttaaccacagctagagattacctcaacttgtgatacttttctgcttattttggtgttaattggtatctgccattgttgctggtggtcatgttattgttgttgctttgtcctttagtaaaggttccttctctgcttagagacaggacatgcttagaaccctttgggtcttaataaaacctcttttaatattcaaggtatagcagtgagatataaaaatgattgcatattgacatatatctaaatattttcactttgatttcagcattgaatcaacatctctatcagcttgtcttcctggagaaggatattttttggaggttctggtcaagctcagtggttactgaagctgtcgggagtcttaccaccttggggtcactgtggaaaccagaaaataaatggacaaagctgggattgctttttggctagtataatatttccagaatccctgaggcttgcttttaaatcagcataagctggttttgtgtctcacttttgtgttgtacaattacagaaagcagcaaatacttatcttggcatgtcctgtcatgacatgagccaaaagctgtcatcctcatagattccctgtctaagggaatagttgccctatcagcatttgaaagaaacactcctgaaaccttttggagactctaaagttatgtactgtcatttgatggataagtgactcaaaattcatattgatcacatcatttcaaattcttacctgttagactggtgagagaactctaggtactttgttgggaaggatgatggagaagagagaagtgaaaatatgaaggattacttataacaaaagacttgagaaatattttaggcttgagaagcattttataagggaaagatatttgtgatggggactagtaagtaccacttttcacctattgccatttgaaaattgactgtttgcatattgtttttttctgaaatgccgctatgcagtcagggatgagaaggggattgtgattgagtaaagatctttcttagaatcatgtcctcatttgtaaattgtgattttctgtccattaagaagataataatttctttttcctgacatggccttgtatttttaacttcttgctccacccatactcaaatgcaggttgatttattctcctttatgctaggtgacttccccctgtgtatactctctttcagaagtatttctttctatctccctaaaatcaaaaccaatgttcaccttaggttgtgtagaaaagtctctgctaaggcacctcacacctttctaaatcacataagttataacttatttatatatttactttgaagtaccattcctgaatatctaatagtgagattaatgagttggttaatgtggtatcaatttagggcagaaatcattttgaggaactcataaatacctactattatgatgtatgaagcttcaggtttttatggctgccactcaaacaaagaaatattatttggaagatgtgatttgatgttagtatttaatcaaatgtacttatttcacctacttgctgaataagcacccttctttactaccatcactggttttcatattgaggtatgtggatttatcctttatcattgctcacctttgaagatggtggcataattaaagaattacaaggggatttcagaaagttgtagataaattgaactaaaagataaaaatagaaaaaatttatttctcaacataagctccatcgggttcaagacatttttgtaagctatgataccagtgatttagtccatccttaaagaactgaaggtcctgaaaatataaccatactaatgcattctttttgacattattacctgaagaaaactgggtgccctttaaagaggttttaagattaggaaacaaagttaggaggagcaaaatcagggctgcaagatggttgcctaattatttcccatcaaaactctcacaaaattgctcgtgtttgatgagaagaatgagcaggagcactgttgtagtggatgaggactctctggtaaagctctcctgagtggttttgtgtttttgtttgtggtttgcaaaagctttggctttctcaaaatactctcataataagcaggtgttattgttctttggccctccataaagtcaatgagcaaaatgtcttgaacatcccccaaaactgttgccatgacctttgttcttgactaatctgcttttgctttgatttgaccacttctacctcttggtagccattgctttgattgtgctttgtttttagaatcatagtgatgaagccatgtttcatctcctgttacaatttttcaaagacatgcttcaggatgttgatctcacttgtttaaaattttcatttaaagctctggtcttgtcttcagcttatctgagcacagtggtcttgacactgattgagtgaaaagtttgctcaactttaatttttcagtaagcattgttagtgaaccaattgaggtgtctatggcgttggctattgttcatgctgctaattgatagtcctctccaattagggtacaaaaagattatttttttcttcagaaattgagtggatggtctgctgctgtaggtttcattctcaacatcattttatcccttcctaaaaatatccatttttaaactgctgatttattttggccatcgtccccacaaactttttgtaaagcatcagtgattttaccattctctcacccaagcttcaccataaatttcatgtctgtccttgtttcaattttagcagaatttgtattgctctgataggagcacttttaaaacaaatgccttttctcttactccctcaaactagatcatgttcagacatgttataacaagttagtacaagtttattttgctacaaagccaaatagaaatttatgcatttttttcttatatgcgttttccacgaacttttggaagacccctcatatatccatctacatatatggccagtgctaaatctcaatggaaattgaagacacagcattactcattggaatgaaatggcttgcaggaaattcccaaagctggctagaaagagttgaggtaacctcttccctcttcatggttccagtatcacccaaagcttttcctcctcagcactaaatctttgctgcaatactccttcttcagaggtgcttatgaaatggcctcatttcaaagaatgaaagttaggttgtagcaggaattttgaagcccagaactttaacataaatagttgaaaagaagaaaaataaaaactctttatacaaattcttaatcttagtttactctgtgtgttaaattgtcattgccataatgattttagtcctttctctgacctggattctcccactccccagcttttaaatttagtccattctatgtagtgcctcttgtaatttagcacattgtaggtgccccattagttttgttgctttattcacctgcatcctcacacatcgtgtgattgtgcttgcagagcacactgaactacaacacattctctcactctgaaatctgtcaccataaagcataaagcaaaatccttccctcctttactgaatggatggctgggtggatagctgttctttgcacatgttcgtgttgagtaggtgctgtataaaatcacttgttctttttttaacgtgactcacgaaaaaattatcccagctttcagtaatctcaaggaaaaaaaaacacttgccatctgcaatttactgcttttaacctgaaaaataggatctaaaatgatactcagatacttaagaggcttcacgtgttgtaggcagaagctgacagatggcacatggtggtaggctgttgcctcataaggagggaaggcagaagcaagtagacagtggtatggaaagcttcttgggaagaggtcatgacaacgcttcaaccagagataattaattatttgctatattctgtaactagcctgtttatacaaatagctggtgtgctcagtacaacatagcagtgaatctatggaaaaggaatctgtaaataataatgcaagggaacttctcttacgtctattgctaaggggattatcatagcattcaattttaagccatgtaacctggaatgcttactaaatgtgtaattcttgttcttcctcttcatataatgcacagacttgaattcctatattgagagaataacttacctcttttaaataataccataatttgccttgaaggtagggaagaaagagagtgaagtggggaaaatttcaaaattctgtcttccagggagcatattcctactcatctgtgacgtctaatgtaatagattttgaagaattatttgtaagatagatacttggagaagtttatactcacttcctaatcccagactatagaaacttctgcattctagaatttcagagaatgtgtctctgtcaattgtattctgaagataagatacatttgacatttgattgcttcaatcaacattctccaatgcagatcactaggcagaaacatcttgacacggcatatatttgatacacaatgattatttgcattgacttttaacaaagtcccatttagaaagattgaaagaaaaggcaaatgtgattggatgtatgctaaagcgtgttcagtatgtgttttgaaatatctttgaaagttcccaggatgtggcacgtatcattcacttgaagctgaaaatctctcagttgagcaaaaacaagtatttgctttgttccatgatgcactccacgtgtgactaaaatggcaaagtgaagcctctagtttgtagatacttgctttgggagacagggagctgtccgtcgtcctgaacgggtcatgctttaatgaggatagacacagggtgcaaaggaaagtgactgggatcccctgcctgcactgactttaacaataaagatactggaataatgagatcccatggaatttagcaaaatacgagtagaaacaagtggtaaagacagcccagactgtagttcaaagtctaagaacatctaagctgcgggttcaggtataaaattagggccctgtggcttatctcaagacagtaactttcaaaggggggtttgaatagtctttccaactgtagctacattacctgaggcaattagtttacttattttttgtttttgttttttttttttgtggttagcttttctttttttttaatttattattattatactttaagttttagggtacatgtgcacaatgtgcaggttagttacatatgtatacatgtgccatgctggtgcgctgcacccactaactcgtcatctagcattaggtatatctcccaatgctatcccgcccccctcccctcaccccacaacagtccccagagtgtgatgttccccttcctgtgtccatgtgttctcattgttcaattaccacctgtgagtgagaatatgcggtgtttggttttttgttcttgcgatagtttactgagaatgatgatttccagtttcatccatgtccctacaaaggacgtgaactcatcattttttatggctgcatagtattccatggtgtatatgtgcatccatcaaaaagtgggcgaaggacatgaacagacacttctcaaaagaagacatttatgcagccaaaaaacacatgaaaaaatgctcaccatcactggccatcagagaaatgcaagtcaaaaccacaatgagataccatctcacaccagttagaatggcaatcattaaaaagtcaggaaacaacaggtgctggagaagatgtggagaaatagtttacttattttttaaggcaagcaaggtgggcctgattgttacatgaattaccaaatctaatgacaaagccaggtgccctggtactgaggctgtgtctcctctactccccatttcctcccctttccatcactattttctccaccctgcctatcctcatttctctttgctcctcctctttttccttctactctcttctatcctcccattcttttatttctcctctcttacatcccttccactccctttccttctcttcctttttttcttctctctgtctctctgcatgtgtctgaattaactcttgagtcagcatttaaatttggtaattgaatgttatgggtctttatgggcttcactttgggagaactgcttttcaaacagagaacctgataagtggtggaccttagggttactttgacatgtttacaaaaataaacttatcagtagttttagagactgccattggagcaattatagtctatgctcacagaggcttggtaggcttaccacaatccaacctcactctcccatcattgattctctgctctgtgaaacaagtactgtactcttcttcaagcccaggtgaataaggcttttctaggaaattctttgggattataataaaataattccttctatgagaaaggagaaaatggtggcttttggtcttaagtagattatttaccatctctctcaagagagataaaccataattcttaacaaaaccatattctaatgaagtcattggtcacagtgtcttctatcccaagagagatgcaaattactaaattcctgtcctggtacaaatataagaaatccagtcatggcctgacaagtttgaattccttcttgtccttgatatactctgtttacccccattgtaatttatctcttccttattcctccatattatttaatttagtaagcaaatgtcccctggtataagctgtgtgaatattataactgaattactgtctgtttgcttaactcattacagaaaactatgataaggtttttaattacaaaattagccctgccaaatgaatttctttcattcaatgaactgcaaaaggtggtacagtgaggataaaaatcatgtcctttcccatgttatttatagtacttttttctaaaaataattgttataataaaaaataatgccaacaacaacaacaataatattttcttcctcgtctgtttttgtgtgattcctttaaactgttaattcatgctgaacttgttcaaccaagattccataaagtaatcctcttcaacctacattttattctcagccttgtcttgaacatcttactctgacctcactagctcttcacttaccaatttgtttctcatcttctccttaataaccttatgaataagttttctatgtagtcccttgtattgctctttagacctgtcacttatcacttcttcttcttaggatactcttctccactgtaattcttatgtctactctaactatatatctttgaattctttagcatacataaacatatctgataaagcaggatcaagcacaaagatgctgtatcttgcctgcatccaacagactgggattattctgagctctcaagcaaaacatggttaaatcctgacaacaaaatgaagtgacatttatgcttacatatatccttccttgttttctgcattttcatttgaaaagtaaacatctagtccattttgtttatgtgtctaataatcattttattttactttaatttctttggtaaaagctatggactatggccattgcagaattatcataatttccatggagaaacttctgacatattttaccaaatatttttgaaatgctacactcacagttaaacctagagaggattaatttgggaaaagggactactttatgaaaatgtgggaaattatttctattctttcccttttgtcatgcctatttccctaaaattagattatttatactatacaagtaattaaacttatttcaaaatctaaagttaagagaaattaacaggtcattgctcagaaaaatgcatagtaattgtgagttttctaagactgtcacaacatttgaccaacagtctccttactgaaattttatggtttctttctctagacaaggccacatgcatatgaaagcagacttaaaatatttttacctatagctggaaaatcaaatcataaatggcaaactatgtattacttatgttataattttggagctataattttggagctataaatccaggatatcagacttttttcccactaatattgtagtattaataaaaaattctcttaatgtgtttgcaactaaattggcattaatttaatgaattctttctttgaacattcctcatttttagccagcggttggtggttgagttgcaaatggttattgcctagtaagagatggcctatgaagaataatctatttcactggatcccttggttaggaatgtagcatatgcttgcccaggtccacttctaaggaccaggtctgtttctccttgctactgcctgaaatagcataataattaattcaaaagttggctgcttttcactagaagtctttaggacattgtaagacaattaagtctgtagaagaatgagaaggaatcttttatttgaggtctagaggtgtcataactgtgaatcacaaagttgtggcacaatgcattcacctcagaaaattttcttcatgaaattaaagtttcattttgtcttaaagaaaaggttccactctcatgcgattttgtgtgttctcatcaaagcaagaatctaacttcctgatctggttactgggaatctatgcagacacacacaatccaacctctggggcctgttttgcaaacagtctttatgtcatgatttagaatactgcataagaaatttctccttgaagagagatgactgcttttgacagttggcttttcccagtgcagtcattagactgcacatgactgatgtgtgtgcatggacagggaggggtcttcattccctggaactataatgtcaggtttcatattgtctgagatcagcatctcttcagaaacaaccatgtactcctttctccccaaaccaccttccctcctgaccataactggttatataatcttgcatcttctattaccctgactgctgatccgtgcctgatggctatgccaggtctcacaacaccacgagcttttgattgctgcactctaagctgcttaataagacaattaaaaatgatttacaaatggccatcacaatgcaactggggatcaggaagagaatgttctatttgctccaatattaaaaacgcatgcccttctacagttccttctgcagctgcctttgatttcagtactggtttactccctttttagaaattatttttttgatgaatatcatgttaaaatagttcctcctaaataatgtatagctggaaataattcaagggatgtgttacacatgctaggtggtctgaaatcttcttccctttggtggggtaaacactgcctagaattctggagtagttaaaaagtagtacaaatgatctttcatcatgccggctccttctcagtttgagggtcaaacctaatttaatcactgacacatccatcttgagcatttcctctttcctcctattgttgcattgattaaaatgggcaaatctcccaaagattccattgtgagtcacacaaacgttcatctataaaaagtggaaatttatcagaaatgatgaccttgatattttgaatgtaataactgagaaattcaagtagaatctcatctagtatgtgttgaaaatgctcattttttgtttaattttgtttagtttttttttcttgtccagaggaatgaaaattgatattggcccaaatattaagaagattctctatttttagtgctgagacccaaggattagtaagatgggcattggcagggttaccataacttttcttaggaaggatgtgtggaatagattttttaaaaagaaccatctttgaagccagatatccctgtattttattcttgcctttgttacttagtaaagtgtaggactttgagcaagatgctacatctatctgagattccattttctcatctgcaaagtgaatacactaatcttaacattcagatttgctatgagaattgcatatggttatctttgtaaataaagtgcctggcacacagtaggtgctcagaaaacattgatttcttttaatcctctcattcaagagcacagatgataaaatatttatcactgttagtggtgttatccctggtatatcctggcaaatgcagtgagatactaagaagtttgatgctgaaattactttttcagcactagattattacatttttatgacaatttgaaaattaacctatcctatgtgtatcaatagcccagttttgtgctattttcaagtaatatgaatgttacagtgatggtggccacatgatatgttatgaaggaattttatttacatcaaacttcccacaatagcctgtttattgaattatccctgaaataaaaccaataaacctgtctttggaaaccagtgaccactgacccacttacatgttatggatggtttcttttctgattgccagttagtgtgattggggtaaggaggaggtaactagtgtgactttcttcagggctccccttatactctatgtgtcttctctccctagctgtctaaagttctcttcaccttgaagagcctcccatatttaacagtttatgatggatgaccagcccacattagggcactgttcaaatttcagatactcaggaaggccaatcctcagagtgtttctgatcaaaacattctttcttatctgttctgcttttttaaaattgcttttacttttcttcctttttttgttattcctaccaggttttgttgttattttttttcttcaatgatgtctaattgcaggttaccatttcatctgctactttattttttatgcctcaacatttggtcttctcacctctggttcacttctcatgggattttcttcacctaaagttacaacttattcttccttgtcagtcccacctctctggagctgccaaaagctccctcttgcccctacctgcttcagccagcattatctgcagatatatcaggtaccatctgggtcctacccttctcatatagatccaccccaaatctacctgccttttcttttctttctttctttccttgttttttttttttttttaccttcaggacttatgattctcagagaaaagagatggagaaaccagcccataacttatctatctgagctgaaacagaatcaatgacaatagtggcataagtatccaatgattttgagctaggccttgtgagtctctgactgtaaggtcaccctccttatctcaccagtgtgctgagccttacccaatcctcagcatatcacacccatgtactgagtcactctgcatcaatcccacgttggggaagagagcaaatctattggcaggggataatacaggatggaattagcacaaaggctcttctagtactacaaaatggctttcttgccatctacttgacccagcaaaactgttgtgtgataatatttaccttaaagttggttgttagagggagatagttgatattcacatattagatctcaatagaaaaaatagatagtataggggaatattttttactccataccaaacttaataatttaccattttctatgaaagtgtcttacattctacttctgtattttaataacatgttaaaattatgataattatatgatgtttttaaattttttaggtgcttttctttttctaccatgacaatgctaagtttctcttcctgattattcttgataatattctcccccacaaggccaatgttatctcctgtttcttccctccactctacctaggctggtttcctccctgttgactgtcctatcatgcgtgttcatctttgtattcttcttgaagcctgtgatgactttcactacattctctaccttcgcaaatgcagcatttccttcaaaagtcagttccaagtctttcctggacacaaaaatcaccacttatgtttctgtatgtgaaatttatcatgaaatgtaatacctaaatttatagtatgtggtatcgtttcctgtgctactaagtgcattactttgcctccttcattagagtacaaattcctccaagttaagggaacatggagactatgggcacttctctgattcatgtgatgttctcacaatattgaacatagcacatgaaagaatatgtgattatcagttggttagtggctggcttgctttggatagtcattcattcattccttaataatggttttctagactgtgggttacagatgctcccttccatcctcagtcacccttgaaaatatgttgaattacatcttacactttgccttagattagcgtttgttactatgaaagaaagaaagattttctgcctttcacagcctggatcctactcactgagactataggctgtcagaatgctacatgctcccagccctttaactcttttcactctgctatggccacaactggaatacaccttttcctcaattacaaaagccacacaagattctacctgcagcctcagtacacttcaacaattctcttattagtccttttgtaaacttactacctaagattttgcagtccctttgatgtctatatatcttgccaatctatcacttgaaggtgcctgttttactccaatgacaaaaaaaatccaatctaatattttttcaccttttctttctctgcctcagagttgataatacttacctttgtcactttcgtctcacctaggtccaggcatgagcatagccctgcttcatttcaacttagcctatctttatggccttcaggtctcctctcatctggaattgagttctgtagattttgtcctgtatgcccataatccactaaatagtgttcccattgttttcaaatataattcacaggggtaaagatagaaaatgtattttttagggctttttctaacaattatattttccatggaatgctgaagtcccacaaggaattctgaggcccaggtaaggaagaagaattagggaagacacaccagtgggaggttgcctagggcacaccaaaccattgcaaaagtatagtaaatccaggccaatccacaggtgagattgagactacagaatacattgttctttggttagaattggcttaacaacaagtcaatgacctaagctagggtaggcataagctggcgtgtcttatctcttatgcaaaattgtaagttctccgagaatagtcttccacacttagcatattacttctattacacattttaaaagataattttgattgtatgggttaagttaaatgtactccatgctcaacgttaattgatgaacacatatctattaagcactattgtggaaaatctatttggtgaggatacacaggaactccaaggaagggtaagacctttattctgcattctaggagtctgtaacatagctgaggagaagaaacacccagtaaaaatgtgtcactgaaacttaaacaaattatttaacttccttaaaaagtagtttttaatatgaaaaatgggagattaaagttggtcttctaggttccttagaattctagaactccaagtaaactagatatacatgtgtccatacttatgtcagatgggtgctatccacagtaggtgctacagttatgcagaaaataaagagatatctggaaactggggtagatatacattcatggaggtgttggagtttgaactgagccttaaaggaatagtcttggaaggaaaaattattatccatcactgaataacgtgggcaaaagtacagggaaaatacatctctacttttttttgttgttgttggggcaggcttcagccaaaagagcatttggaattgtctcgacttttccctgctctagacttctcctgtctctgcacatttgtttctgcattttcagaatctagctattttagtgtaccaaatctcttaaaaggacctgtattcattgtgatacaacccctataggaacttgagataatcagaatttcaagagaaaattatagtttcttggtgcctgaactgacccaacctcatgggtttaggatactaatcagtggttccctggatcagttatctgatcctgtcaccaatcaaggacaggactgtcacgtctcaaaatactactttttcaaggggaagaatatttctcctttagtatgtctcagcggaggtggaaaatgcaaataacctttttaggagccctttaaacacatagactcctcacttagggcccaattagtaggaacaaccaacctactctacaaggttttactcttcccttgaaattacacttcaaaaaaacatgcactgactccccccaggcatagaagcaggatccgtgttttaattctaaccttaattaaatctttacacaaactcactatttggctgtccaatgaagaagggcaagtagaaggaaggaagtgaagagcatttgctcttcctctgtcttccgtgagggttatatacccaaaactctctgtcttaatttggaatagggggaattagattttgtcataaagtcataagagttgtgttataagagtacgtgtatacagtagttgaaatgagtgcccagaaatcttcctagtttcttccccacctgtcatggagtttcattgtattaccttgcacttaacaaagccaaatcattgaaagatacagtccctccatgaacaacaatcaattctgtaactgatccttacccatctatttcaataccatgcataatgacactatcctttggaatgcagggaaaaaaattccaaatgacaatttgtcttaaatgtagacagtgctttaaaatatatgcctgatcataagagtggatatagtatttaagtgtgtcagaactttcttgctcttctaccttcctcctttttggttattgttgaaaatatatggggaaaaaatggcaaaagaaataggccctacatctgaattttaagttcctgttttttgagagaaagaaatattttgtttattttatttgttttttttttctttcccattagtaaaataattccaactaaggtaaagtttagtggaactaaacttttactgtgtgcaactctgactttcaagagtaaaaggaaagtaaatgtaataccccagtacacctaaaaccaggattaatgttttactttatcttgcaacagtactaaaattaaaagcaaaacaagacacattttagatatgatacagtgagcactagagaaaacctcttttattgatgggagcatattttaaaatatcttctcacctttagtctttgggttagtctcagtccctctgcatagggagcaaacaatacatgaagaactatttgggggaaattgctataaagaaacaataacttgctagggaaaaaaaaaacaattaactgtgaagcatgtatccctgaatctgaatcatggccataatacttattagtcccccaaatttgagcttccattgccttacttgtagaatggagaaaaaaaattcctcttgaggtgtcagtaaaagaagatgaatgtatccctcatgtttattctgatcagattatttttattttttgccttatggcatttacctttaacaattttgaatatctctgaaagaaagggagaaaggatggaaggtacgaaggagggtgaaaaggaaggaaggaaggaaaggtctttgttttccttacctggcacagctaaatattggcaaatcacaatagatagcaaaaatctaaaatacctaggagtacatttaacaagaatttatatttttaaactataaaaatgaataaatactatctaaatcaaagactatggttttgagtggtgacaatttaatatcaaagtaattccccactacatttctaagtaaaatctccctctggtgtctttttcttaatttcccagtgttcttaaaattcctatggaagaataaatatctgaggatagccaaggaaaatataagtaagaagactttgagtaagaactatgctttataattctaatataaaaccattgtaataaaaaataatgtatgaacctggcatgaaaagtgggcaaatagattaaaggacaagaattgtagctcagaaattttccccagcatacatggaaatttaatcacttccaaagctgttatcacaatttagtggagagatggaaagtgtttttttggcaaatggtagaaagataaccaaccatccatatagaagaaaataatgttggtgcctatctcacatcataaacagaaataaattccaagtgaattgaagacttaaagtttaaaaaattattaaaaatattggaagaaaatttggactagagatacaatctagtgattggttgaaacattgctaaccaaaacaagaatcctatatgctataatcttaagagaaaaaaggtcaacatataaaaagtttaagagaaatttaggccaggcacggtggctcaatcctgtaatctcagcactttgtaaggccaatgtgggaggatcacttgagcccaggagttggagaccagcctgggcgacatgatgagaccctatctttacacaggcacacacgcacatagctgggcatggtagtgtgtgcctgtagtctcagctattcagaagactgaggtaggagggctgcttgagccaggaggtaaaggctacagtgggccgtgttcatgcccctgcactccagcctaggtgacagagcaagaccttgtctcaaaaaaaaaaaaaaaaaaaaaaattacaataaaagatatcattgccaaattcaatatgtaaattatatatttggaaatgtaataaaatgtgtccatgagaattacaagtagttataaccaaaaacccaagtaactgtggcttggacaaattaggtgtcttaatttttgacatgtaataagaagttggaaggtaggcaatccagacctcatacaatgactccatgtggtaatcacaaactgagctcattctacctgtctccttagctgtcctgactatataggctttcatcctcatatttgtcacttcatgttcactgaatggcttctccaccttaaggcaggaaataaaagaaaacaggaaggtgaaagcaaaaaatgtatatgtgggctaagtttgtatcttttaaaagaagagacccagaagtctcttctagtaaattatggttatatatctttatccataaatgtgtctatcccagttgcaaggacaactggttaatatgatttgttttgtaattgtttttgtttctctaatctgggcatatttgcaactttagcattagagttattttactatggggagaagggcaatattaattccagaaaggtggctagcagtgcctgccacacaaatgaaggtagcgttaatgtctagactctacctaaaatttttgcaaattgataactgaggaaaacaacccaatagaaaaattggtgataaatatgaataaacaattcacagaagaaaaaattcagattatccttaaaccaatgaaaagatgcccaacctccttcatcgtcagacaatttcaaatttaagtaacaatgagatgttttgtattcatatgattggcatgaatttaaaagtgtggtaactcctattgccgtttgagatgtagaaaaattttaaattgttacagcttttttttaaaaaagattaacttttgaatggcagtttctattgaaagttttatatatatatatatatacacacacatatatatgctttgatcagaaatcctaattatgagactctcatagaaataaaaataccagtatctagctatacatacccaatattgcatcatattttgcggtggtttaaaaaaaaaaaaagaggaaagattaagtaaatgttcactaatagaaaaatggaattaagtaaattatagtaaatccctatcagggactattatgcagtcattttgcagaatggacttgatctgtcttcatctaaagcagatgacttagaaatatttccacaatgtattgttaagtgaggaaatgagatagtaatggagaaagataagaatgatgcaggttattaatctgggtggccagcgcttggagagaggaaggggagcaataggggaatatggaatggggaaagcaaaagaaatcaaattttagatatgtacacaagtaaaataacttagaattcagatttcctttttttttttttttttctgaggcggagtctctctctgttgcccaggctggagtgcagtggtgccatctcggctcactgcaagctccgtctcccgggttcacgccattctcctgcctcagcctcccgagtagctgggactacaggcgcccaccaccatatgcggctaattttttgtatttgtactagagacagggtttcactgtgttagccaggatgctctcgatctcctgacctcgtgatccgcctgcctcggcctcccaaagtgctgggattacaggcatgagccaccgtgcccagcccagatttcttttttaaaagacctgaaataaggaagagaaatcatagcataaactaagtttaacaagatcagtgtgggataaagaacagaagattgagaatttttttggagctgttcctgattagatgttagaagattttggttatcaccaatccttttcagagaaaaattttataaacttacaagtatccattgcacgtgctttacatttgttttatatcaatatgactgtaaactttatagagatctttttaatacatgaataggacatcttatttttaaggcaggtaaatgtgctttttctcacttcaaacaaattatgtccacaagctgaataatgagaagggtacttcatagtgtatcacactgccgaattacacgttcactgttttcatccttgaaaaccgtgggctgcttcagagtgggaaacagtcttcactgcttataactgagttccagaattttcccagccatctgattcccaagcccagagcttcggcttctgggttctgttgctggcagtgaggaagtgggatagcacattgtttaaatcacagcacttctctgtttcctggctaagttacaaaacagtgttgtagtcgtgaaactgaatatcatcagcacacatttgtggcatgcacagagcatgcacgactctgtagtagcgctctaggcaagcttatgatggcttttaaaagaggtgttgttgcttcctttaggaagtttatgaactaaaggaagacaaaaaccaaaccaaaccaaacagaaagcaatgcattggactttccatcacagcaattacatgtctgattctgggctttgtgcctattaatactcagtaatatccattgaatatgtgaacgaaccaaccacgttaacaggaactgtactgttatagcaattcttaactggaagttttgtcttctgcctcactccactagaatctatctccatccagttgaatgcaaatctgataatatttttttcctatggtttccagatagctttaggaatcagaaagaggcactgattgtaaacctgaaagtgtgctttgtggagcctgcatgatgttttaaataattgaattagaatgccttttaatgagcggcacactctctagttttcccacagaaaacctctagcctatggtgttgaataggtgatcccccagctacaggataaaatcccaactcctcagtgatgtacagactcttcccactttatcccttgcttattatttcagtcttgagtcccaccattttgctatatgcaaccggcactctagccatgctggattgtttgctgtttcctgaatatgctgtgctcgttcagtcctctgcaaatgtacttatgctacttctttctcctgaattgcttattctgtctcattaacctagtgtactccctcctacccattcatgttcaattaaaatattactgccctcataatatcatttttaactgacctagaaaaacaagttagatattcacatcttcaatattccatctatttatcaattgttgcactttttatattgatacttatctgactcttcacccatcagaaagatggagttctctctttgtacaccttgcacctatcactggcttcatcacaggatccctatcacagtctttttgatgaagcattgttggatggatagatggatgcatggactaggtgataaatgaatgatgaaccattaagtgaaataaggagtgtggtatagacttggaaaagaaaagttactgttgaaatagctctagagaaaaatattttttaagagttgtataggataagatgaaggtgaggatgacttatctataattttatctttggaaattgtgagttaacatttgtaaacagggtggatattttggagagaaggtgctacataactacagcacaattatttattatcctctaaaatagtccctttctttggcatgtttaaaacctaaagtctggttggcgttataaatatgcatgagctgttgggggaagagagcataaagtgtgaatcacacttcaaacagacccacccgctcactcccgacttcaagtttttcagaagtgtgaaatgaaaatgctttaaaattagaaaatgtgccatcagaacttttatcagccctcggagaaaataaataatctctaaatgtggggaatgctggggatatttatttagttagtttcacagctaagatgctttgataaatttttgtgtcataaaatgcacaaattaattttaatgaatgtggaaacaaataacttctaaaacagcctgagtacccaaggctgcaatctagggtttctgagggattattgaaacctaatctatggacaaattgtctcaatggggaaaagaaactcttacaggtgtctttccctctgatacatttgcatttgaagggtgatcttgtagcatttgaggagtgggtgaatttctggaaagagacacttggatcttaaattgctaaatggtaacgaaaatgagagaaaatagtacagttagctgtttgctttcgagtttgtggaaagtgattttctaatcaatgttactcttgatttcttaagcataacaagattaaaatgagtgtgaatataaaagatcatgataaaagataaaggatgatgacctgagatcttctttattttttattactaatttgtttgaagaatagtccatcatttccagtaactttttgaccaaaaaaatggctatgtggttgttgccatcaaggccagtaatagagaagagggacaaagagagaggtgctccattggtatcctcaacctgtgtgtagtacataggcatcactgggtgggctggagctagcccagatggctgggctccacccaggtttcctgatgcagtatgcctggggttgggcagcctgagttgcatttgtcataccctcccaggtgatactgatgcacactttgagaaacactgctctgttccaatacttacatgcaatttttttaaaaaaattatgtaatgaccatctgtggttaaatgctgagctcattttataaaccttaagcgtcttggcaagtgtctctgtcttttttttaattgtctgataatttaaaataccattttattagcctactattgtggaagttgaaactctattatattcactctgttattgttaaccacctcacattttctgtggtatcgtagaacagaaattgttctaaaggaatggaaaaacaacatttactttcatcaaattgttgtctagcctcttgattgagttatagctattgttactaatttattgctagtttttacaacatgcccatgatttttttctgtttcagactgaaagtaaatctgaatagatgaaatctaatttaagtacatgctgttaggttctgtgttttgggggatagattaaaaatacaagagaaagcacaagacaacatgatctctcacatgtatacatatgttcaactgcatgtcttttgttgataatctccaaaacatacatattttgacttcagtaccataccagatactggaaaccaagtgataagatgactttactctgggatgtgaatgtcattgagtcagcagctttctaccaaatcattaatctctgcccaggtccaaattgcttcagtgattttcctaccactcagcattttccttggtgaaggacccttccaatacaagtcttctggcttttctttctactagagggaaggctttctctcagcagctatttctaaaatgaggctgatgatgagagtgatagatgaaaaaactcatctctgaggtttgtcttcttcttgcatctgctgatagcactcacttctcagctcctctttatacctaaaagatgtgcttctctattatttcaataattctgatgctgctcattctttacttattttcagagatgtttatgagatttcaagctccttaactagacatatacaaagagcaagaaaacaacaacaacaaaaaattctccctggtcttttctggaactaacaatagaatacttgaccaagaaccaagattgcagactatctcagtgttagtggaaccatttcacttctcgatgttttcttataaaacacacagtttgagctgtattgttaatctacttggaaagatattatcattttttaaaacaaatatctgctgggtgagtgttaggcaatggctctcaaagtgtagtcccaggaccagcagcattagcaaattcccagttcccacctcaaacctgctgagtctgaaactctaggggaggaacccagcaatttgcgtttcaacaagccctcccagatgattctgatgttatagcaattcttaacttgcttaagaatttggaaagtcttacaaataagggcaggactgggtggagaaaatggagaggtctgattatctttcatgtaatccccacataatttggtgtctgcaggagacacttttatttgtttgctataaataactgggagcttgccagtggtgaagaagatatccagagaacattgtgaatatatacttagtttctccaacctggacagaccaggagcctttatgtcaagatcctgcacggataattcccctcaggtggagagctggtggtttttccaagcacccagccacaactgccactgcattctatttctttaatgctcaatcagtgcccctggccatttgatgatcattcctccctaatgttgtgaggtatttagtccaaatagtacaatccatgtttgctttctttctcttctagtaaaatgtataggttgctgtaatagcctgtgtctgccccagaccacaatcataaaaataataataaattacctcgctgtctctgggttttctttcaggctcaacatgtggtttgtggcttatggggtattgattgtgcattatcagtttagctcacacactgacaattacatgtagcgccaaggtagccgtgacaatgtagtccagttgccatagcaatgaaagaaggcctattgctgctacctgcaacctgctttatagtgataaacgtgctgcttatttcattttaattgaaatttgaaatcatagtctctagcaagaaataaatggactcattccccatttttcccccttggccacacaaaaacaagtattagtaggaaatatctgagcatttttaaaaagtaaatatcaaatttttgacagtatgttttccagtagtttcactggtactagaaacagatgaagagtgatactttgctgaataaaaattgaattagctctcatgtttttgcattcttaattaactgctattttttatttccctaagtccctcatcttaacagcttaccctgcatggtgtactttatataacagagactttaatggatttacttgctgagtttagttcatatctaaaaactcacagcagatatcataaggtacttgaaaattagaatcacagggcgctgtggaagcttttacataattgaaaaaattgataataataataaatatttagccatgtacggtttcacttctatgccagtgcctcatctatgcctcagacctaataatctttatgtgacgtcattactacgtactacagtcatatacaatctatagtgctatatgtagccaagagagagagatactgtgaaatatggtcaggaatgaagagattctatgtcagtcagtccaaaaaagatagaaatttagtacagaaaaccaaccaactatggaaatgaatagtaagatagtaactaaatatgtatagatgtgtgtatatgtatgtgtctgtgtgcatatatatatatatatatatatatatgcacacacacataggcatgaagtgccaaactatttttaaaagtatgaacttggtctataaagattctaaataggtcagtggaagactgggtcaaatctgagattccactttgaccttttgatctttatctgaaagaagtcagatgatttcccttttctggtacaagcctgtaagttagcacaacattttatttccctggactatgtgaagtatatagtagatatttaggacagagagaaacctatggtggggagtaaaatttaactagggtaatataaaatataggatctccccttaaagagcttatgatgacatgtggctgggcacggtggctcacgcctgtaatcccagcactttgggaggccaaggcaggcggatcgcttgaagacaggagttcaagacaagcctggccaacatgatgaaaacccgtctctactaaaaacacaaaaattagccgggcggatgagggttcctataatcccagctacttgggaggctgaaacacgagaatcgcttgaacccaggaggcggaggatgcaatcagccaagatcgcgtcactgcattccagtcctgggcaacagagtgtgaccctgtctcaaaaaaaaaaaaaaaaaaaatcttatgataacatgaaaacttatttttttataaagtgacctcagaaaatgtgcacagggtggggcatctcatgtgaaaagcatctcaatcattgattccagccacatgccatcataagcgctttaaggagagatcctatattttatattaccctcattaaatcttactccccaccataggtttctctctgtcctaaatatctgcttttagaaggagtaaacatgacttgggaattagatggctcccatctgtgaaaatggattcttaccagtggtgttttttgggtggttgggttataataaaaaggaaaatattatttcccttatattttagtctttcttcttactcctagttataatcatggtcctccaaataattatgatgataataaaatgatcaatatcatgtttaatttattttatgtccttattaatacttactgagtacctagcatgtgtgaagacgatattctaagtcagcagtccccaaccttttggcaccagggaccagtttcaccgaagataatttttccatggactggggttgggggatggtttggggatgattcaagtacattacatttattgtgtaatttatttctattattactatactgtaattatataatgaaataattatacaactcaccataatgttgaatgagtcggagccctgagcttgttttcctgcaactagatagtcccatatggtggtgatgacagacagtgacagatcatcaggtattaggttctcatgaggaacgtgcaacctagatccctagtatgcacagttcacaatagggttcacgcttctgtgagaatctaatgctgccactgatctgacaggaggcagagctcaggcagtaatgcgaggagtggggagcggctgtaaatacagatgaagctttgcttgctcacctgctgctcacctcctgctgtgtggccccagtttctaacgggccacagaccagtactggcctttggccacgggtttggagaccccttttctaagtgttaagacaagacttggaccttcatggaacctatattctagtaggattaagacaggcattaaacaagtaattacacaataaattacttaagttcaattataatgaaaaatactagattctacaagaaattataaaatctactataaaattctttagtgttgttagcagataatttactcaccatttaaaaattatatcattgattaaatcaattttaaaatgggaagtgactttgagaaacagacttactacaaacagacacataaagaaaaatctggtacatgttaaagagaaatattgctataaaatcagaatacattatatgaagtctacatttgaattatgccatgtgtcaagtttgttaagcatataggtaagatgtaattattattttgctcttgatctacttttattttttatacccttaattctaaacctttggattgtattgaactttaaaatacatatatttgattcatttaattttaaataattgaaattattatcaaaacctcattgctctgcttgaagcagtagctctacttccctatacttcagtttttcatgtgttatagcaagatctgtactagaattagccagttcaacccaaccacatctttctgtttcgtccttgccttgactgttaattagctcagtggatttttatgtcatgaatgcatttgttttctaatacatcttcattttaatgtaagatggttgaaaagaaggaccaagtcctctgagaaccccatagtacaaagtaaaatgcctcacatctgacaaatgctcagtaaacatgagtagtgggaaatcttgattatatgctcattaaaaatatatctatgtatttaaagtagtaagtctggtgttcaaaaggtaaaaccttcaaaattctaacacagttcttgtttggattaactctagtctataatcacaactcttctgtttccttgtctgcactgtgctcacataatggctatgtctcttaccgccaaagcccggctcactgcttacaacggcatcctgtttcttcacctgtttttcttttgcttacctgacaagctcttgcattcataaaagtcgaaaggattccagcttaacgtttcaatcccacaaagttgacttccatagcgtagcctggaacaccttgtctgtgaatagatatggaatcctcaaatggttttgaagccactaccagcaacaggtctgagatcataggacccaagaagaaaattgaggctggggaaccacagagagtctttccacaattcaaagtaataacaaagcagccacaacagcagaggtggggagagatgtaggcatcagattgcctagagctctaacaacctaccctccacatagaagctgctctctgcttcaggcttcagatccttaaatatgggtggggtccttcatttagtgtcaaagaattgattagaaagctcctgcaatgtaagctcattaatgaaaccattttggcaggccagatgatataattagcccaaacaagatatgaaatctacagtgttttgggcaactgttcagtaatttttaattttgtaataaaaaagacaaggaaaggaaacagcaagagaagatgattcatgcttattggtgaaaaagaataagatataaagaaaaagattccaagataacatttgctagatgtggatagtaccttcaggtttccatcatccttctgaagacagtagcatttacaaaaactgtatcatctctacctttacaaaagtaggtgctatgtcaatagtgtgtttataggatgcatggatattcttcaaaccaaagtataatcacaaattctggtctcgtcacagacattcatttaaggaacatctccctcccctgcccccatgctaacctgagctttctggaggatgataaaggcgacctgaataatgaagtacccaagtctcactactgaggcgagtcaggggtaaagagtttagcactgagtggctgaggatacgtatcaagggaaaatgtcatccttgggacttctctttaaataccagaatatgttttgttttgttttgatttgttttcctatcagggatgtgtctttattggcaatccctaatggaaattgctctctaattttcctctagtcttcttatttgtattgtttgtatatgaaaagatgagatgaatagttaagggtactgcacaaatactttgcttggtcctataggctctcaggtttttttgatatcatgtggcatttgtgtcaaattgagttgtgctgtaattttattaacaagcttcacatctcagaatattttacagagatgcacctaacacagttgacatgttgtctattaaaagttacatcatcttaagaagttattagtccttttaaacatcattttcattctaataagctattttttatttctaataagctatttcttatttctaataaactattttttatttctaataagctcgtgtcttgagcagaaacactaatacccaggaaattttctgaggactggctcacttaaaatgaagggaagtcactccacgctctgagttgtcttctctcatcttcttcatgtgaaatcctggacacttgcagattcatgacaattcagagattattaatccaattgcttttaataaagactgtcctgaaagatacacatggtgaaacattctaattgtaaaagattcatagagcaaacaattctgtaacatctatttccatatgatttgagcaatttcacacttgggaatttttttttttttttttagatggagtcttgcactgttgcccaggctggagtgcagtggcacaatcttggctcactgcaagctccagctcctgggttcacgccattctcctgcctcagcctcccgagtagctgggactacaggcgcccgccaccacgcccggctaattttttgtatttttagtagagacagggtttcaccatgttagccaggatggtctcgatctcctgacctcgtgatccgcccaccttggcctcccaaaatgctgggattacaggcgtgagccaccaccgtacccggcccatacttgggaatttttactacagctgactgaaattttttatttgaatcctattttatatatgaggatactatttcttctttacagcattaaattttctagattaaaaaatactcatttccccccaagattttataaaataatttctggcacttctctaggttttctagctgtatgctattttgagatgacttggagtcaaactgtctgggttgaatcaaggctgtccccaccagttactgtctgtctgaccttgagaagttatttaacctctcagtgtggagatgttcatggtacatatctcatagggtttctgagtggataaaatgttctgatacatgcaaaatagttagaatagtatttgcctggcataccttaagcactcagtaaattatagccattctattttattccattccatgttaatggttcaacatgaaatagaattgcatccaaacaaatcgtgacgtcaagggtgttacctgaaaaaaaaaggtgtttcttacttaaatatattaagtaaatatagggttgtgtacaaattttaaaattttgctttactgtgggacttttagaccttttcatatataaatatgtattgtgtatatccaacgtggctaacatgccatgtctctctcttttttatgaatcacccactaacatctccagtgaatcaaatttggaaacaatgggcagtcacaataagatacatgtctgaaaacccaaagttgattttttcatgctttcagtaattacattgaagttgtcccaaaggcagaagaaagaaaaagaaatcaagtctccaaaatttctctatcctttagaaagaaactccaccttaatttttggtgaggagtaacagatctcacttgggtggtagttacattttgtgatgtgagggtgtcagctttttctccaaggatgacctcccaagaagggcagggtcactcacttctgctacacttcccagctgtctcttttggctttgcacattcctgtctcatgactctacagggaaatccatgatgtagattttcctgtattcaagcaggcaaagatacgggtcaaacatttaaggccgttaacaagaagttaaatcagcaacaacatttatatagaggcattaattcagggtgaacgcaaaatgtgttgcagcatcgattctggcatttttctctgctcctaatagctctgagcatttgatctatatgttatatggacctaaatgaagggaaataaacatctggacagattccttccaatcgagtttccttcttaccatttttctgctgtgatagttaaccaaggccatgggcttcgttcacctagaaccagcctaaaattaaggatgctggccagagtacccaagtgtgatgcttgtagcatttaagcatacagataaattctttttgaaaaatttcaaacaagtgtaccatgagcggagtcagagcccctcttgaaagcaggttggtaaatttccagaaccacttagcagttttcataggtggcaaggcattgtattgttatttttattattgttaggagctaacatttgtttccaggaactgggctaaatggttcaaattcattatctcatttaatctttacaatatttctgtgaggtagaaagtattgttatctccattttagagatagcagttatagaagaggcatctggagctaaaacagattaaatgaccttttccctcaggttcagagtaagtgtcatattgcaccccagaataattctgtgctcaccataatgatttacccttctaaaaggtaatataatgcaatttcagaaattaatgattcttaaaaatgtgtaagcatgcagtgagccgagattgcgccactgcactccagcctgggcgacagagcgagactccgtctcaaaaaaaaaaaaaaaaaaaaaaaaaaatgtgtaagcataagaaaaaatagcgaatgtccttttctagcatcacactagattttacgggtgattacaggaagacccttttgagattttcagcaatggacttttcttggatgagacggaagatgctctcagctggtgtgactaaattgtttgcgacttgaggacatgggtcatgccctctgtgtgtaccactcactatatcctcatcacagttcctgcataaagcagagattcagaagggtcagtcgagaacatggatgacaacccaacactgtaacccagcagcttgtgtcttggtgtaacattggtaggttttgtttgcctttacatttttaccataagaggtcaactagagtttctatcttgttacaagttcattacacaggtatcccttattccttcattcaacattgcaaagaaaacatctgtaacatgctttgagtcattaagagacattgcatacagtcaaaaaatagcatgaatttattaaattcagtactttggctgataaattgagaggaaacctttattgcaatttggtggtgatagtggagagtctctttccaaatataagacctagcattaagaagtatttccaagtctcctattttaggaatctcaaatctctaaattcgagatatgtggaaaaaataggcaattttcaagaaaatttgtgttgctgctagccctttggcttgtacaatacatatttttttttttagaatatactggaaagatgaaatctctaataggtatctttctggagaacagtctttatagcaaggttttctttacacagagcaaccatgcacatgtagttaatggatctccagacaaaggccatttcttccctaaaacaaagccaacaaggcaattgagccaagtaacttcaaactccccagaggggacagcagccattcttaaatccaccatacttttgaatagctatcattggtcattatcttccaaatggctttgtaagtgtctaggcataatgtgattgctttggaaattctccatttttcagggtgctgggaaggacatgaacagacacttctcaaaagaagacatttatgcagccaaaaaacacatgaaaaagtgctcaccatcactggccatcagagaaatgcaaatcaaaaccacaatgagataccatctcacaccagttagaatggcaatcattaaaaagtcaggaaacaacaggtgatggagaggatgtggagaaataggaacacttttacactgtcggtgggactgtaaactagttcaacccttgtggaagtcagtgtggcgattcttcagggatctagaactagaaataccatttgacccagccatcccattactgggtatatacccaaaggactataaatcacgctgctataaagacacacgcacacatatgtttattgcggcactattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaactggaaatcatcattctcagtaaactatcacaagaacaaaaaaccaaacaccatgtattctcactcataggtggtaattgaacaatgagaacacatgaacacaggaaggggaacatcacactctggggactgttgtggggtggggggaggggggagggatagctttaggagatatacctaatgctaaatggcgagttaatgggtgcagcacaccagcatggcacatggttacatgtgtaactaacctgcacattgtgcacatgtaccctagaacttgaagtataatttaaaaaaaaaaaagtccctttcttctttatctcttcctccctgcccctttcactgttctgcccaacacaaagttcaagtcgtctagagacgaatatggcttttgcttttgtagggactttttcctgagtcccttcctagcagggtacatgcaatataggcctgtgagaataactttctgcggtgacacagaacagtgaaaactgtaagtcagtctatggtgagtgcaatcctacattatttcatgcataaaaaagtcatacatctgtatacatatataacctatttcacagtaacaataaaaacatatttatcgattcatcagaggatagacagatttgtgtgtctatccaaatgtattacactgtgatttttttcttccttgagaaagatttccctgaagacaatatttatggcagggcaggaatttatattacacttgaatatatgttctgacaaagaagcacattgcattttggaattgggtgatattggacattcttcaaaaaatcttctaaagggaaagaatgtttcatctactcatttgttcagatttccctataatttttagccagcagtcctttatggatcagatattgcatcaaaaaagaaggggaaaatattcttgtcatggagacattttcagattaagttgaaaaggtccataatccttacggaaattttttttttaatcatcatcaggctattcttgacagtcagtaaaatatcaggtctttctcatttaactgacagatttcttctttttgctttctttcttccctctctgtatctatatctactctctttccagggctcacggcatatagtaagtattgaaaaaatgaatttaagtctaacttatacatacttgtgaaacctcattccttatgataaagaccttaagcttttctaaatgcagaatcagccactggtcatttttaatggacacgtagtggttgctattttctggagtgcaggattcattagggtcattgctggcatttggctatgttcagttgccccggtgtgctactgaaggcaagtgtccaaacgccaataatgtttggtttctctcgatattccgaggttatatatcaaaagaagccgtgtgtatggcttccagttacccatccagagaattcctgaaaaaagcaaattattcttaagatcccctggaattatgaatctcttggtggagatgcatggtagggaaaagggaaacttgatctggtttattctgaaccctttcttctcatcttatccttctactaagtcacttgaaaactgttaagaaggagaacatataggcattatgaaagaaactatgttgtagcagaattcttcaaggtctcaggatttacccttataaaaactgtacataatctaaagcataatagccaaaacaattcagtatgaatcagacgtacacatacataattgtctcattgagtttcccatctccactaagtcatggtcactgttttgccttggttatggtaactaaaagccaatggagattaacggaaagccccccaggagaaaatactcttttgcggtctttggatgaaggcctgagtatcagcaggactggagttctaaagaaactgctatgcccattgcatgagacacatgaagtaatgaactatagacaagtcatcataccagtatttcagaaagtgaaactgatataagaacacaggccagacaccaactcaaacaaactatggaagcagggagagcaaactgaaatacaaaggcatggccagtagccagagcaggagtgcctcagaaattgatgatagatgaagacaatttatgtagcagttcgtctaatggcagttctgcagggaggcatccttttgaaggtgatggctcaggttggcctacatgttcctgcccaattttaaaggtgtcataagccagtgtaattggggatctgtctggcttctgacttcttgcataactatgttcccacttacattggggtcttggcataatttgtctcctgacaaagagaaaatagaaaatatccaaatattccagccttatagcatagatgggtaaatataagacctttccttttagcattgatgacagtaaacacaattaatagctttctatttgccaggcatgtgacatacgactctgaaatcttgcaacaacccagttagaacgacttactaagacttgaagttaagtttgcctaaatgtatacagcaggtgattaaaatatggatttaactgctgatttgttcatatttaagatccttgacctttccactgttataatagtacatattgatattccactggcgatgagtaagcatgccttaccacttcacaaatagataaggtggcttctaagaaaatctcaaatagaggtggtcaggaagccacaggaccaaccaagaacccagaaacgacagtgcttactagatgctgcttgcattctaccatgtggatacaatgagtaaaacttgggtactaaagtcaaagtgcctgccaccacacctggctaatatttgtatttttagcagagatggggtttcaccatattggccaggctggcctggaactcctgaccttgtgatctgcccacctcggcctcccaaagtgctgggattacagatcccaactggattgggatcttagcacttacttgctgtataacttctccaggttactgatcatctctaagtctttgattcttgttctgtaaaatatgataatagtaggaataataatagtgccttctttagagatagttgtcaagattaaagtgcttagctcagtgcttgacatagggtaaatattcaacctatagtcaatcatcttaagtactcttgtctcaccgaggaaccatcaggaggtgtaggtaatatgcaaccttgaattagatgtaataaaatggaccccacaggaagtatttggggatattttaggcatattttccagtacacatatgcaatattagataatattttccaaaccaatgctatttaacctcaaatccagcacagtgaaaaaacattgaaaggtaaaagaaaaagtcacttcacttccatagttctcagaattaccatgtagatatcaaaaggtctcttccaactctgaaagtctgtgactaattttgttaaacccctactgtgtgcaaagtttgtcactgggacgaataaggttgacactctcagagaagcaatatgtaaaaagacatgtacaattctcttaatttttttttttttttttttttttgagacagagtctcgctctgtcacccaagctggagtgcagtggcatgatctcagctcactgcaaactccacctcccgggttcaagagattctcctgccccagcctcctgagtagctgggagtacaggcacctgccaccacacctggctagtatttgtatttttagtagagacagggtttcaccatattggccaggctggtctcaaactcctgaccttgtaatctgcctgcctcggcctcccaaagtgctgggattacaggcgtgagccaccacgcctggctatgtacaattcttaaaataagctaaagtgataaacttaccctatggctttgtcatagaagggttttaaagacaaaaaaaaaaattgaaaaaaattgaacttctgagaagaatggtgatattatagatatgctatagcctctaaataagaatagtgatgtttaaaggaatataaattaaagagaacactaaagggaaaagagagatggattttaccctctggatctgactttggttttaaattgcataggcaagagattggttagagagatttatttcaacctttagtagtgtattagcagtgtcacagaacaagggatatggttaaaagaaagaaggtgagaaatgcgaacaaacaagatagtgtcttggaatctgatttatttaaatttagattatattgctgttgcattaatctttgtataaatcatagttctaagcacattaaacttacgttgcagtcaatttttaattttgcaaaccttaaccgatgtttattattataagctgtgaacatttttttaatcattgagaaggcccctctcaagtgaaattttggttccaaatggccaaagtaactaatgggcagggaaaaaaatctgcttaaactctcatttcaatcacagttatgtggaaacatcttgaagacaacagtaaaggaaagagaaagaaatcaggtggatggagaagatacactagaggaatgagatctcctacatgagtaaagtgttttctaatgtgtttttcttgaatgatagcatcttgaatttcctacaaagtatggaatagtttacctctgactagcgctgccctacagaacaatgtcaatttattctaagactgcaatgttcagaatgcagatatgatcagttcaacccagatgagacaatcctataaatgtaataatagaaataactatttgaaacttgaaaatcagaagtgttttaactttcttcaaacacttagactataacaacatttttagtctaatgtaattagcgcaattttcagaggatatgtttatatcaagaatattcctgtgggagaaatagaaacttttaaggagaggtttctaggattcttagacaactaaaactttcgtttgactcagaccctgatattacattttcccaggattcctctcacttgtgctgttttcagtgattgctcaggttatttcgaatgatggcatacatatatcttctctgacatgcaaaaatgccagaaccttctttttcctccctctgttcccagaaagaactaagaacggtctagctttgagctaaattgtacagctgactgtttgttttgggaacttccaaatgaacatatttggtgttgcactggtgcatcccaggaacagaactgtctgaccagaagagcaattctgcttctggaaatttctagcacataagaagatagctggagggtatgtttgtctgtatagtttagaggctggctggtgctataaaggaaagtaagaaaaaggcaaagatatccttcagaggattcccccagaagaaagtagcagttatgaagttttattcctgaggtaggacaggcagtcagacccaagaggtctcagtgtctctccctgtgttggatgtaattgcttttcattgtcaatactgaaagaaggcacacaagagacaaatgaaatgtgtgtgtataaacctggctttggttttcagagacagtcttcttacaccttcagatctcctagatgagctgggccttacagaaaatacaagtcttgagctctatttgtttacagttttcaaattctcagcttctgcctgtaagatatctcatgtgattaactgatttttctaatttaagggagttattttctgtggaggaagaggctataaagtcacatttttatcttattttcttttttttttctctgatatttcttctctgttttccacattccttgtcactgtcaaaactggtaattaatcaagagttagtcatggatggctccttttccctccccttcttatccttcattttcctgcctgagtgataacgaatgatgtctcttgtcctgtacccctggcttcctctcctcagagcattcaagccagaccccatgacaagatgctcccagtgaagggagaaaactgggaatgacaaatgtgagtctgggaacccaggcatcaaggggtggacttcctgatctctaccacttgccatcatctatctctccatgtcaggaggcctttgggaaaagcagaaacaaaagagaaaggaaaagttctcatcccagcattttagcatcatgagaaacctggaagtacctttgcaatagcactaaaatatgatgagtcttgagtctttcccaaggttttgatacccaccagcccacgagtatacatgtaggcatacttttactctctactttctccagcttaatgtttttccaagtgtctggaggaaaataagagcaaacatctttgtaaaattggacacatctcttctttcattatatgattggtttatgtgtctgaacaccttaggactcagtctttactcttatttaactgaagagattaggggaaatacttcctcacccaccacagagtctgaaattctgctattagagactcatgcctttaggtgaaaatgttgcatctccaagaagacccatgaaaacagaagtgattctaggtagaatgaagatacaatataagctaatcgatgatatcctcctataaattcctttggcagatctatttactatggagatccctagtggagaggatggccttaaggaattgggaaataaaatagttaacttgagataggttgaaagagaaaataattcctgagaaaggaacacaatactgcttgaaaatagtactaatgtatttttacagattagtttttgctggttcctgaaccaaatgactagctgggacttcttattctcagatttgcctcacacccacttaagaaaaataccagattgacatcctcaagttataatctaaaatcccagggagggagcacactagtcaggggtgagattaaatgaggcaaaagtgactgcatcacatttcactgtctatagaggctattggcagatttatgcaggctgagttaagtgaatgacttgatagcctggatcacatctatatgtgtttttcacaggcatcatgtcttagttagttttatgttgccataacagaatgccccagactgggtaactcaaaatgaacagaaatttatttggctcacagttctggaggctgggaagtcttagtgcatgaaactgacatctgacatgggcctttgtgctacatgatcccatggtgaaagttatcacatggcaagagagcatgggagagagccaaactcaattttataaccaactcacttctgtaataatgacactgatccattcatgagaacagagccctcatgacctaatcaccttttaaaggtcccattgttcaacactgttgcattgggaattaactttccaacacatgcactctgggggacacattcgaaccataccaaacatccactctgtagaatgttgcccttaatatgctgtgattgatatagatagatagatatagatatagatttttttttccttttcagtgtgttttagtatattagttgggtctcatttgcttgcttaaactgttgtatgaaaaaaaagaaatgtgctgcaaagatacagaggtatattgtgcagctcaaattaggtcaggaatgttattaatttaattagttatccatgcaatatgctgcataacaaacaaccacaatatctccagcagcacaggacaataaacacttatttcttatggagctgtgggttgcttgagggtcagctattgcagcttgagactggctaaatggctccactaatctcagctgggctcactcaagggtctgggggtcagttgaggttcaggttatataggctttgctcaggtgggctaggtcagctctattacacatctcttatcctatttctgggtccagcctgctagcttgggcaaattcttttctgtttctacaggttaattttggctggttactggaccaaatgtctctgtggaaattctccttctcaggtttgccttatatccacttaagaaaaatgccagattgacatcctcaagtcccagtctaaaaacttgggtaggtgcatggtagtcaggggatgaggtcaaattaggcaaatgtgacttcatagccctgctgtaaccagctggaaaataagagaatgaacagacaaaaatagacttgtaccacattaatgacatactgattatttgaattagttaattttgctaggagtagagataataagagtgtggttctcagttgctgcttaccccgaacaagagtcttagtaaattgaccagctgagtcatttgaacttgattcttggtaggaagacttttgcgtggcttatctactgttttttcttctctttttcttttcttactgtatctgtaatttctttttttttttaattccatgatttactggaaatctcaaaggatgtttgaatgaactctaattatccgttgtctttgttgtcgctgactccactgtcaaaaacccaagccaggcatccgcttggtttggtgaccttaaccacaatttgaaggctgctgactgatcagggcagtggttgcggaaggttggggtggcaaacaacaaagatgtttcccgcaaggaatttgagtcttcctttcatgaaagacttctttgtagcatgcgatgctatttgatagcattttacccactgtaggacagctttcaaaattgtagtcaatcctctcaaaccctgccattgctttttcaactaagtttatgtaatattctaaatcatttgttgtgatttcaacaatgttcacaacatcttcaccaggagtagattccatctgaagaaactactctttgctcatctataagaagcagctcctcatctgtttaagttttattatgagattgcagtaattcagtcccagtcccatcttcaggttccacttctgattccactctgccacacatttctctgtgagtctgttaaaatatggataatccaaataacttctttctaatgtgatttatatgaaatggaagcatgttctccttcccccttatgtgctcttgttttgaattgcaaatattcagttttgcatatatttaaaagttattttgacagtatgtaatgtagatttaaaacattctgaagttggctgttttcccttgatcaattcttcttttagaagaaacactgtaaataaaccaacaagtgtcagagcatacagtatagggaacagccaaggacaatctgttatgatattctgtgtattaaaaaccagtttgtttataccactaggagaatttcattttttagtatttggatttgatggatttagtgagaacgatatgatttgcttcattagacagctatgccacagctgaacgatgtgcattactcttaatgctaaagggagataaatgtaatgatagaaaaagttaagggaaccaaagaggcaatattcctagaataagcagatgaaaatttaactatgatgcacagaagttaaatgtcagtaattccattcaactaggtcagtggaattggggcaggaactttcttcattgtagcagtgaagctgttagctggtttacttagaaaccttgaatctgaggaatcatctccagagaacacctgatataagctacagttttcttgactcatattccaaaatggggattgaactgtgagaaagactacaagtaatttctgagttactgaacttagaaaaagcaaaactggccaggtgcggtggctcacgcctgtaatccagcactttgggaggccgagaaaggcggatcacgaagtcaggagatggagaccatcctggctaacatggtgaaaccctctctctactaaaaatacaaaaaaattatctgggcttggtgacatgcgcctgtagtcccagctactctagagactgaggcaggagaatcgcttgaaccctggaggcagaggttgcggtgagccaagatggcgccactgcgctccagcctgggcgacagtgagactgcgtctaaaaaaaaaaaaaagcaaaaccttgggacttctttctttcccttcttattttcacctttccttctcttccttcttctctttctacttcccttcttgtctctctatttttaccttattcatttcctctcgtgcctttccattttttatatcaggaattaaataccctctagagtgaaacgatgaataaaatctactagtcctgtgagaaggacaaaattaaatgtgttgggttgtgtttgtgattgtgctgatgacagcaaaagaagccacactgaggattgaagatgagaaaaaacaaactacaatgttcactaacgtaatttttaagggagaagatataaagattaccagagttcacactttcaaattgtttgcaatcaattgaaagtcgaaaaaagttatatgttgaacaacatatgagaaaaaagcaagtgaccatttaaggtgatatgtgttaagagcaaatcaactgatagagatagaaatgtggatgaggaagaccaccactattccctggggtagtcaaaggaaagttggcctggtactggattttggataacactgaataagattcaaacagacaaaccatggttggggcccagcttgagcaaaggatcagaagcagcagtattccagacatgtgagaatataaatttggttcaagtagaaaggtttcaaatggcagatgactgtggaaaaataatttggtgaaaacttataaaaggcccggaatgctgagatagaaccttgggttctattcagtatatattttgagaaccactgatggtcactatggagaagaaagacgtgtgctatataatagaacaagaattgagaggtcattgactgggggagtttcctagacccagagaagggtaagaagggatacattttgaaggctggtacataaagagaattaagatatcaatgagacatattttaaaagccaagagaaggagaggaaagtggtcattttcagttctgaaggtgagagttttgaggtttggatgactatgaaataacccagtgagaatacccatttatcagtgggaaatcctgaactagagtttgagagagtctgctaagctaaagttgtggatttgcacgttagcctcctgaagaggatggttgaattcataaatatggatgatactctacagaaaagaagtttgcttagaggatttggcatatccatgatgagagtataccggggaagcaaggaaacactgaagagagaaggggtggtcagaagaactgtagaagtggggcaatatgtggaatagtgagggtctcagaacagacagaggacctgggccttgaaggccagctgcgtcatctggagatgaagatggaaggaaatggggatcattgaggatgaagaagaaaaggagccctaaaggtctcttacagtcatcactttgtccgtagaaacacatctctgggaaggaatgagttaggtttttcttattctttcttcattaataaaaatagaaaaacaggtggtgaaacaaattggaaaacaatgtacacacaactaatactcttgaagaaagagatttcacactgtgtcctgctaacctgttctgatattcaatggcacttgttacccaggagttcttttttaaatcactatctgaaatccctattgctctcctgtgagctgtattttttttttttttttttttttttttttggctttcctctgtttatcctcaggggacagaaagaacatatggcaactatctctcaagtaataatccttcaattttggaaatacgtattatataagatttttcctctctagccttttattctttgagctaaataatactaagaaatttaggctttctttatggtcatttcttcccaggacaatggcacagactgagtcaaattcagttcctaggacttggataaaatttatattgaagccactgctttgaatcagcgagcagtactgatgtcaagtttgcctattaggtagaaattcaagaatgaaatgatgatgacccttttgggaacaactctgtgcatcctttgtatcctgagagcacttatcaaaactaatagatgagtaataaatctttcaaaacaaagaaaaccgatggacaaagtggtgaaaatatagcatttgtctcttattgccaatgcgtggcacataccaactcaattcatatttgcatgaatttatgaaagcaaggatgaaaaaatatgtactaagatataaaattagcaatattatttttaaaaggttgttaaaagtcaaggccttttgggccaggctgttgggctgtttcttaaggatatgatattttatttattttaacatattcagaaacacctagtggtattaaaacctctgagattggcagcatttggccttttagagaatgttgactctactttctttctctagaatttattctatcattttttatgacagtcttaataaagatgattgaaagactctgggtattaattcatcaaccagtatttgttgcaggccaactaagagtttggcactgtgttccaaggggaagttaagtaagcacaaaaatcacaaactattaaagttgataaagctgctgatttaagccaaaatagtaattctcttgacaacataagagtgaatgtttacatagcattgaccttttgccaggcactgttcaagcactttctacgtcactacatatttcttttaatttttacaacaactcattaaacaggtactattactatccttattgtacaggcgaggaagcacgtgagaattggctaaagccatatagttagtaagccatagagttaggatttaaacttgggtccaaatcctgtatgcttaaccattactgcaccagagaggtcctccaggcttcccttgagtaatctgaggaatgaggtgtgtgttatcttttttttttttttcctcaatcaattgaggttttattgagctagagcttgagggtgtgcccaagataaacaagagtcacagaaatcctctgtggcttatgttctccctgaagaggttttcaggaggctcagttttatacatttccttgggggaaaaatgtgtgtaggaagagttggggggtaggcagaagaatgattgctctcatattgtctttgttccatacctgagaaaataaggattattagtgtgaagtataataggcatatccttgttttgtgggagaatatacaccttttttaaggtattaagattatttttttctgtaagttattgggggtacaggtggcattcggttacatgagtaagttctttagttgtggtttgtgagattttggtgcacccattccccaagcagtatacactgtaccatatttgtagtcttttatccctcaccctcctacgactcttcccccaaagtccccaaagcccactgtgtcactgtaatacctttgcgtcctcatagcttagttcccacatatcagtgagaacatacgatgtttggttttccaacctgagttacgtcatttagaataatagtctccaaactcatccaggtcacttcaaatgctgtgaattcattcctttttatggctgagtagtattccatcatatatatataccacagtttctttatccactcattgattaatgggcatttgggttggttccacaatttttgcaattgtgagttgtactgctataaacatgtgtgtgcaagaatctttttcatataatgacttcttttgctccgggtagatacccagtagtggcattgctgggtcaaaatgttgttctacttttaattctttaaggaatctccacactagtatacattccctccagcagtgtagaacttccccctgttcaccgcatccatgccaacatctactgttttttgattttttgattatggccattctggtgtccattatcttttaccagaaaactcctcctgttgaaatggaatctttcttcccatacctttcctttattggtctaatttcactgcctggaggaagatggagattattttctacagagcagactctggatctgaagacagccttcaaactcctccagaaattgtttcttcaggattaatattctctccttaaattgctacatatgacatttttcatttgtttagctttgcaaaacttgcctattcaaaaaaggatattagatagttcacagagatatacacaacagacaagcaagataatatatatacctccaggttttgtggcatcaatagatttgataaacatactttgtgtcttcattagagcagtagataaatgaattagggctgtacagagtataaatccctgcggcacacccctacatatgccccatctagaatttctcaaatatccaggccacatctttctgtcctagttacaatgttaattgccaattagcatgtttatgtcaagatttcctgtgatagcatttttctctgggatctaataacccagtaaccttggacaccagcattatatagtgatatggaggtggattttggattcaaaatgtgtgctaaagctttgcaataatagacaacttaatttctgagcttcagtctccttgtctagcagagataacaacaggtaccgtgcaccttcttaaggctagttgtatggattaaatactatatacatgtaaaattattagcagatagtaggtgcttaattataattgtagacatttgtcaagaatgactcatttggccaatggagtgttggcaaatgtttacttaataattaattggctttctgagagaaaaagctctggtttggagcatttgatgatttccctggtataaacactcccaccaaagcttttgagctaccatcatggcatcatgaaaggcagagttgggtagcgatatatgcagtcaaatggctcttgggagacagtgccagccagtgccaacatccccctgtgtgtggcccatgctacactcatactcccactcacaagtaagattgcagcattaatatgtgagtaaaaagatacaaagaaaaaagatttccattacaaagagctcccgtcaggtgctgatagtgcttgaaaaagagatggttattttagttacatttataattgtgaagcttcttctgcttgctctggtatatggaagtgccagttattctttccaaatgtgcttggttttgtctttctttacctctttctccctcaccctccctcttccaacaaatgcctcatatggtaacagttaccaagcaaagtaagggattttatgaaaaattccaaggtttgagtaaaaaaatgaacaccaaaatacccattttattagtataggtagcatccagttaagagttgggtataaaaagaaacatttgcctacccaaagaaagcagcatcagaatcttggcataagaaaaatagcattgtttagtatttgggtgtttacatattccttgtgagggtgaatgtctgaatatgctcattttcatattttaagtcatcatcaattaaacatttgtgggtgtatttcttgtgggctgactccagtggctgtcagtgaaaccaagcagctgttgggtagatatggaacaaaaacaccctgaatgttacactcctgattgcttcccctggcacaggtagaggtacttatgcacagggaaggaaatgaagggcatgcatccaggttcctttctagctgtctccttagaaatcactgctttttggacagtactgaaagtatgacacagctgagacttggtgtatgtacacacacagtatcatatttgattgtgttggttgcttccttctggcaatcctttggcaggtggtatcacattcttccctctaaagagcattaccaactgagatttccctttgtgcttagtaaatatttaggcattgtagattgtgtcagcaatgattccttttatgtttcaaaggctggaaaatttttcttccttgacacttcactgttgttgatttggggaagaggtatgagccaaatggacattggacaaggaattaaaatttataattgccgcgaatagtaacttttccttagctgctgcttcgtacttgaaaatggaatgccctgtagcttgggaaccgaattttatggtggctctgcttttgtgatatttcattcaatccatttaacagttagttgtatttttcaattctaattaacattggtgtttttaatatatatcttaaaactataatttttgagctaagaagccttacaacagatacaccagcaaagatgactagaggtctacaagagtgcatcataagtagagcaatttagatggacttccttctgaactgctgcctaaaaagtttgttactcaatcttatcaccatagttcagcacaaagttaatgaaaatagggctgtataattttgttgtaaaacatcaagtacctgataattatcatcaccatccatctttatccaccatcatcaatcaccattattgtatttttattgcttggattaattcagtcctaatagagcataatggtatggaaattatttaattacattataagtacacactctatcaagtcagaaatcatttagtcctatgacagaaatccagcaacaccacctcctggtaggattagctatatatgcctttaagatatataacttaagcatgcagagggatatatagattgactgacagctgacttttcttctatttctccatgttgctacacttaattttgcctctatttcaaggaacttcaaacacagtgtttaaaagaatcatttaggctctccctgaatatacaaattttggtacctcatcattgtagttctctgataaggctcttggaatccctatttttgacaagcatgccagatgcttctaataacttgtctggaagaacatgcatggaggaacacaccattctgccctcataaaagtcattcatttttctgtctgtttttgttatatcactgcccaaatggaatgtgactatcaatacataataatttcagttactaatatataaattattagcattaatttgcatcaagttatactcatcattggtaattaataatgatgatgaatgatagcagatgtatatatggtgcctactatgccagacattcttaaaggatttgcacgtattaatccttacaagggccttcggaggcaggtaatattatatccccattctctagaggagaaaactcagctgaaggaggctggtcactgaatcacagaaggaagagagcaggctgtagaatcagatggcatgggctctatgtctgcctgtgccacttactggctgtgtgtcagtgacaagggtccatcatctcttcttgactataaagaaaaactggggatacagctgctgttaactccagagacaggtggtgagaattccatgagctgaagtatacaagtatttaaaggctagcctgaagagtaggcatgctctagaaatgttaactgttatcaccttttcttgtgacaaccctgcctttccaataccttttctaatgagttattgtcaataacatcccagtgctgctttctgaactgtgactatctttagctagtaaggagtgtttggtgtctcttttttagaatttttcttttctttttgaacattgaagagcgttcaatttttaattaatcttaataggcacacataccaatattaggcataattaataaccttattatctcattagaaaggcagaacacaatgcacataaccaggaaactaacgtacaagtcttagtgttcattactgctatgatattcattcacatgtttagtagaaaagaaaaaaaacaaaaacattgagccccttttcctaccggatcaagttacagatgttagcctgttcacaaactttcccacatccaggggcgatgtcccccagcacaccatccctccccagctgcttcctggccctcttgcctctgaggcatgctcacaaaaacctgtgagttttgaaagtattttcacctgccagcatcaatgagaaatcttctgcaagtcccctccccatgttcatttctgtcagttccttgggttacggttctcagtacataagtgtcattagcttcacctgggattttttaataaacgcaaattcctgaatactaaattcggattcagtaggtctgcaatggatctcaggaatctgagaacccccaccccgccccaagcgaacatgacacttctcttcgaaaaacactagcttcaattgtagagaaaaccaaaagtgcacatgaatggaaatctgggacatagtaagacaaaagagactgaagtaggaatagcaagcatttcaaaggaaaatgaggctgtcccttctgaggatttcatattaacaactggtgcaaggaaagggaatttgcagcagagttcagaataggggcagtgaggaagtggagttgaatctgagaacatgaataaggaaaccactctgaagatgagcatgtggcataagggaaattgccaccggaatgtaccctctctacttccctaactcctctctttacttctttggcccgttctttctgccacaacctaccactaaagatcctgctttgaatgaaccaaggtcccaggggattgttgcataggcataagggttgttcttggaagcctctgggtttgttgatacagaggatccctatggctccttgatgataattcagttgtgaaggtatagtattgagaaactggtctaaagtttttatggtatatatattttaaattttatttaataaatatataaaaagcactgttctatgtgttttaaaaatactaacacattgaatcttcttaagtactttgtggagtaggtaacgttattattccaatattacagatgaggaaactaagaagttaagtaacttgcccagagggtataaagaggaagggacaaggtgattgttccatactttaaaggaaccagattatcatatttgtagaaagaaagactacattttgagtctatcccaaagagtgttatttgaagtaattagactgtgtagctctgaaagaattggaacccgcaattcaaaacaatttaaactgttctggagacaaagctaactctctggtggggtttctttcttctgatgataaatttgggggtcacttaatccaggacagttcctgcatttatggaaaatgagcatatcgaggtaggattaaagaagtgaattcattcattaggctctatgccatcatggttcatttttttctaaagctgagccaagaacatctgtaccccaattttttattttcttggccaaaaggggacaaataacatctcacactaagaacattaaaatatttaccaaaggtcttcttttagcaaagaatatttcttcattgcaatgcctctgaacatcttcctgaatcaattaatattcatctaaacttttattttctatgactaagtaacagtaatattcataatagcaactgacattcagtgagctcttattctgtggtcactgtttcaggtgttttacctatattctattgtatgaaatagcacaacttactctgattaactcaattttattggatataacagttatttttcaatttctattatgacaaaaaatgttttattaatcatatctatagctaaactatgtaaaaatgtttgtaattatatccttagaatcaattttcagaagcagaattgccagtgtaagagtatactttaagaaaaaaattcagcacattttaccagttttcctgccaagaatgttataccaatctatattcccaccaacaatgtagcaagacttttgtgaaaagtttttttgtttttttgttttgagatggagtcttgctctgtcacccaggctggagtgcagtggtgtgatcttgcctcactgcaacctccacctcttgggttcaaacgattctcctgcctcagcctcccgagtagctgggactataggcacgtgccaccacacctggctaattttttgtgtttttagtagagatggggtttcaccatgttagccaggatggtctggatctcctgacctcgtgatctacctgactctgcctcccaaagtgctgggattataggcgtgagccactgcgcccggtgtgaaaagtttttaaagtaatgaattgctagttagcaacctctgagttttttaaggtgttgtctagcagtctttattaaaaaaaaaaaacagaggtccaatcacctatttccttagaagagggaatcaagggtatatttcagtctgtctataatgcactgctatgtaattactagggaaacttctccaaaagtcacaatgggtaaagtgttataaattctgagtcataagtaaagtttctactatgtgagagactctcattccctgttgtcactgagatcattaaggtctcagttcacatgttacctttgagagaagtttttcctattatcttatctaaaatagtcttcccaaggtctattccattactctgtcttgttttcatagcacttactaattatctttgtttattactttattgcttgtctccccattataacgtatgcttctgggagtcaggagctctttcttataccagcgattttatcacaagacctaaaagagtgcttggcacatgaaagatgtctatatatgatgaatcagtgaatgagtgatgaatgaataaatattggtcctcttaaatcccaaagtcctctgtttactatttatgcacagctattagtctgtagtacaacactgttaagagacaaaatatgcatatggggcaaagcaatatttgtaactctaaggtactcaaccttgtagatgaagataagtgaggaagaaccagttattagagtatcaatggcattggtcatttggttataagcgtaagtgaatttccccttgaatttaccctgtgagttgctatttaatggtgttggacagttacagataagtttggtagaacttttctctttgtttccttaagggttttgcctttgggtaaccaccttaatttcttcagtccctgtcttccatggataaagtcttagcagagctattaaagatcctaatgtcaacttctcttaagattatattgtccattaatgggtgttctgagagatgttattttgagatcaagtgctaaagatttacaatacacactttaactgggagaatatgcttgtttcactaggacagatatgtttctctatggtatccccagcacttacagtaactggcacgtaggaagcattaagaaaatgttgaataaatgaacaagataatcaaattctgtcttgtgaagaaacccatttgggatctattatatgttctgggtaattcctctgagcatcagcgaggatctgtgcaactaacactctggtttatatctaatttgaactgctgattgtgggcagtagaaattatttcagtagaaacttagctggcttgaatttatgagatattattagtctcattaagaaaaatgtctaccgacttctttaggaagctcatgtcttcagaaagtttctttgagatttcatatagaattccttggttttaataaacgttcctgacttctgcatatttgctattgatgcaacaatgatgcttggatcaaagttactttgtcactttctaattcatttattttagattactcagctagtagaaaacaatagagtcactttgttgctgtaaagtctcttcgtagtatttggtgggattgtgctattcttcagtgggctggtaatccctataaagcttagagaaacacagggctctttaaacgatcctttttctcttttctgttttaaatttcatcacttggttatttttgccacctgcttggattgcctccttacccaaatctaaaattcctacagtaaaataaatagaaaatgtggtcgctactctccttcaaaataatattttcatttctttggacaagtatgttaatttcttcatatgcagttgtcaatggtccaggtttcggaaccaaatagcctaaatttgtgtctggaccccactacctgctattattgactttgggcaaactagttaacctttctgtgcctcagttttctcatctttaaaatggggctattaagagtacttctctgtattgtcattgtgaattatgaatcaatacataaaatgagtttagaagaatgactggcacttcacaagtgctcaatgttaaattgtttttattgggaagaaatgaaaatacttccttgcttaatgttggagaaaagaatcactaacccatcgcatctctaagatgatgatgataattgcagttgccatttattacatccctactgtgtactaggcactgaattcaatgctttgtccaccttatgtaagtgaaatctcacagcacagtgaagtattattattattccatgttaccaatgaggaaacaggagaccctaaaaactgagttctttctctaaggttaaacagctcataagggatggagttcagatgtgaatccagttctatctgattttaaatcctgttctcttaattgttatgtcatgtcatctctacagtcttcaataattgagacttaatgttctttgattactaacatccagtggctattccaagggaattcaaaacccttgtcttcatgactttcaaaagcaacccaagtcctgaaaacaacatttttgtgaagtatattagtgtaatccaaaacatgataaacactttttaaagatatttgcagataagactcccctaccctcactgttacagtaacagtgtaattttccctggtattgctctgaacattaaggaattaaaacacttgaggctggacttgtcaagagacctatttttgttttgttatgttgtaatagctgttgtttctgatatttttctttttccttcattctgctttttctttctccaatcttggcttaaagggcaacttcctgtgcatgttcaggaatctgtggcaaagggaacaagtatgataatttgtctgctaccatttggatgttactattgtctcagcagccaggaaaacagacagagcccctgtgagcatcattgtgtttgggctgcggctttagttgccaaagtgcagtttttactgttggcatttccaccacctgctatgggcaataaccatcgaaaggacaaatccccttgtctgtgatttttctttctaggcttctttggagaaagactgtgaaatgatttattcctctgtacatatgaagctatagtgtattctccactgcatagttttggcctctgatactctctgttcttaggttaatccattaacttgcctgggggaaaagggacaggaaagatggatgaaggtgttatgaaaacagagatgagaaggatcttaaaaaatcccaaccactgccttttcttccctgttcccatctgctcctgagaagtccttcagaggatgccaggcctgttaatacctatactttatacctgttgttttaaatgaggcagttcttcctcactatatggatataataaacagttaagctgtcttcctctatgcccctcaaaaggagacaaacacacaagccctacacaaatggtatcgtgcccaaatgagtgttggaaatgctggataaaacaaaggtaagtaggtcttttcattgcaggccttctcagagccttaaaaaaaaatcctcactcatattttgaatctctaggagagacatatagtatacaacattctccaaatttgtttgaccttggaatgcttttttttttttagaagcaacttgagggacaaaagttctgtagaacacgctttggagagtattgggatagattactttcattgcatttttgcaatttggtttataaacttaccttggagattgggcaaattggctggttagtttagatacaatatatttttttcgggttgcaattgtatttttacagtagctagcagaagctgtggttctgaaaagatactataagaacattatcttgtgttctagaaaatagaaaatactctattttcttccccacctccatttttcccctgtctttagaaaaattaaagtatacttaagaagaggaaacaaagtgagtggtaaaggtgtatgcctctatagatggacaggtgtgttagttacattatatccaagtaatgtgtaagtgggccttattaatgagatcctaagaaactataaaaaatgaacataccccagatttctctttgtgtacactttgaaagtgtttttccatttctattaaaaagtttaatttgtcatgctcatgaaatcaacataaatttatggaggcagaacataatacagtaaaaagacaatgtgatccttttcatgtggcatttttaatacattgtatcacaaattacttcaaagaaacaattaaaagaacaaggaagaacttaggaggttcttaaaatagtatgtagcacattttagaactcaagtgacagagctttcctgatgggcccaagtcctgtctcctctcaccctttttttttgggggggggtggcgggaacaaaacaataaacacctttattacatgggtgaagacaaaacgaggatttatttgcctttccgggccttgatcttcctaagatagaactccaactctttgccctctagcacatagccatctgctcggccacatccacacagttctctcactctttcaaaatgtcagcaccagttccagaaggagggactggcccttgtgatggccataatgtaaagtgttcacacgaccaggtagcatttccattcttagaaagctacgcttcttagaaagctacgctacttgattctaagagatcagtcatacagacgtgtttttattcctttcagaggcaattcatttcatgaaaaaatgctgaaatgaaaacactttatagttaagcttggtgtagtcataaccacacatagctgtgttctgtcataatttgtaaattgagctctgtcataatatctatttttcaggaggctctcagttaaattttcttaaaaagtctttctgattatgaaagtaatgcatgcattgccctgtggcatattacatattactctctcatagaatatatagagagaaggtggcagtgaggacaattctgtggtcacctggaaggttttcctctggcacaggaaagacagctgtcctatttctagttgataaagtgcctagactgtgcattagaggccaaacattgaaggaagtcaaattgcctttttgttgattctaaagtggtctttgtatcagaaagtagaatctgaagaaatatgctgcaagccaggatgattatagttaacagtaatgtattatgtagtttcaaatagctagaaggaggatgttgaatgttcccaacacaaagaaatgataaatatttgagatgatagataggccaattactctgatctggtcactctatattatatgtatcagaacatcactatgtgcctgatagattatgtataatcatttgtcaattaaaacaaattagaaaacaacttacttgtctttttgctaaatctggatgtggatccagctgaatataatttcttcctagttctatgaataggatataggtcttggtttccatggtgttgtgtgacttatacttttgcttatctttgtcagtacttttgtgggaagaagataggggctctatcagaggttgttagcttggtgatgttttcacccacaaattcttcatttgttcttagaagttttctcatttctttgaactttccattaacattcaatctttcacttatatgaaaaatattttccttcctcctctttttcctcttccgtactttctccaaattcaggaggcagataatggtaattgaaagttctagggacacactgtgagctcaaggtccagaaaggttagggaaagtctttattttgaactgtaggtatgttttaattccttctggagactagcactcctcagggatgctgagactggcactggtgctaccggatattaaacagaatggatttaaagtattctcctgtattaagaagattattttcaaaagaaagctctattttgtagttattgtcactttcctaaagatataactttcctggagctgtggatcgccacaatattgatggcccatcccagcactatttaaaggcagggctttgtcatattttttataatatttgcagcttggtcaaataatatttattaaatgattaaataaattcaacagcacttagaaacaatagaggcagaaaatgaagttgtggagttggggtgtgtgtgtgtatatatatatagaattagtacattttcacactgctgatacaactgagactgggcaatttgcaaaagaaagaagtttaatgtactcacaatttcatgtggctggggaagcctcacaatcatgatggagggtgaaaagcacgtctcacatggcagcagacaagagaatgagagccaagcaaaagtggtctcctcttataaaaccatcagatctcatgagacttattcactaccatgagaacagtatgggggaaactgcccccattattcagttatctcccactgagtccctcccgcaacatgagggaattatgggaactacaattcgagatgagatttgggtggggacatagacaaaccatatcatacatatacataggtcagattggtaaaagttatagaagcaaatgttagaaaactattttgtaaagttggaaagtagaaacaataaaaaaacacaattcaaagagataagcattttcactggtgtttttttctggtgtgattcttccagagattattctggttatccattgctgtgtcacagaccactccaaatttagtggattaaaaatgataaatattttatgatgtcatagattctgtgggccagaaatttggacagggcacagtgaagatggtgagaacagtttgtctctgttccctgatgtctttgatctcaactgggaagaactgaggagctagaagtgactggcatggctgagacctagaattacctggaggcttctttattcacgtgtctgtgtctgagcctggaatgggatgatttgaaggctgaagttagctgagatggtgtggcttttccatgtggctcaggcttttcatgcatggtggctgcgcttctgagagagaagtcctgagaggaagtatctggaaagggagccttccaagagaaccaggtggaagctgcattgccttttctgacctatcctctggaggcacacagttacatttccaccacatttcattggttacatgtgaatcagaccaaacagattcaaggggagaaagaatgagcctcacttctttgcgcaggagagtcaaggtcacattgcaaaagagcgtgttggatggaagatgttacatctgattttgaaaaatatacttctctacaatattgtttggtcatcttataaaagtaaaaaatagtgtacctttataatatttcattgagaagtgtattaggcactttatcttgctaatgtaagatggttcactttaaagtgctctgtgtttgaaacattgtctttcttcacctttctaaagaacgctctaagatgatatatggcaaccaatcaatattacttttttcatttgtgtagcttatttaactacaactatttaataaatattatagggacattgtgttattccattttgtgaccctataaaggaacacctgaggctcgataatttataaagaaaagaggtttaggccaggcacagtggctcacgcctgtaatcccagcactttgggaggctgaggtgggtggatcacaaggtcagcagatcaaggccagcctggctaacatggtgaaaccctgtctctactaaaagtacaaaaaaattagccaggcgtggtggcacatgcctgtagtcccagctacccgggaggctgaggctggaggatcgcttgaaaccaggaggcagaggttgcagtgagctgagatcacaccactgcattccagtctgggtgacagagcaagactctgtctcaaaaaaaagaaagaaagaaagaaagaaagaaaagaggtttaatagccaaagttctataggctgtataggaagcatagtgttagcatctgcttagcttctggtgaggtctcagggaggttttactcatggtggaaggcgaagcaggaacagcacatcacatgacgagagcaggagcaagaggagtagtggggtgccacactctcaaacaaccagatctcatgaatttgcagagagaactcactcattactaagagcagggcaccaagccattcatgagggatccatccccatgacccggacacctcccaccaggccccatctccaacataatggattacatttcaacatgagatttgaagggaacaaaacatccaaaccatatcaaatatcatagaagaaaaaataaacatatgggaacatataagtgagaaaataagtttgtgaattatcaaaaagtggaaatagtaatatctaggcaggttagcatacataagtgatgttctagtggttctcaatctttgtggcagaatataatcatctacagaattcaaatcaaaacaaaacaaaaaaaactctggtaccctgctccctcccccagaaacactgatttaactggtctaaggtatagaccaggcatcaatatttaaaagttccctaggtgattgtaatgtgcagccaatcttgagaaccattgctttaaacagtttgtaaaatgtacgaaacagggaaagatgtttaattacaatgtttagttacatgactgaaattttatcaataagatctaaattctaatctaaacagaaattcatttgcctcttcattcttcaacagattagttcccagaggacactgttggattcatatctgacacgtaaataaagcccacacaccaatatccaaagcagaaagctgaaagggacctgtttccttgataatatcattgaaccattgaaatattgaccccataattgttccaattttgacttctaagaatgtagaatatttgtattttgtttcaactagatgttggaaaattctatagtttgcacccgaaagcgtttgaaacattcctttgtataaacacattttcttgattgtgtggtcaatctgctggacagatccactatgaattcagacagatctgggtttgaatcctggctctgctaccgtttaatgactttaacaatcttatttcatcatgcctccaaaaactgggagaaaatagaatacctgtttcagaaaatgattataggaattaaaagcatccattcttttattcaggaaacctttgagcacatgagtattccaagattgtattctgtacttggagtatataggaatgaacaagacagccacacttagcagaatgggagagggaggcaataagaaagttaaagaagagatgacaatgtcggtttctgatagaagctgggataaaaaaaggaggtagcaaaaaagtgtgaataggacaagtctgagactcaaatgataaaaggtagctctgcaaggaccagacaagcacatctaagtcagagaattgttaatacaaaagagtcttatggcaaaaataagattggtttatttgagaacaacaacaaaaaaggtcagagagcctggatctaatcagtaatgcagtggagagtgagaaaagtaagattggacgggtaaacagacgactgattaggtaagccaggaagaggagttgggatttattataaatctcatgatcagcatttataaaactttaagcaaggtgctaaattatctaattttatatataaaggggtaagagtgaagggggaaacctggttagcaaggtcttgtaatagtcccagtgagatatgatggtgccttgttttagggtggtgctggtggaagtgaaaaaatatatgtttaattttgctgtgaacccaaaactgctctaaaaaataaggtctattttttaaaagtatataaatgttagtaaaacacatagatttacatggtgggcactcagtttattagagatagggtctcactctgtgccccacgctggaatgcagttggcatgatcatagctcactgtaatctcgaactcctgcactcaaacaatcctcctgcctcagcctcctgaggagctaagactataggcatcaaatgcccagctaattttatttattatttatttatttttttgtagagacagggtcttgctatgttgcccaggctggtctcaactcctggcctcaagcagcccttcttccttggcctcccaaagtgttgggattacaggtgtcaaccaccatgcctggccagtaaatgctattttattcataatgttatcattaccattagtacaatgtggaagcaagatctggctctgtcattagcattgctttggtggaaagatttactaaataaagcagagagacttttccaaattgtatttattatctttaaaggctttcccctgaaggtacactgggatactaagaagacctgaatagcttaagatctctacaaaaggattccacataccggtttgggacttctaagggaaaatgcaaagattcacaacttttaatagacagtgatttttgtttctatatctgacggtcatataattatattttagcatcccaacacagttttgccataatggtgtgactctatgattgtgttgtattatgtaccacttcaacccaaattagtttaatgatgctatagaggcagagttgttttcccatcaaaatgggaacaagtatgcaaaagcaagataaacactatctttcagagtgatacattcaagcagcattggttttaagattaagcaaattcccactgccttgctttattagtatacttatgagaagctactttataggtcatataactgaagtgagtttataattatggcaatgggtctacattggaatgtagtttatagttactagctcaaatatctctgcctttcacgttatgttggaaaactgcatgctatctttatttcttagtttcacatctgtaaactgagattaagatctgcttttctgtttaaagactattgcctacatcagagaaatcatccttcagcacttgaaagactttgaaaacagaggcttcctaggcagataatattttgtttactatggttggttttcttttttccttttgaatagactttattttgtagagaagttttaggttcatagtaaaattgagcagaaagtatagagttctcataaacctcttcctatgccatcacacatgatagcttcccccatcaggagcattccatgcctgagtggtacatttcttacaattgatgaaacagtattgacacgtcatcacccaaagtacatagtttacactaggattcactcttggtgttgtacattatcttcatgtgtcaccatcataatatcctacagaatagtttcattgccctaaaagttctctgtgctgtgcttcctcattccctcctaaccactgtcaagtaatctttttactgtccccatagttttgcattttctagaatgtcatatagttagaatcatatggtatgtagcttttcagattggcttcttttacttagtaacatgcatttaagtgtcttccatatctttttttaatatatacatatatattttttattatactttaagttctgggatacatgtgcagaacgtgcaggtttgttacataggtatacacgtgccatggtggtttgctgcacccatcaacccgtcacctacattaggtatttctcctaatgctatccctcccctagcccccattccccaacaggccccggtgtgtgatgttcccctccctgtgtccatgtgttttcattgttcacctcccacttacaagtgagaacatgcagtgtttggttttctgttcctgtattagtttgctgagaatgatggtttccagcttcatccatgtccctgcaaaggacatgaactcatccttttttatggctgcattgtattccatggtgtatatgtgccacattttctttatctagtctatcattgatgggcatttaggttggctccaagtctttgctattgtgaacagtgctgcaataaacatacatgtgcatgtatctttatagtagaatcatttattatcctttgtgtatatatccagtaatgggattgctgggtcaaatggtatttctggttctagatccttgagtaattgctacactgttttcaacaatggttgaacaaatttacactccccccaacagtgtaaaagcgttcctatttcttcacatcctccccagcatctgttgtttcctgactttttaattatcgctattctaactggcgtgagatggtatctcgttgtggttttgatttgcatttctctaatgaccagtgatgatgagcattttttcatgtttgttggccacataaatgtcttcttttgagaagtgtctgctcatatccttcacctactttgtgatggggttgtttgtttttttcttgtaaaatttttaatgttctttgtagattccggatattagccctttatcagatggatagattgcaaaaattttctcccattctgtagattgcctgttcactctcatgatagtttcttttcctgtgcagaagctctttagtttaattagatcccatttgtcaattttggcttttgttgccattgcttttgatgttttagtcatgaagtctttgcccatgcctatgtcctgaatggtattgcctaagttttcttctagagtttttatggttttaggtcttacgtttaagtctttaatctatcttgagttaatttttgtataaggtgtaaggaaggggtccagtttcagttttctgcgtatggctagccagttttcccaacaccatttgttaaatagggaaatcctttccccattgcttgtttttgtcaggtttgtcaaagatcagatggttttagatgtgtagtgttatttctgaggcctgtgttctgttccattggtctatatatctgttttggtaccagtaccatgctgttttggttactgtagccttgtagtatagtttgaagtcaggtagtgtgatgcccccagctttgttctttttgcttgggattgtcttggctatacgggctcttttttggttccatatgaaatatgaagtagttttttctaattctgtgaagaaattcaatggtagcttgatggggatagcattgaatctataaattactttttatggttcaatagctcatttctcctgactgctgaataatgttcccttgtctggatgtaccacagtttatttattcattcacctgctgaaggacaccttagttggttttaagtttgggcaattatgaataaagctgctatgaacactcatgtgtagatttttgtgtgaatataagtttttagctcctttgggtatataccaaggagcacaactgctggattgtatggtaagtgtatgtttagttttgtaagaaggtgccaaactgtctttcagtgtggctgtaccattttgcattcccacaatctatagatgagactttctgttactcgacatctttaccagcatttaatattgtcagtgttttaaatatggaccatactaattgatgtataatggcatctcattgttgttttaatttgcatttccccagtgacaaatgatacagagaatcttcatatataattattgccatctgtattactttttgggtgaggtgtgtgttcagatctttggccatttttcatctgctgttttcttattgttgaatttcaagagtttttaacatattttggataacagtcctttatcattatgtctttttcaaatatttttcccattatggcttatcttttcattctcttgacagttacatcatgcttttaattgtagaattagacaacaatgaaataaccaaagccttagtaatcttaattagagattatcttctattattttctatttttcttgtttcacctgagttagaaaactgacctgcactgacttcctctttcacaataattccagtgaaatgaaagtgattagaaagtcttagcaaattcaccaaaagttagagccagaagactcacatttcaattctctacctaaagagaaggacaggcagaagccaaatatgtaaagagtttgtcagaagtatgccttggagccatgggcattgttcattactctgctgaatttatcttatggattttcccctccacattaatgtttcaatgatcttggttagattgttgaagtacaggttcctgctaggcatttctaactttttgttttaatattctcttatcctgttcatttactctcatttttccttttagaaatttactgccatcttctcttttagaaattcttttgacaatctgaaggaatgcagttatttatccctatgagcaattaaatacttttaatgggaatgtcatgtttttaaatcacatttcttataagaaaaaaatggtgtttactcaaatgaatgtggtctgatggtgatcctgatctatgagcagtaattgagatcatggaaataaatacaggaaagctggctccctgctcccttcaataaccaaatctatggtttagacattttttagcactttgctccaacctgttacagattatcaacattatatatgatgataataaatcagagcaccactttaaaacacaaaagtggttgcctctcagtgctatggcaaacatagaattttgaactttttgtatgactggtatttttttaagcgactatattttaataacgagctattgcatgtgactttactatgatgctcaaatatgttctatgtatgacggggaggaggaatgatgttaccatatgttggttctgaattcctattttattttattctcaggtggaaaaaagaaagaaaaaaggattcatcagcaatagggcaacttagagcggacacataggtactatggcagtgataagagatgagatagatcatcactatgcccttttcaattcttgggaactgtcttcgttaaacagttttagatgcaagggtaatttttttcctatggtgattgtagaaagaacacccagagattgggactagaagtcaggatgtctttagccttacttggttgtcagctaactgtgctgttttggacaatgcattcttttttggtattctgtttatcccactacaaaatagagatagtgagaattggattaccattgtcaatatgaagcacagatgaggtaagtgtgaatcacttgaggatatataaagtcatttaaaactttaataattataatacgataatatagttgttgatttagtttagtttcttacatatgatattctacatattcttatcacttcacagggaagcattgactggccaaagtaatggtgggtagagggaatcacttaccttagcttaaagagatgccaaaatctaggacctattcagagttatgaattatattttgttgagcagtgttcctccaaaattcatgtccttcctggaacctcagaatgtgaccttatttggaggtcacactggagatgagtgggctcttactccaatctgacttgtatccttataataaaaagggaagagacacagagacagatgcacacacagaggagaacattgtgtgcagacacagacacatgaggaagatggccagtaatgatgaaggcagaaattggaattactccgtaggaaggcaaggatcaccaaggattgctgccaactaccaacagctagaagactatggccatgctcacatcttgatttcagactgtgacccccaaaacagaaatggtgagaaaattaatctattaagtcacccagtttgtggttctttgttacagccgccctaggaaactaatacaggagtcaaggaggctgctgaacccagctggacactgaggggcatccacagaggtcaccaaagtggagtggccagaactagattttggaagccagatatggaggcaggaatccaagaagcagggagcctaatgaggaatagtcataaaaagagctcttggcagccgcctgttccagatgttggtgttgctgccagtttctatctgctcagtacccaaggcactttaatggactgagataggttggacaggttctgtttgaaaaaatcccttacatgcaaagtaagataaaaccaaaagccaaagtatcttgctttaccttgaagaaggaagcaactctccctgatcacagagcttccctacttggccataggatagcctcatgtgcacttagctcaatgttactctgagtttctttctactccgtctttctcgatataatcctaaaagttagggattcccaggaattatcatggaacaactggcttatgtcttagtttcctatcactgctgtaataaatcacggcaacctttgcaatttaaaacaacgtaaaacctattatcttagacttttgcaggtgagaagtccattatgggttgcactagtctaaaactagtgcaacactttttaccccctgaaagacatcaacactttttaccccctgaatctaaaataaaagttgaaattatttttagaaataaaaataaattaaaatgtttcgtaaaccactttggtttcctttctggtgtctctgaggcaaatgttttctgctcatttgagttgttggcagaatttaatttcttgtggttgaaggatggagatctggggtttttttgctggctgaaaactgagggccattggcagcttctagaggctactgtattcctagcccatggtgcctttcttccgtcttcaaagcctgcattcttctgcttctttgtccttttttaaagactcatgtgattagatcaggcccacccagataatccaggattatctccctttcttcaggttggctgctgaacaacctcaattccacctgcaacctaattcccttttaccatgtagcctaacatattcacagctctggggattaggatgtggacgtctttcaggagccatgatccttccttccacacattaactgcagctaagcaacatgactccccatcacgacagagtagaaggagaaactgaactgtgagaggggaaacagctttatcaaaacatagcaaatgtcaattataagcaaaaagagaaagtcaagctgcctataatatgtgcaatatatttattcttttataaacttgctgatatggaaattaaaaattaaatctacttaatggaaaatatttgatataagaacatcagacatatctttgataggcaataaattactttatagaatcgtttagcatcttatcttcagggctattttttggccctaactttgagcacattaattttgagttcctcttgtttctcttctatttgttccctcaaacccaatgtatcagaagttattttaacttaagttttccttgcctaattccatccacttatccccagaattgtttcatctcatgtatttattacactgttcacatatcaccttctattttcatgccccttgtaaacagcctaagaggcacattactggtaaagcctcagggtaaacaggcattgcctcccattttgatttcagctccatttaatgactttttatacccaatgtggacacatactcatttttagttttccaatgcagatttcagctatattttggctttattcctcttttttcatcctttttttctttttttttttttttttttgagacagagtcttgctcttttgctcagtctggagtgcagtgacatgatctcggctcactgcaacctccaactcccaggttcaagcaattctcctttctcaagtaatcctcctgaatagctaggattacaggcatgcaccaccacacccagctaatttttgtatttttagtagaaacgggtttcaccatattggtcaggctgctcttgaactcctgacctcgtgatccgccagcctaggcctcccaaagtcctggaattacaggcgtgagccaccgcgcctggcctacatccattttaaaatgaaaaaatatatatatatgtaatttatttgaagaaagtctattcatttacgtaacacttatcattgagcacttcgtaggtacctggcgttgttctagacactggaaacagaccactgattctgatgctcaagggccctgttggtggcattgcctttggtgcatccttttctttcacctcttatactttcgtgttaatacttccctacatggattgttttcttactttgtcatgtgtacactttccctacatggtgttttcttaccttgtcatgtgtacactttttttaccctttgcattatgaaatttttgtatcctgaatctcgtttggctatgactcaactttttaagctaactctatttggaaagagtctgattaaagaaaatgtcaccaaacggttaaatatgttatttctgtgcatgtttgttatttgtcaaggggtttcattttaacccaaatgaataactttttattggtggattgtacccatcctcgttagatcaccaaaggcagtatgtattctgatagggccactttgttgtgcctctctgctttcttttctctctctttttcttttctttctttttctctctctctcctttctctccttccttccttccttccttccttccttccttccttccttccttccctcctcccttcctcccttcctccctcccttcctcccttcctcccttcctccctcccttcctccctcccttcctctctttcttctcttgcctctttacctaatgtctcaaatggtaagtcaggccctgacctcacatgtgacagttaaaaagatgccagtgacatctttccccaaagcaatagaaaggatatttttcaactaacgatttaaataggtcaaagcaaacaggatactcacattaaaggaagaagaaactgcatgttatagaaagacctatgcattcagatacctttgcctgccctgaaattccatttttcaaattcatttgcctgttagctgaggacctttttaatggaactgatgttagtgatctcctagacctctgacagttcttgagagatagcaaaagctttccctgaagtgctagccatgtagcttatccctttaggcactctattgtagaagtctccctgataaagcttcctgtactcaaattcttaggggcagggaggagggataaacaattggaatacttttttgggatattaataattggttatttcaaaatctaaaaaaaaattaaaaataatcatttgaggaactctgttaaattttttaaaaagtgcattaggtttagatgtgatgaagcaacaaatgcaacagatgttgcaatgccaatcagatacttgactaagacaaaagtttaatgccaaactgcttcaccagaaatagcttcctacctgacagaggacactgaattgtgtcaaagtattagaggaggcaattggtaggtaaagataattaaagggacatccaacatgttttgagttctttctccgtatatatggagagagagaaaagggtatatttgtgccttggattcattagtaaaatgcattagctatagctgactgatttgcaactggtgcctgcctgaggtctccaaagagaggagatttacatttaggttttaagcttgggaaactttgaaagttcttataaaaaattagacagtcatttagaaatgtaaatatactgtatttctttctggattacacatttgctgaaattcaccttttagtttttttagaagggagcggtattggcatacgtgttacacttttttgcacatcacttttgaaatgaggttccagatggagtctcagccccagagtgtaacaaagagatcattggttacaacctccttcttacagactaacacactaaaacccagagaggttaaggaagagatttaaaatcacacaaatatttagcagcctggccatccatgactaggacccaagttaatcaaatttccatcatagtctttttttccttcccttcatcagcattatacttgcttgagtaaacatcttaaatatagaatgtttctccttttcattaagaggtcatctaaaatagtatgttctctattctccattaaacatagtttataagatttctttgcctttaaaatcagtttaattagggtaaaatttaatacataattgatcatacatctccaagttgaaacatctattctgtttttaggcttagtttagtcatttcccatttgtttgatttaaagtagggttgaaggggcacacagccccgggaaacttcagtgtaaagtgccatccaactctagccagattcttttatctaatcaccacactccctgaagtctctgataattatcaataaattgggtggtagataaatagcagtgtcatgagagaaggaaaaagctgaaggcacactagcagtgactctttctacctgtcagcaggatggaggagtaaagacagatctgtcctgtttgtcaggagcagaaagtatgctggcgaaaacgaactcctgggaagggaaggtgtcaggaagatgaattaccccaggaagccaggactgctctcccagtggagagcagctcacttggatataatttgccagctgtccgtcttgtcctcgtgcgtctctgtctttttcctcctttgcgctgccagcaacaagcctgtgctgtgtagatctagtgcagccacagaaccttgggactagctgaagggccgctagacctaatggcaggggtaactatttttgcaattgtgaatattcagcatgcacaggcttcctatcagctctcccaggagctctctgagagatggaccctgtgaggaaacatctttaaatgaacaccttagtagagaatgatcctgttaggtgaataaaaggctgattacatacccagaggtgagccataatgaggctcagagtaactaaatgcagcaatctgctgcactttgtatctggacttgagcctgagcatttcaaagtagcatctggaaaagaaaaaggctctggggaaaatcacacagtagacttgaaatatttcatttttttttctccaaagggaacttagggtagatttcttgggtaacggttttgaagaaagaaggcctggtgtgagaggaacatgttgtgttggcatcaccacctcacataaccaaactaacactctcctatcattgttgggtgctgagagagctggtggtccctgcctgtgtctttaaagtgacaagggttgcctagcctgaagattctagcacaacatcagcatcttacctacataaactgaagattcctcaagaatgttgaagcaatagtcattatgtttactacaggagtaagtgaggcatcaatctaccttctaccttgtgagttagccacataaagcagtgccacaggttgaaacaaaccttcttggtctggtttataatttaaattctccatggaagtagctgcagcttggaagctcattccattgaaaagttcactggctttggtgattcacaaaggagcatttcttatttggtgaattagtatcctaattaattcatttcatggagcaagcatctttgtgattctctcttctgctgcctactttctccctggcaggtacaggtaggattctaaagtataaagaggactttcacctggaaaccagaaggttgagttcttaaaggggtcatgatgcttgctagtaatgtgacctcctgctattcaatacttctgagtctccttttactcatctgtaaaatggggagaaaaaaaaactgtcctgccttttacccttttcttagcatacaagagttactgagaatgcttcagaagctattatgaaccactgtagcatcagctatatttatttaaggcacctattttgtatgttaaaatattctagagtatcttataactcttggttaatgaaactaaggactttctcactccttaggtaaaaaagtagtgtttatttcagagcaagatgttcaaaagcaagactaaacaatttgattcctgggatcatgccatcgggctgtcttgactctctctgattgctttcagtatttttattttattgggtagaagaacttggtaaaatgttaccctgaggctaaagagagctctttaaaatgactttagggatctgaatagaccagttgccatttattcccttaatatgattagtttcctaatagtcaaaggctgagatagcatttatttctcctaagtttcagtctaagccaatgtgggtgcctattagtgtcatagtgatgagtggcacagatgagcaaacagataattaaggaaaaccaaatatccttcccatcccccacctcacacccatttagtagttgactttggtgtaaaagtgtcttcctgtttcagtaggataatttggtgctcatctgtcagatagatggaggatggcaatgctaatttgtttctccaggcatacttgcctcagacttaaggactaaggttaccatgtagctcagagctgaaaggtaagagtcagaggcattcaatgattaaatagtcaatatgttctgacttctctgctaatttagcaaaaggaagaacatctcaattttgtcacttattaccagttgtttagcttgtcttagaaacatgccttgatttgaatagataaactacttttaaagcataagtcagcagccttttgttttatgaaatagtagtcctccatttggggcaattaaaatgaccatttctttggaaataaaatgttaaactggtgatggtagggtgaggtctagggggtgataggagagggaagttgagatttcaacagctaagtgcaaaagaaaattttaaaatacttagtattaaaatttttaacttgctactactttattggtctcatataaggacatgaacacctggggaagtaattggaaagggaaggaacataaaaaatattttatattctgtgaggtaaaaactgaggctaaaacataaataatttggcccaggtcatatggcaggagaatattagaatctggatttgatcctgcttttgtctggctgtggctgtgaaaattgagtccatcagttttcatcccatggcatctggaatcattgccccttgccacgtctttgtgtgtgtgcgcgcgcacgtgtgtgtgtgtgtatgtgtgtgtgcgtgctccaagttcatcccgatttctttaatctagccttgttaaaacacattttaaggtcagtttttaaggcacaaaatgtaggatgagtgagttgataggtagatatctattagcttgaaattgtattcaaaacagaacctcattcttaaaagtttaaaaatctatatcaattacccagcctcaaatatagttttcttctctttcaaatgttgtagaaaaatgcttcatattttctggctactgagcttcttaatattagagtaccatctcttcctacaattcggttacaggttgctcacttttagcgacattggctttctagttggagaaattccttagatttcaggtaccacatcagaatttctttcagttagggtgacagatccaatatactacatgtgtgtgaagtatagatgaaggtaatcagatctcatgcttcagggaataaactgattacccgcgatggtcaggaaggaattttcaccattagcatcctgcaaatacacaaacccaagtgcaagaatccaactttcttctatgtaaagttttcttgtagcacctcatcaagtgcagggcataaaatctaaacctatgacataatgtgctatgtataattgttgtcatacatgcatgactgtttattatgcaccaaaataaatactgtagcagttgagacagagtctagttagataactgagatagtgattcattaaatataaactacttaaaatcttttcatgtttcctccaggaatctcaaagtaccttcccaaaatgagctcattaatcctcatgaatattctgtcacataaattctgttacatttctctgaaaacataggttagtcaatcttactaactagtaagttctagcagcaagtcttcacagcactccaacacctttattgccttgaaatctcattagagatttagtttctaacactgttaatctagatggaattctttcatccctagctcattactacatttacccttcaacaaacatgtggtgggagtcaactgtgcgcaacgtgctgaatatgaaaagttaaatggggctcagggttcactgggaaagtgctggtaagttcattcacatgcactccagtacaacttggtatgcccagtgctgcctagcctagcaagaccctctttaatctactgttgccttcttgtacaggtctttatatcatgcgggctttgacacagataaacctactgtaatccgtgatttggttctaagagcctataatgaactccagttaattcagatgccatttagagaaacttggtcatattctaccttagaaaactcttggaataactttagttcttttgaaaattgcagtggtccagacatttttactctagtataactgctgtgtgtgtgtgtgtgtgtgtgtgtgtgtgtctgttgatcagaaactttataacgaggattagacttaaatttggcaagcttttctagataaattctagagaaaggtcccatgatgatcctagaaaatttaattaagagtaacaattaagagatccttttgaagtgcccatgtttaagttttatttgtttggttttgtatttttttctaaatattctttcagatcaaaccaagtctaaactggttactatttgacttaatgaaaggcctgacatgaaggaaggatgtaaataattttgagagaaaatacttttgaaatgttaaaacatttcttttgagcaatgttatttttattataaaggaaatagcactttcacctctgggagtgaataggggcttctcaatttgatacctaaaggatatttcctctcaagacaaacaaacaaaaatgtgcttactggggctgcaccttcagcccagcattggatatgttaattgctgacatacttgaggtctcactaagagaaaaatatcattagactgctggttcccaaaatacattcccttaaatatcagtcctatggagtggtccttgggaataaaaatcagggaacatattcaatggtaaatatatatatatatatatatatatatatatatatatatatatatataatatttatatatatattatatatgtattatgtagctctttattattattattattatttttgagacagagtctggctctgttgcctaggctggagtgtagtggcatgatctcagcttactgcaacctccacctcctgaggttcaagccattctcccgcctcagcctcccgagtatctgggattacaagcacctgccatcacgcctggctaagttttgtatttttagtagaaacagggtttcaccatgttggccaggatggtctcaaattcctgccctcgagtgatctgccttcgacctcccaacatgctgggattataggtgtaagccagggtagctttttaatactgctccctctctcttaggtattcacagtgcatattagcaaattaaatgttctgtgaagtcttgtattaagtacatcttttaatattttatttaagacttcccaaattcacttgaccattcactttgtaatattccttgacagaatacttgttaatatccagctcctgggaacacaatttgggaaatactacactaggaaaaaaaatctaggttggggaaatctaactaaacaagagtgtttatttacattagtaagttactttgtactttatgtgagtctccttttcaagtgagtttctcaagtgtcttaaaatactattttaaataatttttaaaacattgatatttttttgaaaatacattaagtatgtttttagaacttgaaattgaatgaattcccccttatcccttgtctgccagttctgttagtcttctcttcagtatttgatttatgagagatcaattcatatccaacttttcagagcatgtctcatgtcatgtgaaagacagcatacctatatttgtgtaagaaaggggagaaaacctacttctgagtgtaacataaaaactatgtgacagtcaagtatgataaaaggaaaatactggttatagggtcaagcaacctttatctctttttggcttactgtgagatttgggccaacaagtaacctctctgatcctgcctggataattgaaatgactattacttccctccaccagagagtgaatgatgtgtggattaaagtctgacctttgggcaaatgcctcctagtgacttgaaagaaggtgccctcatttctaacccacaccttacatctgtgtctatgatcccattcacagactggttctgaattaattctgtcagtcttgcattcttgcacttgccttcctgtcacctattcacttgcattctctctctacagttaggacattgtcaacacagattgtgtttgagtaaaaaagttcactcagagaaaaataattatagaaaggaaaagcatagatcaggagacaagtaaagacatacagtgaatctttaatccagagttgatttactcaagccttattgaaagataatcatgaagcaaaatgattaggtatggatgtgtaaatctgtaatgaatgactctgagtaaagattgtactcatcatcactagatttctctcataagtgcattgggttaaaaaaaagaattacctaagatcatttgaaattcagtaataagattctcttcagaagatcttttgattctgtagagaattaacatatctaattattatctgaagaccccaaacaccagatcctccaaaataatgttccttctgacattttcaacttgtataaaatttggttatctggaaatttactgcacataaggtccagcaagagaataattacactttattgatattttctcacaatgccatgagaaaatctggctgaagctgtgaaaaatgagttatatttataaaccagagatgttagctttccaaagtagtttcaaatccagacacccaatacacacacttccactcaccttcacgttctcacaaacttatacaagaaagtactcaatgatgtatttctaggcattaaatatttatatggtgtatataggtaggtatatatatatatgtatgtgtatttatgtgtgtgtatatgtacatatgttcacatacatttatgtatatgtatgtatatatgaatcataatttgctgataagcgttagacactattattataaatttcccttaatacacaaatttctcaatatcttagaagaaaattttcaagtatatgagagctcttctttctatcagcataggtgatagcattaaactgaatattaaccattccccagggtagagaaattatatctcagggtagaaaaatatatattttttgtatggaggttacttcttattgaagtgtgttagatctggccaggcatgctggctcacacctataatgtcagcactttgggaggccgaggtgggaggatcacttgaactcaagagttggagaccagcctgggcaacatagtgagatgctgtctctaaaacaaaaatttttataattagccaggcatggtggcacacgcatgtagttccagcagctagggaggctgaggtgggaggatcactttaacctggggatcaaggctgcagtgaaccagattgtgccagtgcactttagcctgggtgatagagtaagaccctctctaaaaatatatatatttttaaaagtgtgttagatctgcatattataaaatgacatgaattaagattcttcctccgtcatttatttctgttaaaaaaattcactgcttgcaaacatgtacatatatataaaccactgcacactaattatactgtatggtgtcacaagggtgttttttttttttacttgtaatgttttgcctaactttagagaaagcttgaaaagttaattaaaatcaacttatgtctcaacattttgttgcagtagaggaatttggaagaagggaaaagagaatagcaatgaattgattggataagaggcagacacatgtttttaaaaaaggatcagagcttgcccagtttctatttaaagtattgtaaggacctaatagctagctatagtgatacatttaagattaaaatgagcagatttggcggtacaggggagatgatggctagctggggatattagaaacagagctataaaaattcaacacaacctggaaaaatgcaaatgaatacaaccaacagtggggtgcagggttggttgcgggggacaggtggattatcttaggtgatatgctgtggaaggcatggagtttggctgcagggctgggtggtcacctagtaagaggaatgctttggctccttcccttgtctcttggaaatcagaagagacactgggccttttctcctttactccaagaagaaatgctcttttttcatatatctttattgaatacctattatggtccatgtgttaagagatggggaagcaaagagatacaactcatccaccctaccctggagaagcttattgcaaataccgtcaaatgcagtttgaaggaaatagtatgagatttgaattaaggacactaagattttattcatggattaaaatccgtattctgtttcttaatgattttgtgatcttgcacaggtccattaacctctgagcattagttatctgtgaaatgggagtaataattgagtctgcctcatgggaacactgtgatgactaaatgtgaaggtttatgataatgctctgaaaataatcaaaagtgctaaaatgatatggtttttaattatgaggtatttttaaatccaagcttgatagtagagtcagattatatacaaagggatcagagaaatagataagtatgggaggaatgataaatataggaagaacattatatacatcacagatgagttcaggtgcatgggggtcctggacttacaagcgggtgtgcttagtttaatgctctcctatcaccaccttgaaagttttaatattttttaaacaaaaggactcacttttttaatactaggcctcacaaattatgtagttagttctggttgtagacatattgcgtgtataaatacttagattagttacatgcccacaatattaatcattaagttatttgtgtatacatttaacagttacccatctatttatctatccctatagagacatattctcccatgtaggatgtgaggcacttgaggagtgaaacttgcttgaatggatctagggcccaggagagaaggcgaacctgaaaaacagttgttcggtctaatagttatcactagttggaagtcttgtacgttccaaggtcaagcgctgtgatgtgatacattacacacacacacatataatatttatttatatcatggaataaatgtgtaaatattactatattactaatgtatcttaattttcttttttacaaagatcctataatatcagtaggtctagaattaggtcaagaatctgcatttttaaaaaggcattccagcggcttctaaggcaggtggtttctagacaaactttccaaatactgagtgaaaagtttattcatgttgtgtttccattatttatgtgtaatttggagaactgggtgatcttttctccaggagcccctagcaacagatccagagaaagaatgtcatagctagcatttctttgtgttatttgggaccaatttcaaagttactgcaagatgtttgctttgccaagagatatcccatatccagtccaggccctattggatgccaaataactattagtgtacagaagcccccacttttccatgggggaaatgatctaagacccccagtagttgcctttaactgtggatagcaccaaaccctatatatactatgttttttccatacatacatgcgtatatacatagttatgataaggtttaatttgtaaattagtcacagtaagagattaatgacaataactaataataaaatggaaaattatgacagcatgctgtaatacaaacaatgtgaatgtattatagtctccctctcaaaatattttgttgtactgtactcacttatttttggaccatggttgaacaagggtaactgaaactgcagaaagcaaagtcgtggagaagggggaactactgtacataaagaaatagtggataataacaatgagaagatagattggggcctttaattctggataaaggatctgagactcttctcagaaggcaatagggaaccactggtcatacagaattaaataaaggagaaggaaacaaaaggtaaggagatcacttagaggctattacaaaaaaagtagagaagaggtaacaaaggccaaaagtgggcactaagagtaaagattaagaaaaaatatctttaattatggaaaatgtatggagattcctcataaaactaaaaatagaactcccatatgattcagcaatcccactactgggtatatatccccagagcttgaaatcagcgtgtctaaatgatatctgcactctcatgttcattgcagcagtattcacaatagccaagataaagagtcaacctaagtgttcatcagaggataaatggatgaagagaatgtagtaatgtggtatatacacaatcgaatattattcagccttaaacaagaaagaatttctgccatttgcagcagcatggataaacatggaggacattgtgctaagttcagaaataagccagacacagaaagactaaaacagcatagtttcacttatgtggaatccaaaacaatcaaatttatagaggcagagaatagaatagtggttaccagaagtagtgggtagggggaatggagagatgttggtcaaatggtaaaaaattttagttagaaggaattgatgataagtatttaagaaaatggatatattaattagtttgagttaatcattctatactgtacagatataacatcactgtgtaccatacaaatatatatatatgcaattatagtatgcccaaaaataatctctaagtcttctttttaaattttactttcataagaatggtatccatctgattgaagaccatcttctttcttctccatatgcaaatgtattccttatagaaaaatgcactcctgcccccaccccagcaaccatgcttcaggccccaaagaagttttcctccctgttaccttgcaaaggtagcctctcttgggaatcgctcactaattcaccctggaatactcttatgttagtttcccttatggtccctaacagcctttatctgttattcatctcccaggtactcacagcttgctgaaaggctttttctaatcagcattgttttgtcttctttaaaatccttgatcatggccactagcatccttgacagtctctggacacttggtgagaaaagaataaactcaatgcacaccagtgagagatcatgcccttttcttctgacaactttgtggcatctttggctgccctttttatgtgcttgtctttgtgctcccctacatcaatctcataaaacatcctttttttcatgcttgacatattgatatcatcccaccgcagataaaacacagagcagtgtaatatggacaggtgttggaattatttgcaatgcacagaaatctctgctgatgtttaagactaggacaatattaaacacattactttccctgacaggcattttcattacacccatgccatgcaggtgcagaatctagaagtgatatcttgttttccccaatagggtctatgcaatacaatttaaaagtgtgtttgggtgtgtatgtgtgtgtgcatgtatgtgtccttccccctttatatctttatctttgcaacatccacagcctcttgtttaaatcacatctgaattcacttggaggaatgacacaaattccaaagaacctgtagttaaaatagttgctatttaccagatcagtattcttatggttggtagtgtcacatggtcaggtttagagggcaactctgagataggacaagatgaaaaatagcctaggaaagatcaagaaagaccaacatcagaaagccacatagtcctccagagtgagttactatgtagcttagtttcatcaaaaagagaatcatggccaaggtggctgtattagtctgttctcatgctgctaaaaaagacatatccaagactgggtaacttataaaggaaagaggtccagtggactcacagttccacatggctagggaggcctcacaatcatggcggaaagcaaaagagaagcaaaggcacatcttacatggcggcaggcaagagaacttgtgcaggggaactcccatttatataaccatcagatctcatgagatttattcactaccacgagaacagtatgagggaaactgcccccatgattcagttatctccacctggccccacccttcacatgtgggtattattacaattcaaggtgagatttcgatggggaaacagccaaaccatatcagtggcaaattcaaatggctacagtaatgaaaacaacaataacagcaacaaaaggtaatattacttgaggatttatcttgtaccagaaacttttacatgctttacattcatgttgaaaattaaatgctggccaggtatggtggctcacgcctgtaatcccaacactttgggaggctgaggcagacagatcacttgaggtcaggagttcaagaccagcctgggcaacatggtgaaacctcatctctactaaaaatacaaaaattatccaggcgtggtggcaggtgactataatcccagctattcgggaggctgaggcaggagaatcacttgaacccaggaggcagaggttgcagtgagcagagatcacgccactgcactccagcctgggtgacagagccagactccatctcagaaaaaaaaaaattaaatgctcaaaacaaccctatcaggtaaatcactgtaattagcacctatttatcagatgagaaaaacaagactcataaaagtcatgtaacgtgtataaggtaacacagccagtgattcaagcccaggtctatctgactacaaaacttgggctcttagctttttgggattctatactcatggagaggtaaagctcagatcctagaagatcagctggagaagttagtgtatgaagtaggcaagccagatctgaggccaagctaagggcagaaaacaggagtcctgggccactcagcatgcatgctggctcaaaggagtgtgtttctgagcctagaatcttcactgtctcctgctcctgctaaatgttagagacctctaaaataaataattgcagtagctttgtggcgtgttttaattggctaccctctgggttccattagtaggtttacttactctaccctggacctaaagctgcagtgagggttgttacctccagcgaggagagtatttatcatgccctctccagaggtaactgcaattttgcttaagtgtactaatggcatctgctctcagctctgtgtttttcctctctgggtcttctgataaggtcattaggaagtgtgaggcagacaacctgagggctaaagtctcattcagctccatcagtcagattctgctgggactgcacaacccaaggatcctgttacagcatctgcctggaagattcttaagaaggaacttgcagttcattcattacatatgttctatgctgaggcataacagtggaggctgttttacagtgtatcatgccaacagtacatctgctgctggcaattatgctactaacatacaggaccttaagaactcttccttcccatagtttcactgagaaaaacaaaatcccagaagaatattaattgacattaatatgacacaattaaccatttattcaattggcctttccacctagaagtttaagcattcatctttcctgtatttcagatgaacaaaatgagataatgcattcatatactgattcagcaaacatttattatgacttcccatgtactgggtactatatagatatgcgagattaaaacaaagaaatacaatgtaaaaattcagattcttttaaggattccaccgtctactaggggaaacagatgcaatgatgtcatctataatataattttctgtgttgtgatagaatcatacataggacagcatccaaatacagcagataagcaactggctcagctagatttgggaggaggtcaaggcttcatgggggattcaatacctgagcagggtattaactaagagtgtaacctatataaaaggaatcttttttttgagcatttactatgtgttgaactggatgcagagtgctttatgtgcgttgtcataatcctatgcgtaaaacaatccagtgaaatctgtactatagccacatgtctcatgatgatggggatacattctaagaaatgtgtccttaagtgattttgtagttatgcaaaatcatagtgtgtactcacacaaatctagacgatatagcctgttgctatatggtacagcctattgttcctaggctataaactcatacagcatgttactgtactgaatattggaggcatttgtaacacaatggtaagttttttgtgtgtctggatatatctaaacatagaaaagggatagcaaaaacatggtattgtaatcctatgggaccatgatcatatatgcagtttatcattgatggaaatgtcattatgtagtacatggctatattattatcatattataaaatttccaagtgacaaaaaaaatctgaacccctgctctcaggctccagatcccagcttttagcagatatgccacactatcattaactacggtgtttcgcttaggaacatcaccaaacaaagctacttgttcttcaaggacccagtaatcatccttatccttgcacaattatcctggctctatcgtttgatgattttctttctgcaactaatgatttgggtagaaagaaaacctgccgatagtcatctttgatattgactggtcagtcccaagatctaggcattgaagtttctaagagtctctctccagtcctctatattgttctctgcatactcctccaatgtggtactgtactatgcagataagcacatggatgtgacctgatcctcctcaatcctatgctccctgacatctaaaatgggcccagaagcaaaacactttgcctgccgatttgtgcttttcagaagatgagcattttcttttacattctggacacacacataaaaaaacttttctatcattaacctgccacagccttatggaaattctgagaagtccagttcagcctcataacgcgtgaacgttatttatcttgaatgctgcaaatttggcatattggtggggggtgacaaggttaggtagatttattagcatcctgtcaggaaatttcccatgagcggtagaggtttgtcagaaaattcagtgtaattgataggagcaagttggactaattcttagtgctagatctgtactggctctgttcacacctttcctttgcagacaacaagatgtgctgaggagagctcattaagaagaccttcctgcaaacccattctttgcaccaggtttctttttccttcctttcttttatataattatttcagttactggagaagatataagcgtatattggaggcattactgaataggcaatgatttcaactcatttgtatgtatcttttaagtctccaagggaacacttaaactctagggaataaggattaacaagaagccgatatctgttcagtgtttcgctctattttcactaaaggattagaggtttcaactgtcgagtctaaaagccatcaaggcaggatataacagtggaaggaggttagcttttgaattaggattcttgggtcccagtctcaagtctccagcctgcgagttctttggccctgggacagttatttaaacttgctgagctttggtttcctcctttgaaaggtgaggttaatgatgcccatctcacagggttcctaataaatattaaatgaaatgaaaaatgtcacagctacttgacctaagcatctttcaatctctagttccagcactgctgcccctgaacagccttccttgatgtggccaagtaataacagccaccatttattgtgactttatgatgttgccacactctatgcaccatgctttgcatacttcatgtcattgactcctcagaatccagagagacagggagagaccatgggaagagaaagggagagaccatgggaagagaaggagagagagaagagaggagtagggagagagagagaagacagaggaaaggaaaaagaagagagagaaaaaagcgagatgagagagaagaaagaatgaatgagttctcatgtaattatggtcaagatattcatctttcctaagcctcagtttccttatcagtaaaacagtaaattatcacgtcttaactattttgatgactaaacgaggtgatttctgttacatgcaacccacagtgcctggaacataataaatccctaataaatagaataaaatattgttgtttctgatgataagtttcatttttgttgcaagcactcctggcacacattgcattatagattccatccactgattttccgttgtttatttcaatttcttcctcctctactagtctgcaaggaggccagagtcctttttaaaaaataatcactgcgatactgttcatcacacagaaacacacataaattgtttttaaaggaagaaaaaagggaaagaggaaggagtacaggcgcgtgtttggtaaggtgtcaagggtcataggtccttagattctactcaggtttttcttcataaagatgccatttctattggaaagtgatggctctgcctctgaaaacatttcacaaaaaccagaagaggaaaacaaaccaaaaagaaatattgctggaacactatagtgtgggcacttcaatgtagttttcctattccttatatttttccatagttggaattgacactgtaagggacacttttcacaaagtagcatattcccatggctggaacaaaataaccaactttgcaaagggagttgaattacttccattccttgttaggctaaaagccatttggcctagccagggataattttggcctggaaagctcagatttctaatctagcctgactgacctattcccagttccaagattttccacatactttcttccctcactcatggagcgattacatggagttaaatacaatacccttagtggaattgtttggtacaaattgtggtggcattgactctgtccgaggttctgcttacattctgtatgcctggatgctagccgatcctctccatccagtggaatccagccttgtctttatctagcataaacctcacccttcccttgtgatctccaaacatgtgaacagcctttttttaacacacacacacacttctctctcttctcacatcatggccttctttaaatgtcaggtgttttgaaagaagttagaggcctttagaaagtgcaagatacaagttaactctgtttaaagtttaatggcaaaaatcagaataaagcaaaactggatcaggtttacagatgatgagttttgttttccctgcaacaaggttaaaaactttttgagacaacattttaaaattgaatagtgtagataaaaatgagctgtccatgaaaattattagctactcttggcaaatcagaagacattgcaatactagacttgcattcccatgtagcaaaaaatttgctagtgattattagtgattgttttggacattctttgggtatttacagtccccaccattgcctatcatcccactaacaccaaagccaactgccagttctagtaataacaaccaaatatgaaaatgcttgagcaccagaatttgtaaacccagcccatgaatttgcattacctgcttgacctctggggtcgttggttttgcaaaccatactgtaaaggaaagaaaaaggaaaaaccaagttagatgtgttacataatactatttcattatattatctcttttttctcccttctacacttttcatttaccaccactccccaccccctgctacctaaatatctttatcccaatggaagatgcgttaccaaagattcacagtttatggaccagaagaaaaatgtggcttctaagtaagtcctgcagtcttatttctcacttctgtcattgacagccactaaatcaagaagaggttaagtgaaaattagcaaaatatgcattgccatactaacaggcagtaatagaacaatctgttcatgtccccacttcacaagtccactttcccaaaactaatcaaactcttccatctgtggaacttgccacagcaggtctttttcagcaaagaaagagcaacaagtttccctgcacatattttccctggcagaaatttatcaccttatttttctacatttcaaaaataaatattttccccttatacctttcccaatcttattttaaaatggaaacagccaaaagctaggtagttgtcttattctcttttattttcattgaaatcatttcctagactgtatacatacacattatgtatgtaatttatgaagttttgtttatatgagaaagcttcttttattttttaacatgcatttatgttgctttttgggctaatgtccttaaccttttcaaaacccaggagtttttccacctctattcttctgcatcacaagaccttacattgtgtgtgtttactggccttcataaaaaaattaaaaaaaaaacactctaaattcacatttcaccacttgttatctatcaccctctctcatagcttgtgatgtttacaaatgcttctgaagtattcagtccctagagtgagctttctttgactggtgggcaccagtacgatcatagttcacagcagccttgaactcctgggctcaagtgatcattttgccttagcttccaagtagctcagactacaggcgtgaaccgccatgttcagttgaagtccacatatgataacatttctgcctccacttaaaaccctccagacagcccttcaatgacctcggcttacaatacaaatgtgttatgattttccaggcccttcttcatctgctctcccttccttttgagcattatcccatttcatgcccccacacagattctagccataccccatgacttacaatttcccacaaagaatgcactgtggctccactccaggactttgcccatgctgggtccccttcctgaaatgccttctagctgttctctcttccctgtttgctgccatttccgtggacagactatacttgtctttctgttctaattgctctgaaatatacctctggccccccagctttcctgctcccccatcccctgtagtccttctagttttcctgtgtccccatgggacttctttatcctttttgaagcacctatcacactgagccataactgcatacctttctggatgtctctttcagtggaccatagttgcacactctcttcaggaagtgcaacttgtttgtcagtgagtcgccaatgccttatactgtaaccaaaatgcagattcagtcacttgccacctgccgagtccaattcacaagagcaagttctagtataaagaaagtgactttttattccaaagctagcttaagggaagaagtataggcttcctgccttaagagtactgcttacttttggagcagaaagcaggcacttttaaaaggcatcttggcatgaatggctcacaggggagggaaatgcaggtggggtcatgtaactcactgcagtgcctaatctactgcgtggttgagctggtgacagctggtgccttcatgggcagaactaggttgtaaacgtggccaaaactctcctggtgggagacagttttgtagcaggcacttcaggttgtacattgactgttgtctctcgaggtgatctcctggtgagagggagttctgctctggagcttctaagcacatagttagatgaacttgccctgtagggagtgtctggaaaaaggaaggtaaaaggttataattgcatgtctaaagagctaagtaggaagtagggaaaaaagaaaagagaaaaaatacattatctcttataaaaatgggggtactcattacaaaactgtgtctggcacatgaatgttcagtgatgttgactgaccaaggagagttacaaaacaaaaacttggaagtgggaggggcatagcaatcagggtcccaaaggaaagaaggcatacacaaaatggttacatgaagagaaactaatgaagggatttatttcccaggtaagaaaattagcaagtgctggtgaaacacttagggatgagaaaatgtgaaaagtctcaattgtccctaggtttgaatggccacagaagacaattggattccatgaacatggctggtgttgcaaccttgtgagagaggcaactcggttatcactttggtcctaaataaaataacccagctactggcacattcataacacatcagggagggttctggaaggaagaatgaataaatgcccaatgtttctcttattgagctctccactgccaaaatatacaagaagccagaggaaaaagacagtcttatgatgtgatctatacagcttatagcagtcagcctttctagtgggcagagaaggaaaggaagtgaatctgggatgaaagtgagaatatctaacccagtgtacctgcctagcagcagaggggaatctttgactataaaaatgtttcgttgttaaattttgaaataataaatgactataagcttttcataaagtatatacctgtattattaatgttcttatgctaacatatctggttattaaaaaatggtgcttatgcactaataaccaatcagtatacagagagctgtcaagtcactcatctgtaagtgctaccagctggggttaataagcagaactgtgacatgtgaatatttccttcatgcaaacataaacagaaatttgttttattttaaaagatagaggaattctaaatatatagtaaaaatagtaagtgtgtattccagaaaatcttagcaaaaagtcagaactaagtaaatgaataataaatgagtgaatgaggtaatataattggactacagagactaggcaatgtgaaggagagaaatatgatgtaggctttgggaacatgaaaggtagagtttgcttacactgaaagaaaagatagagaaaatgtgaacaatgtgacaaggatggatgttattaaattttcatcctaaattgtaagattcttgtcctcagagaaggaaagagggaggaaaactagtatttattgagtctctatgatatgctgagagcttttacaaacctttgcttgtttaattctcacaagtcactatgagtattattatctcatttttacagtaaggaagccaagacacaaagcagttaaagaactcactggttagtggtaaaaaccaggaaataatcccagattcatctctcagaagcccattccctgtttgcataccatgcaacattcaagaatctagtgaaggaaataacacacctatcaataattatatatccaagacagaatgtaaaaatactatgccagaagtagacagtgccttggtaacacacaggacagagaaactctaatcaggaattctgatccaatttcatgcagtggtggcatttaaataagtctttgagagatttttgaaatttgaatatctgatagacaacatgacttaaaagaaagaatcattttatttatttttgacaccttggtacttgacacaatgtccatcaaatagtaagtttcagtaactcaatcaaaaataaaaatgggaaaaatgacatcaggtgtgttcagggaaatggtgatttgttaaaggtctggtagtgagtatgagggatgggttagagtgaaggctacagctgacatgataggacagggctagtttgtagaggattttgaatactattatgcagagttagaactttccataggtgtgaaataagtagccactgaaggattttgtgcaaagcagtgaaattatgtgggctgcacattaggaagatttctccggggaaatgtagcaggccctattcgagaacagtgttggcagctaagaactgcattagtatgccattgtattcattcaaagaggtactagggaatgaacagcactctgagaatgggaaacaggggccgagctgaatgatgctgtggagatagtcatttctctagtttagatagggagagggaagggcgtctttcaagaaatgacttcagaattttgagcctgaataaatggaaaaattatgatgtcattaactacagtatacaacgtacaataagtaggggtaaaatgaggagtgaaaagtaataaggaaaatgatgagtttggatcatctgtagaaagaggtccagtaggtggttatggttcggattattggatgacatcacagatatagatctggggttcctccacttagaggaagtagctgaatccatgggaggattcacaggtggtgaacaataccattgaggatagagctcagacctgggagagcacatttttaagtgacgggtgataggagaaaaactaatgggatatttgaaaatgagaaattgtcaggttcattgcactattacccccatttttctctcttttattctctcttttctttttgtttcttttcttttcttttttttttcagggtcttgctctgtcacccaggctagaatgcagtggcatgatcatggctcactgcagccttgatctcctgagctcaagcaattctctcacttgagcttcacaagtagctgggactgcaggcacaccatgcccagccaattttttattttttgtagaaataaggtcttcctatcttccccaggttacatttttctctttctgatagtacctttatctagaacactaagtagctaatcctttctacaaaattaaagatagttactttagttgacagttaaatatcctattgtacttaaagttcttgtacattccgacgggttaatcagatgcctccaattccacctctttcaagggtggtgtatctgaatgtcaaggtgattggcataacactaatgcataataaccagaaatcgagtttatcttccaagatcttaatagaggatcctcctcaagagaaaacctttcagacatatcagccttacaactggaatctatttacttttcatttgtttttcaccctatttatgtcattttcctttttaattgccagggatatttatatggaaaagagttttcctcttcttatttctgtcagatcttgtagttgacatcttgtttcattctgtcatgccaatgattaaagctcagtaaaatgtccattttgcatatatggctttctaaagatccatttggaggagatcagatgttaaaagagaggatgtttgttgggggggtggtggtgggaggtgggtagggatagtactttagaaactgtttcagatctaagagggaattaacaggatttcagagggtgcgagaaaagtgggataatgttaagtattacattgaaagcagcgaatgagacctttccaaagtgatgacaaatacaacagaggagtgagggctggggcagtcagcaacacaatttttccactcacttgtggagctagaacataccttccctctgttttgtaaagatgagcctcctccctttcttagaacatttggagaacttcataactttcaatataacattcaagacatacttcaagagttgcccagccacatccattagtctaggtggcacctatgtggttcagtcacatctgtatgaagacttgaagactcccaaggaacttacatcagaaggagagaaaatggggttcttcatggaaacttgccatggatgaaggtacaacatgacccattgactagaccaagtagcgtgacctggatgttgagggaaggaggtggttccaggtcaagtttgaaactggttctgaacattcctagatctgttctcctgccttgtctgtgtgttttggggaagagattgtttgcaaaagaaagaatcctgtcacttgtgtctttactgttcttctgtgggaaagggctctgaaaggattgcgttttgacaggaggaaggtgttgaaccactactcgtagatagacagggaaccctgtgcggccatagtttaggtatggttgccagttctgtggggaatacagtaaaagctttcaaggacaatgacatacgtggcctccagagcatgaggctagaaatctgacatatgcgagaaggtcctctctcacccaaaaacttttacagaaaataactagggagggacatcctagagggcaaaattagacttcttgctaaccaagtgtattagtttcttcttatattgctactcttattcttcttatactacctgaaacagggtaatttatgaagaaaagaggtttaattgactcacagttccacatgtctggggagacctcaggaaacttacaatcatgatggaaggtgaaggagaagcaagcacattttcacaaggcggcaggaaaagaaagagcgaggcaggagctgccaaacacttttaaagccatcagctcttgtgatgaactcactcactatcatgagaacagcatgggggaaaccacccccacaatctaatcacctcccaccagatccctccaacatgtggaaattacaatttgagatgagatttgggtgggaacacagagccaaacgatatcatcaagcaagtgggtgcccaaaacattgaggcaaattgtggagtttctttaagtagaatacatttgtaagttcatagtttcagcttatgaactagctcttatttgatcagcatgagagcatctaaaagagaaataataaaacaaatggatccatctctcattatttccattccatggtctaacttatttttttcttgactacccttcttcctataagaagaagaagagaaaggtctgagaaaaatatgtgcccccataacactctggggcaacctgaaggccatcttccaaaagtcccctctgcctttctcagagaagagattgttaggctgatccatgcttctgtaacacacagtccacaagaatgcatggcatgcagtgacaaaccaagaatattctgataatctcagttgaatctaagcattctatggcagaaactcgcttttagtaatctgctatctgttaaagaaagaacaatttggtctcaagcagtggggaagatcagctcatttacaagactgtcacttaatgaagctccttggtgacttttctgtgatgaatttagacattgaaaagaaatatttcacctcttcactctgctccataggctcaagcagaaaaaatgggagacattgtatttctagtttctttcatccaaagctttgctcacttatgttgacattgtgctgaacagctgacgaacatgcgggcaggccaaggaggatgctgtcttactgttggactcttctctgggcaaagttcattattgtgctggcctcagaccactttagctgccatcagttgagaggaaaagaaagaactgcattaaaaagaatgtcttgcattacaggctttagaggggaaactagtgaaaaaactgctgatgctttgggaggcaatttcttccctccctgcctgcctccctccctccctcccttccttctttccttctttccttctttccttcctttctccctttctcccttcctccctccaactcttcctccctcccttcctttcttccctcctttctagtagatgtctctgattctacctcttttttcaattgatttatgtgcttttgcttggcaagtttgcgctaactcccataattgcttggaagggcggtgttgatttaagccttgtttcattgaaggagaatagcattccttctttcataacagaccaattaaagacgacacaatgacttcttctttctgtaagctttccttgattccctgagccaattttgaaattaaactcttcttcagtcctcctaaactcattgcacagaaacaatcacaaactcacactgtcaggagtggcccaggccatctggttccactgtttgcaagcctccatagtgccgtcatagaggcatttccacagtattctagagacactgtaaaccttctccataataggccagattttcctagcagggactaatactagctgatgatagctaataggtactgattgcttaccctgcctggtgttttacagatagtgtttaaatggcagtatagggttaagagtatgacaaccagagccagagatattgggttccaatcctaccatttaatccctgtgtgaccttgggcaagatgttttacctttctaaaccacagttttcttctttgtaaaatgggaaaaaatttagctactgcaagttgttgcattaaatgagataatttaaagtagaatgtgaatcgtaatacccagaatgttctaaaaattaatgttaattatcatccttattatccattgcttatctccaaatgctttagtgtaattttcaacatggtgctacatagcgaggattatgccctctgaaattgtcacacatcaagactggtggctgaaggccagcaaaatggtaattgtgatcattatctagcacattttcttctctagaagatggattttaagtctctgctcataagctgattggtagtgctgccttagattggtatcttctgttttggggaaagaaggtgattttgccagatttcctcagttttgatcattgggaatatacaataatggaaatttgccatgggaggctgggaacccataactaaacagtccatgataatcctatatccaactcttggaaaagggaaaaacaacacttcatctcaggattgcttcagggtgaatactgtgcctactacccatattaaatgcatttctttatgtccatccctcctctctctctctgtctctctccctctctgtgtgtctttctctctctctctgtctgtctgtctctctgtctctctctctgtctctctctctctctctctcacacacacacacaccccccagaagagcattttggccacttaaaggaatgctgtgaggaattacagattttgactgcgtaaaatattgtgcgttgttccaagcaaaggtaaaattctcaaactgttgaaattgtttttatcagcactactcctaatcataattactgttgtcattagtcagtgttgggtaccactaccttctgtgataacacttaacacattgttagcaattacacagaacttcccaattctgccagctccatgctacatcatcaataccatttcctgtagtagagtgccccctagcacctccacgcttctctcagtttaatttgctttttgagccccccaaagagagactactaaatatcaaaggcagctttcactctttagggacttgggctttccaagtggttaagtgcccagcattaatctcctgagatttgttcatctgacttcacagcagctggaacagggacagagatcttttggacagcctgttctgccagaagcagagcaggtggctttctctcgggtcacaattgaatttaaaaatcccattaattttgtcaagtcaacttaattctcttaacctgataattatcttcctttggaaaaagaacaataaaagagtaggcagacctctgttaagcaatgtttaaagtgtgtgtgtgtgtatgtgtgtctgtgtgcacatgtgtgtgtgcatgcatacatgtgtgtgacagaaagagacagaaagaaaggctgcctgactgattataggtttataaggttcacttcttagttcatctctgaaaacaagagattttggctgctgtcttatttgtccttaaataatttgggtgatccacctgggcattaggtcacagccttgggccctctttttaaagcacttgcatgcctgggaagaaggtggtaggctcttacagcagcaaataagagtgtattgcttaaacctctctttgaaggcagggagggcgagggggaggtgtgagatattttaaaaataagatgtgctgctaaattctctgccaacctccgttcatgctgagtggagtgtaagtaacaagtatcagatagttcctccagatgtcagctatttaaagagtcacatgctagaagttctgtggatagcaattgtcttattcctggtggtggtggtggtggtggtggtggtggtggtggtggtggtgatggtggtggtggtggtggtggtggtgatggtggtgatggtggtggtggtggtggtagtgatggtggtggtggtggtggtggtgatggtggtgatggtggtgatggtggtggtggtggtggtagtgatggtggtggtggtggtggtgatggtggtggtggtggtggtggtgatggtggtggtggtggtggtgatggtaatgatggtggtggtggtggtggtggtggtgacgatggtattaggaggtggatgctgcctcgcagaaacttttatcagcaagaaagtgtgggaatgtgtttgtgcatttgagaagtaagacaaattagaccagagggaaaaaaatgacctaataactcaggaagatcatgatatcaacctttgtacaagtaacatttgatttttaaatgtataaagcaagaagaatgtccaggaactctcaattcctgtaaaattattgtattttccttaagaaattaacttataggccgagaaattatacaataaggaaaatgattcttattcaattttaaacttttctctactgctttacctaaaatagactggaaaaaaaaaagttgtgactgttctcttttgttatctctttgaatcccagtggtaaaggacttcttcctacaagacataatgaattgatctgtttaagttagtaatcactgtgaggaagtggtagggtcaagactgattagagtcttcagaatttccccaccagttcaaatgatgttttcttacactcatgcttaaaagttctgcataagggtcacaaaaattgttaagcttcatttcttctcttctcttctttatttaatttttggagacagagtcttgctctgtcacccaggctgggatgcaatggtgtgatctcagctcactgttacctccgcctcccaggttcaagtgattctcgattctggtgcctcagcctcccaagcacctgggattacaggtgcgcaccaccacacctggctaatttttttgtttttggtagagaccaggttttaccatgttttccaggctggtctcgaactcctgccctcaagttatctgcccatctcggcctcccaaagtgttgagattacaggcatgagccaccacacctggcccattccttatatatttttaaaaataacctgttcttcttcagtttctacaaattctggctttattcttttgcttaatttgaatttcagctgtgttaataaccagagggactccaaaggatgtagttttataatttctctgagggtcagttcttccagttttatatggaagagaaataagatagctcccagctcttggctcattgttggtgacaaactcaagtaacaaacactgcctttctaatgggagatatcattatgctcaattcctcctagtgtctcttctaaaacagatactcagataaaacacttatctctgggagaaacagataggcagagaaaagaagggtatgtgattaagtgaaggtagcatttctagaactgaaactttgtcttttccttcaacttccatggcccttttgagtaatagaacaaagtagagataggtttggttgtgtcaaacacagtgggatcagatgtccttcaaacagactttgagagacagtgtggtcatgggttttattttttttcctcactttttcttttctggaatcttctgcaggcatcccaggttgagacacttgcaaaaaaaagataagaggcagctatacaggggagaatcgcaacctgtgtagtcaccatgtgaccacttgtaaaacagtcccagcatcccatcttagtttgtcccttggtagggcaaggaaggttgtgagcttttgttcgtgatgttaaataaagaacattgtgtgtcaaaagaagtagacttccttatctgctgtttacagctatgaaagaggaggtgttggtctttcttctaagctctatcttccagcttttttttcctaccttctgtttcacatgatctcatacagaaaacttctgactttccaatgtagggcttgttctgttgtcagcatttgtagtcagcatttctctagtgtttttctaaaacccttatctgcagggaacgtcaacgtggttgtagcatcaatagaataaggttttagttatatatatatgtatctacatatatatagttatctatatatatagctgtatatatagttatctatatatagctatatatagagttatatatatatagctatatatatggttatctatatagctatatatatagttatctatatatagctatatagttatctatagatagctatatatatagtttatatatatagttttatacacacacacacacacacacacacacacacacacatatacacacacacttagcttttctgtttcaactttgagtcataatgttgaatgaaaactgagtccaagattgatattctggggtcatctacatggagcactgaactatcttcagtgcattacatgggaaggttagatattggtaagaaagttaggaaatcaatctaatttctcctattctgtctcccccacctttccttttaccgtccattgtgtgcagaattcaagagtgccattcactcagttgtgccagagcataattgctgataaagtagagctgatgaatttgcactatggaatgatcctggtcatatgttttcctgaaattttctcaagttttgcaaatttattttctatttcatacttgtctaatatttttgatatgtacaaatatgtatctaccttattactttagtgagatgggactcatgttctctcatacacaaatacatatatcttatgtatttaaaacatatccatatctataaattatattttataagactcacatatccatatctataaattctattttataagactctagctaaaactgagtagtgttttaagaattgttaaaaaggcagacacgtcttgggatgctagcaggtgggaagtatgatctgtccttaataaaacatgattaatctcacaaaaaaggaaaaactctcccatttaaggcccagagaactaggctaaaccagaaaacagagaggcttgtgttggggagtacttttgacagatccctcacccccatccgcacagccacccacaacataggtgtatattgtctctgtatgatttcgtatctggtgctgttctgcacttctcagtttgggggctgaattcctcagcatccttgccacattacagaaatagaaagcccaatatcatagtcacaccaccaccccacttgccacccacaatgtaacagaagagcaggcagccctcagtttccgaaagggttgtattctcaatgttactttataaattctcagagctcagattatattttccagagaaatggtatattctctttccagaactcaaacacctactaacccagaatattcccaatgtcctagtcaagagatactatagtcaagtacctggccacataggaaatgctttctaaaagggtatgtatttggaattttaggttaggataccaatgacatatttttcaccattacagatttgataacaagatctgggctacccaaacacctacttgctgtctgcaaagatcctaggctagttagttctttatccaggttcatggcaaagtttgagaggagattcaaaggtaagaaaggggctccagctggaaaaggacatggtgaggtgctggacttgatgtgctgggaaggggtgaggaggagggtgagatatatgtgaggggcataatgggagcagtgggaattgggagacacagggagaagaaacgaaagctgaaggagtggactttgagggttaacaaagaagagaagcagaacataattcaattcaattcaacatactttgttgatcacccaatctggtatgtgccagaaaagtgagcaaagttgaatgagatgtgttctccacaggcgagatctcctgtaagggaaggagaaagggacatatgcagatttgcattcttggagcagatctgttcggttccagactagagatgcagaaagggcacagagaaggagagatttatcctgacttgaagatgaggggacgtctcatggaagaggaggcagttaagctagacctgaggatgctaagtgcctcacataagtagggaaagaaagcataagtccagtctgggaaaatggtgagtgagatgaaatcccacagataagaaaggtgctgtgtgtgtgtgtgtgtgtgtgtgtgtgtgtgtgtgtgtgtgatggggtgggggcggggggatgacaacatgcctacagaatacagggggatgtgaaagaacaatttaccttccagaataaacttccttctttagcactatgcacatattatcttggcctctaatgagactgcaatcctgcgggcaagttgtggttctcatgggatagaagaagtgaggatgggagagggtaccgaggaggggctctgggactttgagaatttggcagtttggggctagtgggcaaggagatttttcccacttcttgcttctctagatcaactactacctggcctattgtatgactctcagatgctaatgtggtgggagtaaagaaggaagcatgtccttggagcccagattatatttcagggtatccaaggcatcagagaagggaaacacaggggaaggaaatttttagaggaaatgtggaggcttggaatgctccacatttatacaatgtttacacactcaacattgtataaaaccagtatgaaagacaggattagtctgaatttcatgaaacattctcttgggcccctcctgcccacaacttcttttaaaaggaaaaatgaagtgcccaatcctcacatttcttcccatgcaagtgaacccctgaagaatggatgctgaggttggggctgctctctgatcagcaaattctgagatactagaaaaaaagaaggaggaagaggaagagaagcatgaggaagaaaaagaaggataagaggaagaaaaagagggagaaggaagaagaaaggaggaggaggaagaaggaaaaggagaagaggaaggaggaggagaaagaggaggaggaaggaggaaggagaaaggaggaggagaaggaggagaatgaggaaggagaaaggaggaggaggaaagaggatgaggaaagagaaaggaaggagagaggaggaggaggaggaagaagaagaagaataacaagaaggagaagaagaatcatttttccaaatatttgtcaaaagcataatgcttctattaaaatgttgaagtgcatatttatgtttcaggaatttggggagaggacaaatgtgtacaaggaggcagtcactcctgtaagtgctgcacacatacagggccttcaaagcaaagagagagttctgcatttcagggaaggcaaatggctatggacattcacagaaacctggagaaagtggatggctcctgggtggatagcaacactgataggtacaaagcgaagaaggaggtgggtagctttcggactctactttatcatcttttagggcctgtgtatctgactactgctgggattgaatctgctggatgtctacagctggaggttaggggatttcacacttaaagtatgggtgtgtgcatgcatgctgtctgtggcctgtttgtttgacctcagtcttaatgatgaactaccaggaaaatggaatttgaggcactcactacctcttggccattcctcaagtgaaaggacacaaagactttatattaagatttatagcaacttcaaagctataattttgggtcttgaacacatcctttaatggaattcttttgttaaccacacatatagaaatctccatgttttcagccacagaataccacatctatataacagactaggcaaatattggcatatttcttttaaaagattaccaatcttaccatttaaatgaatatgctgaaatttaagtattatgttcatatctttacactttgaaaaacaggaagacatccctctgccctagctcaggagctcaggtgaaatgataaaatccggggaaaacatgttttggtactttggtaaatgtgtgtgtgtttatctcattcattagtaaccagagacaagcaggaacatgttaaccatcaaatcaggaggtgggagatcctggatctgatttttacttgtttctatccatttttgagcactatgcctttctaggatttgaatttctcctctgtaaaatgagggaggtaataaatggctcttaatgaaaggtaataaatagtaataaatgaagtaataaatggttcttcaacatttctgggtcacgaagttctttaaaaatataaagaaatctttggactttttttccagaaaaaaaatgcatacccaaagtaaattgaatatagttttggaaaggagtttttatcttatcctaccatagatattatgtactacacaactccgggggcacaattcacagactgtggtgtaaatgacaccaccttggaggtgggcaaagaggtgactctctttatagcagtaccttgaactccaagctaagaactcttttgccagatgagctttaagattctctctggatctgaatttcttcaattccagaaatgtcattattattaccaacaaccctatactaatctggttaggccatctttacaaaatactacagaatgtgtagcttaaacaacagaaatgtatttattttattttttatttttatttttttgagacagggtcttgctctgttgcccaggctagagtgcagtggtgactcacatggctcactgcaacttccgcctcccaggttcaagcgcttctcccacctcagcctcccaggtagctggggttacagaagcccaccaccatgcctggctaatttttgcatttttagtagagacagggtttcaccatgttggccaagctggtctcaaactcctgacctcaagtgatctgcctgccttggcctcccagagtgctgggattataggcatgagccatcatgtccggccaacaataggaattcattttctcacagttttagaggctggaagtccaagcttaaggtgtcacaaagttaggtttcttctgagatctcctctctccttggcttgcaaatggctgccttctctgtgtgtttacatgatgtgtgtgtgtgtgtgtgtgtgtgtgtgtgtgtgtgcgcgcgtgcatgtatgtccccaaactccgagtgtttctttgccttcttataaggacaccagtatattagattagtgcctcacccttatgacctcacttaaccttaattacctctttcaaggctgtatctccaaattcaatataggaattttaagagaacacaattcagtctgtaacaaatcccaaactgataaacacattgcagagagtaactagaaaaatcaaaacatctttcagatcccttctacatgcaaataagtctatcaaaaattagaatgaagtatgctacttttcaaaatgggaatttatgataaataaccagaatttatctgctactatgcttactaaaggggaaactgttacagaggtttatttagtattacatatacacgcatgtatatatctagtatatatgtgtgtgtatatatacatttatttaaaaactaacttgatgttgtataaaataaattaacttttaaattaactggccaaatgtcgtatatagtaggacaaagaatgagttaagatggaaaaaattttaataacctataaacattcttagtttttgtttttctttgggtcctccaagtgatcatcttcgtgtaacataaatcaaacaaccaaaaatctcttccacatctggtaagtgagggtaggaggaatgggggttgctcttttttttttttttttttttttttaaattttcctgatttttctttaactataatggaggatcaggggctgagaagaaaaggccaagagtttcttgtcatttttatttatgtatttattatttctcccccagtgccacatatagtaaccaccaccttctgagtaattcccgaagcaacaaccattctacaccccacccccagttaccctagtgccaatggtagctaaagaagagaaatgttcaagaagaagatttacatattgctggatgttcttattcttaaagcctcaccacgattctatggctgtatagtccattcagcaatgagtcaagcctgtgagttagcagtgttacagactcaccaagaatgtatggcaccacccaatagcatactgtcctttcatccttttttgctttgcatgtactgacctttttctctattcatcttctgtacaccgacaaggtatacattttaggaaattacatctatcaggcacaatgactccctctgtgatgtttcactcccacgcaacactcccttggatgaaatggcttgctctctgcctgaattgggctaagatatatgcctgctgagggcttctgccctcccatctctcttctaccacccctgccttgtgaattatcttctttattcctagggaatctacagtaaatactttgtcatctatagtcatttgcttgaaattaacaggtgggtggttggccaagcaaggcaggagagacgtgggacaggaaaaataaatagtaggcacaagcataccagcaggtgttattattccaaagctgtgtagctctttagcccctgtttctattataaaaattaaaatttttaaaaggcacctgggaatctataggagagagtcagtggttaagtgagttgcctgatatctggcaattaatgtttgagccagggactaaaatccagatatttttgattcctaaagtgtgattaaaatatgtctcaaccatgacatattaaactattggaaatcatacgtaatacagtcctttctatattacttcaaaacctggtttaaagaaacaaaagtatgatttttttcatgacttttcaaaagccttctgattttctccagctataaaggttatatatatatataacctttagagccaaatatatatgctttctcttctttctcttaaaggtaagctttatgctcattattgggactgatgttattgatcatatcagacttctcttttggaataatgtttccaggattttcactttgagaggatcaaaacccaaaaaacatcagatgcatttttctggcatttagttcccaggttgggcagtacattttcaaagtataattgattttgtcaaggtcttgagtttgggagtgaagactggagtatcaggaaatgtacatctctagccatcaactagtaacaagaatggcgtaaatgttctagggactcactctgacatccaaagggaagggagcaacttctgagattaagagacctttggttttgtgatgggaacacaaaaagtaaacctatttgtccatatctcctaagactccaacaaattatatgaacaactgcaagttatctgaatatggaatgaattatggatcatcaactaatttaatgtaaccccaggttgcaattcccgtttttagagaggtaacacaaaatatttttaatctctaaattgtaaattgctcaagcaccatgtaataaatatcaatatctaacacaaatgttttggtcatcacttaactatcatatatataattgaaagttgactgtaagtattgcacaggagggcacaaaagatatgtaaactaattattatccagtagtccacactgactatcatttgtatgtcatttgttttattttattgcaaagtaggcatgttgacacgtgtgttgggtgacctgttataaacatatagaaaaacaaaaggagagaaagagagataataatttgatcacagttctctttctaaaagcattgctttaatattctcttatatacaggtagtgataattaaggatatagaattattttctaaacacgcataaatttatagttaagagaaagcatctcatttcaatgataaaatgagagatcatttaattttttttttttttttgagacagagtctctctctatttcccaggctggagtgtagtggtgcaatcttggctcactgcaacctgcacctcccaggctcaaccgttctcatgcctcagcttccctagtagctgggattacaagcatgcaccaccacacccagctaagttttgtatttttagtagagagggggtttcaccatgttggccaggctggtcttgaactcctggcctcaagtgatccccctgacttggcctcccaaactgctaggtgagctaccacacccagctaagttttgtatttttagtagagagggggtttcaccatgttggccaggctggtcttgaactcctggcctcaagtgattccccctgacttggcctcccaaactgctgggtgagctaccacacccagctgagatcatttaatttttgatcacaactattgggagtattttaaaattgtaattgacgtagactggtatgacattggggactgatgatatggaatgttattgctgattcttcagtatgtggacttcttgcattatgttccatatattcttaaaagaatggggctctcatataattttatttcagatatgtccattatttctggactgttagttatgccatttaaattaggtatagccttgctacctttttccagcttatcagttttaagaaagatatggtaaatttattcaactaatggtaaacactttttctaaacattgttctaggttctgaagaatcgacagtgattgaagaaacaaaaacatttactcccatggaacatacattttagtgggttttttaaatcacagatttgtcattttttttagtcagtgtgtgctttatatattttgaggttatgttattaggtgatacagatcaggactgttacagctgatctagttaattgtttttcttcaggatataacgatgtttttagatgtaaagtctattttgtctggcaataatatttccgtatctgttttcttttggttaacatgtttcaagcatattagttagaatatttgtttgacagtatggtagttctgcttctctaggtcacctccagatccaggttgcctttttcttgttgctcagccacagcacattgggcaacctatcagttcagcaaatgttaaccagaagaaaacatgtggtaatgtccacatgggcaaagttggctcatcacctcatccacattccagaaaaggggcaaagagaaagcagaaagaaaacgtcagcctcttaaggtatgacttagaacttgcacacataaattgcataggatttagcaacagaatagtaatgccatttagaccgtagacacagtagataggtggtttgggttcaaatactggctctggcacctcctggctgtgtgagtatagacaagttacaatctatgcctcattttctccaattgtaaaacagagatacttataataatatatatcttatacacattaatcaagtattggttattattattacctttatttttcttctgcagtttctagaatgcctttgtttaatcacttcaaccatatttattttggcaatgtatttcagattgttctattacgtcacattatttgatcccttgttctaccattgttgtggttattaactctctctcatggtggactattttcttactaaatttttatttttcttattttattttattttattttttgagacggagtctcgctctgtcgccaaggctggagtgcagtggcacaatctcggctcactgcaagctccgcctcccgggttcacgccattctcctgcctcagcctcccaagtagctgggacttcaggtgcccgccaccacgcccggctaattttttgtattttcagtagagacggggtttcaccatgttagccaggattgtctcgatctcctgaccttgtgatccacccaccttggcctcccaaagtgctgggattacaggagtgagccaccgcatccggccctatttttcttattttgtactgaagtttatgatactgtaggagctatgcatgcctcactctagaagaaaattccagctattctgacattaatatagcatatgatactaaacaagtcactctcttctgtatctgagtttatcctaggtatctcctgaatagctaacatccttctttttcttaccggcgactgaggagagatggccttgtgttggttagacagagcaaagtagttctgcagtctgtcccacggttctcaggctacacgtctttatttagggtgattcatttttatttatgtttagcccaccatagttccatgctgaagaggtaaggaacaatagggtaagcaagccagccagcatattcttcccataccgatgagcttttcaccagaggaaaatgccctctcagatcacagaaacagtagctgtgtaggtgttgctagtggagaaaaaaaaatgtttggtatttaaaatagaaacataaaattgttaataagtctacagacaacttgtattgcatgcagaaataaaaaatgaagtcctagtacaacaatactgcttagtcttggattcattttacagaagtttaagattcctcacctcaatgaatgagattttaataaacagaagtgtattagaatatttgcagcatccaggcattgggtttgagcctcaaaataaggccagggatgacatttaagtaaattcagaagtaaaaagcaaatggaaaacacttttaatgatgtgtcacataatgtaaaatgtgaaaaataacttagaggttatatactccatcctcttgcttcagggtccctaacaggcatctctcacttgagcataccctgtgatggggagctcactgccttgcagtgaatctttgattttgctgtggctccaaatgttggaaagtgattccttatgagataattgcatattttggaggttcccccaccacacacacatacacagaagaaatgttctcccctatagtaattcaaaatatctcgatagtattgcacaaatatccattaagtgtctcctatgggcctaaaactgtggacaattggagataaggaatattgtcgttttcattttgcctgtgagaaaaagagttttcggaggctaggtaacttgtccaaggaaacgattgagcagagatttgaacttaagctctctggccctggaatttaagctgtctggctctaggactaggccctcattccctgcatgatttcagaattcatgattccatgaatcatgtagggaacccagatataaatcaactgataataacagaatgtggcaagtgtgaacagaactgtactttaggaagctaggaaagaacaactaattctgcctgtccagattggaaatagtaagttttgaagacatagacaccatcaatgccaaagtattgttatcataatgttgtttcacctattttaagaaaaatctgtttcttctacctatgacataaacttacatttcagtatcccccacctcacctcgtcatcagttttagaatgtgctaaattctcaatactactgagaaatgcccttattccccatattgcaaagatttctggggctgcttaataacactttgtaccttctgttcagagaacattcatcttattctcctctcaaattctctgttaagtaaatttaatactacatagcatcaagaggaaagtgaccatttattttagatctgtatctatcttagacgatgtacttttcatggaatagtgagtgagacagacacttgagtcaggtgatgtttgaactaggatgttcccagaattaaatggtagtctcttaaattggatctcatgagtactttagtatctgaaaagtaactacatggaataaattaaacagaggaaaactcctggctatgccattattaaacttttttaaaaatatggtctttatttgacatttctgagtatggcaacccattccttggaaataaagaatgtggcttccaacacatgagtttccccctccctctcccctcccctcccttaccttcctccttcttccttccccttccctttctttcccttcccctttctttcctttcccctttttttcccttcccttccctcccctcccaccccttaccttcccccttcctgtctccttttttccccttccctcccctcctctttcttccccttccctttccctggcctgccctttccttccctttctcccttccctcccttcctcttcccttcccttctcctgccgtgccttgcctttctgtatcccatggaatacctctcttttgcattggaagaaaaacttgatcccttttggagctctttgggctttaaaggtttaagtgccaagtgaacgctgggcttgtttgcctcctttaggaagccccgtgtggatgattccacccctcattgataatcttcttactttacactcccctttctctgccaatttaaaatcattcaaaatcaagttcatcataatagtgaacgtcaatttacaatgctcttttccaagataacttcttttcaaaccctcaaaactattctatgaggtagagatgattcatagttgtacagttgaggaagcaggctcaaaaagtttaaggtaacttgttcaaagtcatatagccagtggacccaggatttgaactctagtcttttaacactcagtttacgtgttaccttgtctatgaatccttcttgatggtccctgctttccctgccgtagatcagtagatcaattccattctctattcccctgtgtgctttgtttatacctttgttctagcacttatcacattgtatttgggaagcagtgtatttaaatggatttgtggctggtctaatttggtttaggtttttttttttttttttcctgttagtttatttacttcctaaggcctgaaatctcttcttcattatttgacctgctggacttcatgcagtgctttgcccatagtatgtataaatttagtgttcatggagaaaatgaatcaatgcaccaaagtgaaggacaggggctgcggtttctttgtatcctgagtggaacctagttcagaggtacagtcacaatcacttttaaaaaaatgttgaataataatgaaatactacataaatccaatagaaattcttaaaatatttagaaggcatgttttctaggaagaaggctaattattagaatttattttttattctagagaagaaagagagaaaataaagaattaaagaaataggaaagagaagtcactagagagccctttcacgtcccagagcagattaggatcttgagagctctaccctactctgacaaataattacttataaaacaattctggggtttcatagcctgcattacctggttccagggaccaatcatgagcttcgttgttttggagttggcttggaggacatttataagaaacatgtgatgaagttgcccctttttctgcagaagataggcaaagagaatcccatgagttgggtaacatgtgggacagattttgcattccgtgatttgaaattatgggtgggggccgggtgcggtggctcacgcctgtaatcccagcactttgggaggccaagacgagcggatcacgaggtcaggagatggagaccatcctggctaacatggtgaaaccccatctctactaaaaatacaaaaaattagctgggcatggtggcttgcgcctgtaattcccgctactcgggaggatgaaaaaggagaattgcttgaacctgggaggcggagattgcagtgagcagagatcacgccactgcattccagccagggcggcaatgcaagactctgtggccaaaaaaaaaaaaaaaaaaaaaaaaaaaatgggtgggagggagggtgtttactccctgccctggagatttgtataaacaggaaaagaagactgttttcttgtttagtcttttaaactaaagacttttctctcatctggagaaaaaaataataatggtagtaataataataataataaaatgggccgggcacggtggctcacgcctgtaatcccagcactttgggaggccaagacgagcggatcacgaggtcaggagatggagaccatcctggctaacatggtgaaaccccgtctctactcaaaatacaaaacattagccaggcgtggtggtgggcacctgtagtcccagctacttggaaggctgaggcaggagaatggcatgaacccaggaggcgcagcttgcagtgagccaagatcgcgccactgcactccagcctgggtgacagagtgagactccgtctcaaaataaataaatacataaaataaaataatttttattattgatcatttttgtgtgtcgggtactatttctagacaatttacatgtattaactttaaacttgacaacaaacctattagatagatggtatgattactcccatttcacagatgaagaaactaaactacaaagaagctaagatcgagccgggcatgatggctcacacctgtaatgccagcattttgagagtccgaggtgggcagatcacgaggtcaggagttcgagaccagcctggccaacatggtgaaaccctgtctctactaaatatacaaaaaaattagccgggcatggtggtgcattcctgtaatcccagctactcgggaggctgaagcaggagaattgcttgaactgggacccgggaggtggaggttgcattgagccgagattacgcactgcactccagtcttggtgacagagcaagactccgtctcaaaaaaaaaaaaaaaaaagaggctaagatcttggccacgttttcacagcagctaacaagcagaatcaggatttgaacctaggccgtggagcaccagagcccattctaaatctgaatgcactctcaaagtgtcttgcagggaggtgagcccagtctgtctctctcagacttcaagaccatttgcagtggtccccatacctattgcaatgattctgaataaagtctcctgtaccaaaaaaataaaaagtattctctaaatctttaatattttatcctagaaacaaatgagattattccttcttttattgtgataacatattatgataactcattttatttgattccctaaaaccggacagagatttccatggtgctgaggatacgaagtttagaccttcgatagctagtctaagcttagtggagatctgatatccaatctaagcttagtgaagacaaacaggttgtaaatgcccaaatctctctatgagaaactaattaagccctgcctttgagtaaaagagaaaaaaaaaaaaatgcttctatattaaaataacttcatttggagttcaaaggaagctaaataaggttttcacaggaagagttcatatttttttaatccttaaagtaatgtgtataagtttcaatgaagtaaatgtcccagctacattattcaaactcaagagattaaaaatattttttttccaacatccaaactcctgatatccctatttcagccacagggaggacaagggcataactatggatgtttattagaaggataagttaaagaggcagaagcagtatatacattctctaaactatacatttatacaaggatgccattgtctttttttaagcaaatacttgtagaagtgatgtctaaaagaataaagcttctcttctatatctccaaatagaaaatataatcaaaatccgcttttatgtaggatggcttttttaaataaataagcagaaggatgaattatgtggctataaataaatctactgacatgtaataaagcaaagtcgaactgttttatggtgtcactgaaacccttagatatatttatagccatgttaacagtccccagtattttttcaggacttttatttcatttcacattatgagagtttagttgtttgtttttctctccctaaattgccttctggagccctttgtagagatagaaagtaaggatctctactcttcatatttggaaaaaaaaagggtcttcaccgaaaaagcttagggctcacacagaaacagtcggttctgatgctttctggtctgcctgtttctgtgcagttcatatgagatgtgcctgcgaagaacaacttgacaggtagctcctgctggcagcaaagtggcaagtcagagtctatacaagtgaggagaggcctgtgcagagataaaatgtacagtactgtagaaaacaagcagatggacagagcaactttgcattagattcctgatgcctgacacatttaaatacaatcacaaggcttatttcagaagccaaagaatctccagactatcacatagccgaggcacagaccaaaacaagataaagggtctgatgggtaaagatgctcacaccttaccctgggacattctcttgcagggtgaggatggggggggggacatttaaaaagcaagaggagaaggtttataataccagttctaaagcctgaagtaatataggggttttttaaaattgtattccatttagaaatttcaggatccaaagagtatggttaggattccgtggggggtttattcaagtggagctaagcgtggttgttcctgtgaaattatttatatttttcaacttgaaatctgggtgagcatagtgtttctaaatctatttctcttcttttctatcttaaaagtggactctcattttcatcctgtagctatacacttgattcccaagtgttatcactcaagggacccactagaaaagccaactcaagaggaagaggagagcttttgatggtaggacaagggatgacaaatccttcagctggaactctagctacaggcagtatttagaaagtatcactggagctaaaaatctttaaaaatgtatttaatgtgttagactaatataggctctaaaagacctaaaaagaacaggatccagaaaagaagtcgaaataggaatgtgttaactagagggaggggcaggagggataagaaacacatgaaaaaattaacagtggggtaaattggagagggacattcattttattaggataattgggggttgtctctttgtagtggaagaagtaaaatagacctgtcttacatttgtcctctgaagagtcttctcagtatttaactgtgttcccaaatggaatcagccttaccaaaattcacggtgacttcttttgacattttgcaaaaagtaaataaataaattataagtatgacaagtgaaatgaatagttccagctgtgatgcaccagcagcatttccagattttgtactgcattaaggatttattttctctttattgcctagcagagaattaattggaaggtccatctaagcttcccacacatcctcagaatgaagtcaaagcagtctccaatgctcaatgccaattaaaaaaaaaaaaaaaaaagaaaaacagtaagtgggtaggtggtcagtttatcaactctggaaaagcttgtctttgaggattcacactgctaaagccagacaaacgcatcagcaaaattaatggcataaggaaaatgtgagtatgagattggcaattgattcactgagttcgttcattcagccagtatttactgagcccgtatgatgtgctacctattttttcacacacacagaaaacaggagaaaatgaagactcagccctcagagagcttataaccattttaaggagataaactatgaacaagtatacagataaaataatttcagacactggagagtgctgtcaaggaaataaaacaaggtaatgggaggggatgccttccaggggtggtggtcaactttaaatgaggaccagagagggtctctgaggaggtgacatttgaaatgcacccatcacatgaaaatcttggggaaaagccttccagacagaaggggccaacaatgctataaaggccttgggatgagaaaaaacttcccacgatcaaagcagaaagacctggggaactagagagtagggaggaatggggcatctggcaggagatggagctgaagcattagagttaagcagagtcatctaggccgccttaaggccaaaagtgcagtggaaatccacctggggactaaatcaaggagtggttgaattgagtggaaattatcatggatatttaggatattaagaattttttctggcttttctagcaataatagcataagaccctaaccatgtacttaacctgttcttcacctttttagagcttcagcttatttttctagtggacaaagaatattgccactgtttgtcaggtgctctaccagatactgtatattttctcattttaaacccccaacaacctcgagagggaggcatattcctcattttacagaggaggaaactgaggtttcaatggaatgtccataaaccaccccttccccttgctgtggtgtccctgagagcatgctgctggtttaagacactgcgtgggggcacacccaaaagtatgcaagaccttgtcagagggccatttcctggggggctgtggatcctggaccacccttacaaatgagagccagggcagttagggtgactgtgtgcatcatttactacgggcagcttgaagcttttggaggacaccaatttcagaaccagaataccagttcactgccataaattctgaaatggacttgatgtatgaccttgaaggcaaatcacctgtaggtttggtctttttgttagagagacataatgctgtttcctcaacacctccttggggtgtctcaaggatgaatagggctgtcttaatccctgttctttatcctcagggggtttgaaatgagagtggagtatataataggtgctataagctccttttaaaaaagcctcctaaatacaacatatatatgttttaaccagcaagtattgttcactcacctccccttcctccctgcaaatgtaatgggctttttacccaaggtgaatggtaggagggagtcaaagctagcaagacctgtgtggacaacaacctggcctgagagggcagcctgttgggtttgtccttcctgcgcatgagacatactggaggggtggatgccgcctagtccacagtgttaccgtgtcctggcagagccttgggtcagtcccctcctggagtcacagatggccacgacagaggacaggtgctgccattctggctctcccctgcgtgttcagtcgtgaggtaaacaccgtgctgtctttgatgcccagcgcccaggggacttcacccacctggggcagcccttctgcagccagttccggacaggcgccagtcacttctctttgagccagccgacttggccctctccccttctgaagttttttgatcaggactacaggcgcggacgataacctctggattttgaatcccaacagtgtcctatccaccaccgggggtggcagccaccttctggaaggactgccaatcacggagcccttcaccctttggagtccccaggccaccgctccaccttcacttttgggagtccggactcagattcccatcattcgccctgcgggaggggccctgggcattttaaccccgggagacacacgcgcctggagagtggtcgcccaagccaccgccaggcagggaggagcgcgcgtgcggcaccaccgcgtgcagcagctccagcgctcgcgctgcctcaaggggtttatttttatttctatttggagctacttcggccttagccgccgcccttacttttcctccgaaattgtgagaaggtgccttcatggctggagtttggtttcacgcgcctgggagaagagcagggcacgggtgataaagaaggcgcagtgtcggtctgtcggtgtcacacacgcgcgcacacacggcggggcgggagccgcgcgagcgagaggagggcgggcggcgtgtgctggaggctcgcgcgggtgtatacgagcctgtgcttgaatgggaagggccgggattccgggtcgctctggcccctccttcctccggagccagccagtccctcggcagagcgctggggctgcactgatttgctctcgggagtgcgctatttgcatatgacttgcccatttgtgaatttggctccccaactcctcgcttcacttcacctgtgcctccctggtccgcgcacttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacggtaggtctctctgctctttatccttttaatggggcatagcaattcgctaacccactagccttgcaggtagtgtcaaaggtgggaagggaatttaaaaaaaatgaatttaaaatgatgaaaagcatcgtatgtccatgagggaagcaaatttctactttctcataaaggttagtgttttctgcccctagcctccgacaaccatctccacttttctctaaagggttcttttccccttagctccctcattcatagctgcacagacaccacactctctcttttgcaaccttctactctctccacccccacggagacaggcaacttatcaggtgagtcccagtgctgtacttggagaaatattcattcaccttgctttcacccttctttgctgtggtcttgcttgggagctagtgggggtggggtgggaatagctgacaacaggaatcaggttttcagcctgaagttgattgaactgttataaagtagcctgtgtggtaatggtcagggaaaagtagccgaacataagaaggcagaaaatataattaacaacctgtggccatttgtgttgaatttggcagctttatgtttgtccacatatctagtggaaaaagcagctatctctaaaactacacatctactattgctatcagaaaggaagcaatatgtaagataaggctaagttcatttataatttacccaagtgtaaatgacagtaacttggattccccgtgtatgcaaatgttatttcatctttaggtagcagagatgggcttgttcacacaatacaggtacgatgggttttactccaaacaaccctccttacatggctattgagggaagagatctatggctctgaaaatgatactcagctgttagccggctgcctctaaaagggcgatgtctgcagctaaggtaggagcttgctgtggtaaactgttctaaagaaaggagcttcttaatttgtttactatgcactccactctgatggtaaggagagtaggacacacagaaatggagactggtcttgcttgggagctagtgggggtggggtgggaatagctgacaacaggaatcaggttttcagcctgaagttgattgaactgttataaagtagcctgtgtggtaatggtcagggaaaagtagccaaatataagaaggcagaaaatataattaacaacccgtggccatttgtgttggttttggcagctttatgtttgcaggaacagccctccagggaacatgagcgtgaaccatactagggggttcctgcccttgtattttgaagactgataacatccagaccctatttggaaagttgattcttcctgctgcctcctagccctgagctttggctttatgctgtctgtagtgtaagtggaagcacattgagaaaatgccagcacatactctggctctttttgactctgtctttaaattttatttgatggagttgtcaagcagctcacagcttgtaaggttggtggagggggatggtgaaaagaagggattgcttgatcttgatctggtggctcttttctctgtgactcctgctgggtctggtgttggctcccttaaaaaagaaagaagcaaacaaacctaggagaaaaaagagccacaaccaccaaaaaagcaatttcattgacatggaaacttagctcctaagggggagagggactggggggagcgggtaagacaggaaaaaaagagggagtgggagataggggaagccagagagactgttactaatagccataattaaacacggaaatgctcagagattagctaaattttgctaattactgtaaatgatcagcagggagaggaagattatgcattacaggttatgggtggcagggtcttgatatcttttgttcgggttgtaaacagttacagcagatactagtaagtgatggaatttgcagagcagtacttccctagggtccctaagtcagagtcagtctctctctctctctctctctcataaaggggttgagccttgcacaggttaaacatgaccctttatttagtttatttcttcaacgattggttgctcagtctcctttaaatctttttgactggtccccagtctagtttctcattaacctacatctgataaggttcagtgtgatggaaaataagaagaaagtaagtaaatggctagagaccccagaaaaggccctcagactcaccagagctgtagagtacagtgaactccatccagggtctggcatggctgagataagaaaactcatgaattcagctcttcagaatcctctttcaatcctgaagtcccaactcattgatttggggcttggagagtgaatgcatctgtattaagtagactccttgcatatttaattggtgtttttgagcataaaatcaagagaagcagcaatcaacaaaatatccctacctctggcttccatcctgcacccaagctgtgaccctttgcgtctctaactaaaaggaccagaagaccccacagagctttgctaatgcacttctcattcttacttggtgtacacttgctttttcctagtccaagacaaagacctagctaacagcaattgttttaaaaaatatttttggatggaggtggtaggaggcatggcaccaagagactgatggttgttattgatgatttactgccaatcttattccagagttaaaggcagcactctctgttgtctgtgaaaaagtaaatgcccttgattttggtatgaaagaaaactagagccttgagtccaagaatcttctttggacttaagagattgttgtttttttaactacacttgctcttcccttgcccatttcctgagaagccaaagtcctcaaagctgctgttcatcagttggtgctcccaccccctttctctactatccagacctatagagagattcatgctaagacagatggaagaaacagaaatcctccaaatagctgatattttacctacacttttgcctgtgcttggttccaagctttagaaaattggttatattatagatttgcttaaagcctttatcccaggacagcctagaggatgctgggattctttgtaaattagggagactaaggccacacttacctggggtgcccccaaaaaatctcacattaggattgtgtttcaggataggattaaccttcttcttaatgggaatctagtaggctcttccccattctgttagagtcctcaccccactttcatgctctcttctgttcaccagtcagtcaatactctttgagcacatactctgtgccaggctgtgggctactgctgaagatacagaaccgaataagacattgtggtgttcagctaggaataattgcaaaagtatatatatatatgcttccatattttaaaaagtgcaaggagtgggtggagatccaaataccaagcgaaattaatacaaaatcaaaatatcctttataaaatgaaggtttacattatcctgttatttaaaatatccctccaggttccttttcatccttggctttatttccatatgtaaatatcattttttatcaaagtgcaaggtagtttagtgattacagatatataaatagtaaaatatatttgtttaccaagctttaattacataagcaacttttgtatattttttccttctttttttccctctctctcttaaaggtcattggacctttaagaaatccaatgtgtctgggcatggtggctcacacctgtaatcctagcactttgggaggccgaggtggggggatcacctgaggtcaagagtttgagacctgcctggccaacatggggaaaccccgtctctactaaaaatacatatatatatatatatatatatatatatatatatatatatatgtatctccaatgtacatctgcctaaaaaatgcttcagtatttatagtttaaatgcaggtttctctaaggattcaaggttttatatgtaccttaaatgctattctctataaaacagcagactttcctgcctctgtagacgatttgtggggactagttgaggacatggaactcttggaaagctcagttttaaaagggaacacaccacgctatatttgcaggaagaactcttgctcagaaaccagggtgtgtgaaaagggggagtataaaagtcctattcaaaccatcttagcagaagtggtggtgatgggcccccttgtgacacatgatcctggagtctttcttggactcattccttgtcccagggatccacccccaaagttttttcagccttgggggcttgttttgctttgatctattgagtgccttcttctgctcagccagctgctttctaaccactttctttatgcctgccttcttgagattcagggagttgaataattcatagtgttggttgacagatcaaatgataagatttatatatctttggccttggtgatgaattaattagattggtttctccatctttggctcctctagatgcgttgtttttcttctttaaaattcactggtgagtggtgggtctggagattaacttgttcttgagagaccaccataggatgattataatatcctagtgtcaatttcttcaggactttcaacatggatcactgggtggtgtggagtaggggcagctatatcatagagaggagagataagatcatcagaacaaaaaacaagacgcacacacacacacaaaaacttgccgatactggctgcgggatgaaattttacagtaagaacttgattgctttcacctcagattttgaatctaaaagagaaatgtatttcattttacattttagtaaatgaacttatcagcccaaagaagtttgctttactagaactctgggtgaccagggagggaagcaaatctctgaagataaatcttgaacttactcatactttcctccttgtattagtttgctagggctgccataaagtagtaaagtactatagactgggtggtttaaacaagagaaatttgtttgctcaaggctctgtagagtaaatgtctgagaccaaggtgtcagcaggtttagttctttctgacatctctctccttggcttgcagatggctgttttctcactgtgtcctcatagggtctcaccttgatctacatgcatgcatccctggtgtctttgtgtgtccaaattctcccttcttataagaacatccatcagattggattagggtcctccctaaaagcctcattttaacttaatcatctctttaaaggccctgtcctcacatacactcacattttgaggtaccaggaataaagctttgacatatgaattttgaagagacacagttcagcccctaatgctctttctcctcaccgtgcgctgccccccaccgccccccaccatcccccgcccagttattgggaaagaagtaaaactgtactgttcagtgaatacccattggactcaaactttcacagcagaaaaataaaacttcagtgacaatggttgcaatttacaaaattcataagatagtgccctaagaggtaatgttgtgtttacagatatggggaaaaaaacagctattggttcagtgaagacttgtgttttctttcttctcagtttatcttctgtgactgagtccagatctttatttgcacatagactaattctgtctgactgcagacacatgctctaatgtccacacattaaagctttctttacctagacctgctacccttctgacccagaccctccactcctgccactgactcctttatgaactacagttgtttgctctttgcctttcctgaaacacaaattaccaactactttcacatctcagcctttggtgaaaacaagagaaaaaataggttaactaagtataaatttctcgtttttcaattttcatatttctcaattgaaaaatatgttaaataggcatcagtttaattatttttctcttcaattttattttttgaaagttcatctgaaaatataaatatgaggtaaattgtctacttcatgacatggttatgaagcttggtgagatgattgagagaataatatatatatatatatatatatatagtgtatatataagttctggttgttctaaatcctaagcaaagcattccatctttggggaaagggtatacctttctttgtctgtttgtttctgtgctcaaaatgcgtgctgatgttgataatagataaataataatggcattctggtggacagtgtggtgttaggtgaggtgggaacaactatggttggaggaaatagccttcaacctcaacctttggttctaagaaactttgtctctaagaaactaagttactaagaaacattgtgaacttaagtcacaatgaataagtcacttggtttcactgagactcaatttcttcacctttaaagtgagcaataataatagttaaccatacttatatcacagaaattgtatgagagattaaacaagttgtattttgtacattctaaaccaatgtgtacaggttaaatattttatgagacatattttcatgataaggctgccctctttgaattccttgcacaaagaggagcttcaatgttgatcatttgctggttggtagatagtggttaaagaacatgcatctgctggttctcctcattttcctatctatacatacacttttttgcctcctagagattatttcatttacatagtactctgagtaaatgtagatgagaaacactttactgtattttcatgtttatggcactagaacacagcatgggacaaaagtcagcttgtgatttttggtaatggtctgcttaggtagaaagtcatgccaggcaaattttagcatggaccaacacattatagcaaatcatttagaagctcagggattcagtaaagtgaaaagagaggactccaagaaatactctgagatcattttggaaattcagaattggatcccatttgcagtaaacctgtgcagaattcaaacattcctacatggttctcagtgtccattgtaaactaagatttttaatctggtttgtgctgggaagaagcaggtgtttttagggacaactaccttcagatgtggaagtgaagtacttcttttaatgcaatttcttaggcttactagggctcaaagtttgtagagcagataggagcacaatattatgccagaactcttagaattgactttgtgaagcctgaatttgaaacagaattcttactgagagacatggtcctgatacatagattttgccccagttttctccctgaccagctctgtaactttgaattataacattatatttttaaattatattcatcttttaacttttagacattctgtgtgataccttgatttcctaacctatattcttggctttacctgtagttttctgcatggcatgtagtatgaaagctccttaataccatagctggggaaaactttccttttcatatcttcatcatttgtacaatgagagatttgagtgagatgatctctccaaatgttttccagcactggaactgcatgagtctctgatttgtatgtctttaaagacaccactgtgcatcttaaacctatctgagttccacaagtctgccagtattttataggtctattttcttgactatcataataacttatgccaaagccataagccaggttttctcttttcccctcagacagaagcagcataatgtaccagagtggcacactgtgatgttataaagcccacaatccaacttcagtgcagtcacgctgagatgggaagaatgcagctttcatttaaacacaccttaataatgctagaaaggagctctatgttatgtttaaaatattctgctgtgtttagccatatcagagcagggggcagactagcaactgggtttataaagaggaaatggtttatttctatttacagttaggattttgagagagacttgcttgagttatacaccaacacataatgtacacccactgtgtgacaggtactcttccaaatgctttacatatgtgacttcatttaatcctcactagcctttgaacctaataaagtgactattttacgattaaaaacattgagactcagagaggttaagtggcttgattaacatggtgttaaagccaggattcaaacctggttgtgaccagaaaactcttggtctttctgctgtaccacacagtctgtcaactcaggaaacagactacacaaacacatcaagctcttttgtcaggaatcaagtacacagattgatgaagcactttgattaatgcagctaacacacctttccaaagcatctacaagactttccaattcctaataagtatttgaatgttttccaatctgcctgaacccgtttcaacccaaggagatagtaaataaaaggagcagactgatgaaacactcacacttgatatgtctttttttttgaatgaatgaatcaatgaataaatgattgagtgaggttccacatgatcaaatctcttgcactaggaaaggagggatgctagtttataaaagaagcaaaggcacaggaagttatgcacccttcaaaagcacaccaatgggctcgtagaacttagagatataagagagctcaatgttccaggtaggcagggtgaggactcaactaagagcatccagttagtgtcaggactggtcaggagcacagacatcatgactctgagtccattgccttttctttcctctacttctcagtccttcaagacactttcttaaattacaaacttgttccccatctctctttcttcagagaaatctccccttatccagattatgtcctgcaggcacatattctgccagtgttggacttgccaggccttccattaaaattaattattggctgggcgcagtggctcatgcctgtaatcccaacacttgggaggccaaggtggctggatcccctgaggtcaggagtttgagaccagcctggccaacgtggtgaaaccccatctctactaaaaataaaaaaattagctgggcgtggtggcatacgcctgtaatctcagctactcaggaggctgaggcaagagaatcacttgaacctgggaggcagaggttgcagtgagccaagatcacgccattgcactccagcctgggtgatgagagagaaactctatctaaaaaaaaaaaattaatcatgagaatccttctaataggttcctggctttgtgtgccaaggtagggtttcttggtgtgttctgaaggcttcctttgtataggaaacctcagtgtgaaaaagtgctcagattcggggttctgtgaaagatgcttcctgtcctggttggatgtcacttgccagaaggcaggaaagaaatggcctgtctgttcacctgttgctgctcctcatctggaagttgtgaccaggatcttgtttgaagacctgtccccagccccagtcctgacctcttgcttaccagctattgagtggctatgaaaacataaagcccctggaaaccagcaagccacattttctgagatactgtcctgccctcccttttttattgttttgaaatattcctctcacccccccacgttaaaacataaccatgtgtattcactcctgagtgactttcccccaaactatgaatttcaactatttccgaggcagtcgttcagaatttgaatataattacactctttgggtgaaaattgtggtttttgctacataaaaaactaatggaaatgatctgcctgttcctgtagtttacagattatatgcttcagaactgacgatatatatttaggctgcttttctgtgtggcacatttaaatgaaaatgaactcggggtgagccaccatggttgctaggcaatagagcgggttgatagagcacggtattaaactgaacccacattggtgttttacttaacatctatttgcttagcacctttgtcatctgtggtgtcatagaagggaaaggaggaggagacaggcagagtctggttatctgcagagactcaaacaagtaggagaaataatcatcccaaacaccaaagtgacatgagcattttcaaaaatttgaggttgcagcacagtcaactcatttaatgaagaacatgcaagacctgaagaaatgcataagcatagcagacatattcatggatgtggtagcaagaggaactaaagagattccccaggctgggttttgctctggtggttccagaaaaaaaaaaaaaaaaaaaatagccaccacgctggttgaaaattttaaaaatgcgtctatgggtcatttaatttcctggcctaaaatcccagatttatcatgagcaagcggtgataggcagcaaaagcattgcggcttctttacaattgataactaatagaggaactccaattgctttgaaaccctggttttaataaaagctgaaagtctcttataagaaaacaactggatcacaataaagcaaaacctcgtcagactctttgggtccattctagccactttctgatacatttaaaagtttgaaaagatgattaaagggttaaaactcagctgtggggagaatttggtctcatgaataatttgggcagagagaggatcctgtgatttggatagccaaagttttattgtttattttttccaggagccaattattatatatcttttttcattgaatcaatatctctgcataatggaatggtcacctttgaatgttctcttttcttaaaacaaacttcttagataagttaaacacaagatgataggaaacctctattttcataagaatgacaataacatctactttggtttttattatagcaattgatcactttttattatgcctaacatttttgcctttcaatatgcctgacatttctataaacgttatagttcatttaattctcccatgaagtaggtggagttgttttcccattttttaagttttagttatttattttagcagagatggggtcttgcggtattgtccagaccagtctcaaactcttgggctcaagtgatcctcccaacttggtctctcaaagtgctgggattactggcatagccaccatgcccagcccattttcccactttaaagaggcagactcggaggcatggaaagtttgagtcagttgcctaaggtcttataggtaatataaggcacaatcaggttgggtatttaagcagtttgaacctgtcctgttcaaactgcttaaatacccaacctgattgtgccttatattacctataagtatatactgaaattatactgaaaacagtatactgaaaacagtacaatatttcataaatactcttaaaatttcagtatttatgaaatattacctgaatggtgggaaaaaatttcaaagtggtattcttaaatggaatactgggccatttttaaaaggacctcttagggtctacctagatacaggataaattatgaagacagaatattttctaaacaggtaaacacctacctcatatgaggtattctaacaaatactttagcttactgcatttaatctttactgaccatccttcaaggtaggcactattgttatcatgaatttacgggaacagaaactgagccccagagggttaagcaactcactctagttcttccacttactaagcagttagcctatagcatctgttgaactcttaggtcaggtaatctgtgcaaatgtagaacagttcccggatactgaaagcaactaatcagaatgcttccctagattcacaaattctattacattataggagaggcttttcaaaacagcctttggaaactcacaccagttccagaatctgctggcaatgaatagttacatctttacatcttcaatcaaggacccaagagtgagggaccccctctcctttgacagggaagcccattggtgcctcattctcctcatgtttaattcactctaagaatccgtttttttcaggaagtttcttttccagtaattacgataggctttctccccaacttatgattttaggcaagcaaccaaactttcctgattttaattctctcacctgaaagacagggaactgtgaggtggcctgccagctttgctttcaaaagtgtggcattcatctttcattaatgccaaaaggcaaaattccaatgatttctaaaatacttcctcacccttatcagatcttattagatcaccttgaatctacttttaatcttggcccttcatacatatggtagtagttctttaaatatgagggtgaaactaatgaatacgttaagaggggcagtgggtttccaacttgagtgaatatgtgtgtgtttgctttcacatgtaggtaaatgtgtgaaccaaaataaacgatgtaacagaaaaccttcatagcagcccaattagttcctagcttagaatgtaaagatcagacatgagaactaagtctgccgtgcattacagacgtagggaggtttcagtacctgcttcttactgctctggtatcatttatcagtgcagtgttgtcacaggctcatgtcaacatgtcaataataatctcaggagaggatagcttttatgtgaaataggaaggtaaacctagagtcttggccttatacagacaacccccttctttgggatgactagtgttttcatgtttcttgttttttccatgccagggagccattttatgtgtgtgtattggtaacctcatcaactgttagctattaaagactggttaaactaattattattaagaactctctttcagaaaatcctgagatagttccttttacttcccttcacaaagtaacttgatattggtccctgagaaatagatccacaacctcatcaccaagttctccaggccctgaggaatgatcatgcccctaaaataatgttctgatgaaggactttctttggactcaaaatctgctttgcatttgtggaatcatcaaatgcgaaacctgcaagaggtctttagaagcccttttcaatcaagttatttttcatgtgaaaaagctaatagaccagaagtttgtgaatagttttcccaaatcacacttttcaaattagaggcaaggcgagggcaacgtgcaagctttcagcttcgctgtttagtctctttctagtctctttctactgcatcacaatgttagcactcaggctttccaggtgtcatctgttttgctgtggactgggaaactgggattgtctccagcaccacttggataacaaatgagcacagaaggagcagagagcagcatgacaaccaagatactccaaacactcgcactgtttcctgtaattaccatccagagagcagctcccactccgtgtcaggcatgtcaccccctcacggggtctcctgctttctctctgccccagcagcctagaggggaaattcagcatgctgcatttcaatcaaactgtttgatgagagcttttgagcctaattacatggaaggttttatccagtgaaaagaaagaggaaagagaaagagagaaattaaattgaagtataaatcagtcaagagcttagatcccgcgcttgctttctttttaatcaagagtgaaatgagaggagagttttaaggatcatcacaagacaccattaactacccaaggagctcttggctgaagatggtttgtcataaaaagaaaagtgtacaatctgtccataaagaggaagtatctgagggtcgtgctgcagtttaggagcatgacactaaaaggaaggacgcttggtttttccgtgattattttatctttatttcccctagatacctagcatattttctcgcacacattaggtgttcttgttctgtattttaaatcaatgacttggtaaataacgtagtgtgttaactcaggtaattattacataggaaagggtatgttatcaactcattcaatattagatacaacacatgaaatcagtattcaaagttttggccagtttccctttgtggttgatgtagtttgggcatatccctctaatattactgttatttatagaatgctttacagtgttacagagaaaattcacggtaattatttgatccacagcacagccttgtgtggtaggaggacaggtagtatgattgttatttattccatttttttaagctgatgtaatcaaaaccaaagaagcataaatgacttgatcagagtcatccaagtattaagtgacagagcaataactgctacccagcttctattacatcaccctgtatgacctagaatcttgtacagaatttctgggttcttcagtataagaaggataggtaaacagcagagaggagtgtttgcaaaagaaatgcattggaattcatactttattattgagtacttatgatgagcaatgcaaggcactggtccatgctctgaactggaatgtgaaacatgagctttgtccccaaaggcttacagtgtggttacaattcattaaaatgatacttagatctatcctttccatctctattgcattttcaaccatatcacctaaacagttgtgacaacctcccttaacagaccttccttagcttctgtttttccctcctgtccatgtttccctcaccattggagccatccatctgaaacaccagtctgatcatgccgctcttccatgggctcttcgtgtcatttcctctgtactcagaacaaaggctggccccttatctttatgatctggcccctgtgtatccccaacttcacctcctaacatatttgactaccttggccttcatctttttctttttccttttttccccccttgaatatatcaatcttgctactaccatagtgcctttatttgatcagttccttttctctgggatgttttcatccagattgccgtatggccactccttcttcttatacgtcaggcttcaacttcaatgttatcccctcaagagcccttccttaatgacccagtctaaaaagcactcttttttagaaggatcaagattatatgaaaaaatttaaaaaaataaaaaataaaaagcactctttcaaatgtctctccagcataccaccttgttttgttttcactgtagcttgaatatctctgttacagttccttatgtgtgtattgcttccattaacccactagaatgaaagttctgagagcagagaccttgctgatcttgttcatggctggactcccagtacctaaggcagtgactggcaaagactgagttttcataaatcttgctgagtaaagggatggatgaataaatggcatagatgcttcacaaatatgggctcccacctagcattttaacctcaatactcagtaggccctttaaaaacatcagttttagtttgtacttttcccttgattgagaatctctcctatttggtagactgctactaatttttcacgttgcagctgactccataatatctggtctgcaaagttttccctatctcccactgcacagtgagtttcccagccttctgtgtttacttttttcgctatagaagttttctcattgaataacaaaaattattaaacatatattcagtcttctactgttttccaggcactgtccagggtgtcagactcttaaacatacatcagatttgggccttgcctacaagaggttcacgccttggtggaagagctcactctcattttattaaacatgtaacattgcattgctgttatttattgatggtgattgttttcctcattaggctctgcctttcttaagggtaaggaatgagtcattcatttctatattttgattggctgacatagttcttcttttacaaaaggtgcttaatggcactcattaatgaaaaaatagagtgagtgggctgaaaaggtaagaacatacagtattttaatgcacgttgtagtgtgacaaacatcatgagataagtagaaactaccgtggggatttagaggggaagatgtcacaaccaattaggtcattaaaaagtgcttcatagcagaaataaactttatatcatgttttgaagaattatttccacaggcatgcaggagatgggctgaaatatacttgggaaaaaaaaaaaaaccagatgttccagaatcagtgactccatttgctgagttatgggcttgtagagctcagttgtgagaagggctggtgaaggagtttggggctctttgatggaggacgttgagtaataactataattataatggacatctttggcatttacagtttgcagatcagtaatgtaaatactatatgacttgtccctttcaattgccctgtaattcttttatcatgatcactatttacaagagaaaaaaagggtcaaggctgagaagttgatgcttaaatcttataggatggtgctgtatcttttcaaaatgtaaaactggttttgtaaatccctggcttaaaaagataaaacaaaagcaaataaataaataaattaagcctctttcttcactgtttccagtgccctctaaatcaagataaaaatgtttaatgtggcctagcagttcctgcgtgatctggcatcactagcatagcacgtttagcctcatcactcaaaggtccttctgccttcttgattccagcgccctggccttctcccaaccattcatattcaccactacagacttgcctttgcttatcctatttaagcagaatcctcacttcttcctttgatggtcacctactcagaactaagaactcttctttagtgtagcacctcctcaaggaaatccccctgccatttctttgagaaattcaaattcccaggccataggttctcataaccttctagaactctctcctgttgctcatttcacaattcctttttatacatttggttgtgagattatttgattaatatccatttcctaagtagattccactggggttagacagggttgttagaaaataaaaatgcaagacagccaattaaatttgtattcagataaataactgactttttaaaagtacaggtatgtcccatgcaatatttggaatatacttataatttaaaaattttgttgtttatttgaaattcaaagttaactgggcatcctatattttatctggcaacctatattttatctcatcagagactatatctgtttttttcttctagcataatcactggggttgtaacaaacaggtaatcatctaatgttggatggataaataaaatgagtttaaaaaatattctggcagcgcatgtaggctgaattggaatgacaagagactgaatttggaaggactcattagcaaactttgaaaatcatcaaagggaaagttaaggacagggtggtggcattgaggctagatagatggagatgtatagaaggaacatttccaagtggggctcagaatttgcacaggtgttattgggtagcaacccagcactgcgaggaagaggccaaagggccatttcaaattattagtgatcaggattaaaaccagtaacggagagaaaaataaatataatgcctctcatttatatagtgcttcacaacttttaaagtgctgttttatgttccccattatgccccttggtaggagagtattgtttctaaaaagacagccatttaattatcacttttctttataaattcaattacatttcccagtccatgtagttcatcagttcagagatgtttgtcttcatttctgtctattttttaacaggtttcttttatttaagttcctcatttctcagtcctgaatcctttatttctgaagcaccaggtaattttgtattacgcataacaaatctgaaatttatttgtatgagcagattgattttatatccatcagattttctaaaaatgggctataactggcttataatgacatgaccagccagaggctaatttctgtggtatttcttcctgatgccagaataggtagacaagtcagaagcacccacttcagataataaagatataattccagttattcaaatttgtgttgaaagcaaatcctttcactgcttatttttcaattagtgccaagtgtggctccatggcttctagctacagaaggccaggtgatcgagcattcttaaccagatacatgaatagggagaccacggttctgcagttgacatttcttcagctgctctttcagaggtcttaacattttttctcaccagatacttgcctgtgagctgctatttgaaagataaggtgtgctgagtaaatgattaagcaagtgagacaataagaagcaacgtaatctcatcagagactacatctgtttttttcttctagcgtaatcactggggttgtaacaagcaggtaatcatctaatgttggatgaataaataaaatgagtttaaaaaatattctagaacaggggagaattctagaaggttatgagaacctatgttctgggaatttgaatttctcaaagaaatggcagggggatttccttgaggaggtgctacactaaagaagagttcttagttctgagtaggtgaccatcagaggaagaagtgaggatgctgcttaaataggatgagcaaaggcaagtctgtagtagtgaatatgagtggctgggagaaggccagggggctggaatcaagaaggcagaaggacctttgagtgatgaggctaaacgtgctatgctagtgatgccagatcacacaggaactgctaggccacattaaacatttttatcttgatttagagggcactggaaacagtgaagaaagaggcttatttatttatttatttatttgcttttgttttatctttttaagccagggatttacaaaaccagttttacattttgaaaagatacagcaccatcctataagatttaagcatcaacttctcagccttgaccctttttttctcttgtaaatagtgatcatgataaaagaatcacagccatgtagaggacgaaatgtgagcttttaactccacatacctgagtgtcactgatcactctctcagtaggtcacccagaggttagcaaacttttcctgtaaaggaagagagtaaacatttccagctttgcaagcaatatagtctctgcctcaacaactactcaacactaccactgtaatgtcaatgcaactacagacaatatgcaaacaaatgagtgtgagtatatcacagtgaaactttatttacaaaaacaagaccacctagtctgcagacccctgcccccagatttcagcttcctgttatgaaaatggccattataaaacctatatggcacagttgttgtgattaaacatttttacatacccaaaaaacttagtaaagaatcaggcatattaatgagagttcagtaaatgctaacctgtatcatgattataagttttagggctgcaaggaatcttgggtgtgacagacaattttctcctttcaaaagatacctagatggaggattcaagaagtatagggacttaaccagggttacaggatctattttcccgcaatcctatttgtataccacttccagaaaccccaagaaatatgatggcatgaagccaagctatatattgcgggatatttgagcatccattcagcatgtatgcattgaatgtcagccatgtataagacattgtgcagtatattgcaagtgacacaaagatcaataaagttcctgcgttggaaaatctaacagtttaagtcaccctagtaactataatgaggtggaaagcgacaagtatcaaaggaatgagtgacccctacgtgccaagcactatgttgaagtgcttacatgtgttgtctcatatgatcccccagcaggtggatttttagcatttcatcctcaatgacattcaaatgttaagtaatctgctctaggtcaaaagttactaagtgatagaacaaagatttaaactcgtttctctaattgcacagtgtgctttctaccagacgctggggaaatcctcatacatgaagtatggtttagttagctattgctacaaaacaaacaacactaaaaagttgtgtttaaaatgggcatgttatttgcttgtgattctgtgggtcagcagtttagacttgactcagctgggtagcttggatgatctcacatgaggtccctcatatagctccagttatctggcagatagacgggggatgatgatggtctaatatggtctcacacacatatctgccagttggttctggttattaggctgaggagcctcacgtgatatctctgtgctttgtgacctctcatttggctaatgttgactgcttcacttggtggtctcagggctgcctcccagagaggtatataacaggagcagcaactcttgagagcttggaaatcatacaagaacactttcgctgtattctgttggtcaaagcaagtctcagaatcaggctagattcaatgggcagggaaataggtgacgtgtcttagtgggaggaacagcaacatcatactacaaaagggtgagcgtgcaaggatgggagggtttcttgctgtgtttgccaacaatttaccataaagtgataactgagttggaccttcacagaaaataaagatttgggaaataaagactttgccagagcagggattataaagaagagcattacttcagattagctgagaatgaggccacacgcctatattgcattattgaggaaatttcctcttgcctttgctccacaagcacattgcttctactagttgcagggacataattaccaatttcatatatataatacttctaacttttcagaggatttttatttctcctatataacgtttaatatgctatatagttttgttgcattgttttactctgctcattcctttcctctctgtaagttggtgtcgtcattgcaacaaagcccaggttcccagctcacttcccaaaagacaatcatgtggactatctgctgtgattgactgtggctgagtgtttgccctggcagcttttttgttgctgaagatgaaagtttgatggactttaagatggaaaggaaggaagaggagaaatttgatttcatcggcagctgtcttactcatcttcattaagatgggttgtggacacttcaaggccattctgaaccagtggtcataaaactaataggtgccactcaacctgcgctgctcgtattattgcctgagacctgtcatctcggtagttattgcaaaaggagaaggaatctactgtagggaacacaatggtccttgtgtgacagaagtgaaactgaaagaaatagatttttctattagctgcaaatcaaacccttgcacatcatcccttggaggtgacagtgcctgattctctaaggcagggttcaaacaaatcatttgggcttgcagaaaataatatgagattaatatccaagtgtgtgtgtgtatgtatttgtggggtgtgtgtgtgtgtgtgcgcgcgcgtgcatatatgacaactacgtggctcctcacttgaagttttggaattagctactaatatatgtgtatgtttaagggatgcatttgtggacttgaagttgaaatagggaaactgagatgtattctgaagagggaaggagaagagggaatccagtcctgattaggggaatattgaaataagtaggtgaataatattcagtctcccaggtttgtggctatgagctcttttcttccagaagtatttgctgaagggagggaagaaaacactccttttcttctgacaatcaaacttttcaaatgtcagcatgcatgggtgtttctctctattcttgaggctcctttttgtttcagtctaacacctcacatcctgtgggttgtaataataatggtagcagttaccatttattaagcccttgtcatatgccaggtgctttacatatattacagtgtttgtaatccatacaagaattattacaagatagatatcactatgcccaggtgtgttagtccatttgtgttgctataaaggaataccggaggctgggtaatttattagaaaaagaggtttattgggctcatggttttgcagactgtacaagcatggcatcagcatctgcttggcttctggtgaggccccaggaagcttttactcatggtggaaggtaaagaaagggcaggtacgtcacatggcaagagaggaagcaagagagataggggaggagttgtcaggctctttttaacaatcagatctcatggtaactacagagtgagagctcaatatttcaaggagggcatgatatggttcgactctgtgtccccacccaaatctcatcttgaattgcaatccccatgtgcagagggagggacctagtgggaggtgattggatcatgagggcagtttcccccatcctgttctcatgatggtgagttctcaggaggtttgattgtttaaaagtgtgacccttcccctctgtctcactctcctgctgccatgtaagatatgccttggttttccctcaccttctgccatgattgtaagtttcctgaggcttcccaagacatatggaactgtgagtcaattatacctcatttctttataaattacccagtctcaggtagttctttatagcagtgtggaaacagaccacacagaccaccaagccattcatgagggatctgccctcaggatccaaacacttccctccaagccccacctccaatgttggggatcacatttcaccatgaaatttggaggggacaaacatccaaaccgtatcaacagggaactatagctcagggaggttaagtaacttacccaacaacacacagcttatatgttgcaatgtaggaatccaaacccccaaagcttgtgccctcctactgcgctaccctgcctcttccaggcttggggctttagggaatgccctttacaagcagtataaagacgcatttaggaatttttcaatcagctcttgtctagatcttctttggaaagtcttcttagttactggcaggtcaaaataccagctacttgatctaatagtgttatcagcaagaaactaaaaatcatgaagcaatgcagactttttgaatcagataggacttactaggccatcttgtgattctaatctaacatcttatctggccactttttctgccttgtgcaggaagtgaggtctggataggtcaaagggcatgactagagcattggagttaatgggaatggggaatgccttctttgcttcttgacatttctcctccacaacactgcacatcccttgtgaaataatttactattttttagacatcatgtcaaagactgaagtgaaagccaccctcttgtgatcaactgaggtcagaagttggcaaatttttttgttgggggtggggggctaaagggccagataataaatatttttggcttttcacaccagaaagatctccattgccactagtcaattctgcatttataactgagaagcaaccacagacaataagtaaagaagtgggcagcactgtatccagtataatattatttacaaaaggcaaagagggctggatttggcttcccaatctctgccttaggcctttaaagatatagcttccctggggaaatctctacactttgagatttatactccagtactaataacatagtaagagaatagtaatggtggtggtaataatagcagtagtggcatcagcagcaacaacaatggcaccttttaacatttgcttaatacgttaaggtttacaaagtctttttacaattatcatctcacataaaccttttaaattcctactcaagaactacacaagcaagggaaacgtgctagctgagcagtgtggtacaatgaaaagagaatgggatatactgcatttagtcatagagattggtggtgtgggatgaaaatgcctagagagtaggtgtgtgtctcctggccccattaggggacagttcattcagcagcagggtgagtgtcggagttcccaaatacatggctgctaatcagttccctcactctgtaggcattttgcatttaaagctgtccagaaaagagaggcttggtctaagaggttgtggtgtaagaaaatctctacatttccacccattgccttttgggatccctgtatgttagtgagcaacagtaaaaagtgacctgtgttaaaaaggtaatggaagcatggtacaattttagagttcatttgagcaaacagagattcatgaattgggcagctccaaaccagaagtggtatggggattccaatgaagaagtatgagaactaagctattataaagagaatgcagacctaatacaaataaaatatttgattgattacagttataaagctgtctttgctgggaaattcctagttatgtaattataagtgtgattggttgagcttaagttctgtttgtcattattataggcatttacaagaaatagctcaagttaagttctgctgatgtttgcaattcaagcaagtctaaggccacttatgaggcctaactggctctgtctgctcaggaattcttgcaccattgaagcattcttcaaggtctccattttaatttagtttaacacctcttaacaccacgccttcaataacatttatttaacacaggtctttgcttcgtgctaaaggcaaacatgtatatgagactctgtccctaaagcatctgtaactctccaaagacatacccctaggaacatcctgaagattctgaatcttgcagcctgccagaagcacagcagtgctgttggcatctctagaccactgtctgtgattgacttctggctctgctacttgtcagctatgtaaccttgggcaagtttctttttctagtctctttgtcatgttcttcatctgtaaaatgggtattttttaaactacccatttatgtagtctgtgatgatttaagagctaatatggtatgtgtagtggttatttatgagctaatatgtgtatattagcttaatgcctagcattcgtaaatactcagataaatgccagtcattattattatcataattgctggtgaaattaacatacaaagtcctgtgcaaaccttaattttctcactatggacttcatacattttcagaatcctagctacttggttctcagaacattcttctaacacctagagattccacagccaatgtatctttgggaacttattgactaacacagagctaaatgaagtaagcagcatttgtaccctgacattttacagatggaaggaatcatagaggtcatctcagccagaaacacattttcaagatagggaactgaggttcatagaaagtaaatgactttgccaaagtaatacactcaggacagaatgagggctagaaccccggggattagtttttttcctctggcctcaaaactcttccttctgccatttttaacttaccaatttcacctaataccttccacatatttttgtgactgtttcaaagattccactagctaccatagaagaagtaatgaactaaccttataattccatcccagtggcttcacctcacctgccctcagtttcctcacctgtccagtgaggcaaacttacattggaagatccctaaggtggttcccagttcagataagatacaatcctaacaaataaagtggggtcggagtggaatgttcttgaaatcctggtatcaatgggactgggatattactctaaatctatggaaacttcaagaacaatatatttgttttaacctgaaaagacagttgcgttccagtgtgaaatagccaccaggctggatgaaaatgtgtgatgtgattccatcattgaaatgagcatgtgttgaccgtaagttcttctctttctctctggggacatttgcagtgctgcagagcttctctgtgagctgggatgctctgtcagcttaaatcctttccagagtgataaatatacattgattttatttgatttggcccataggtgggggataaaaaacaagacatcacagccacactatactgtatattcattccccctgaagacaacgcacacatccttgttgaagtctcctcatttagacaactcttcctttttatgcttcattataatgccactttcatgtcccttcccctcaacatcgtgcaccttgttccacatccagcactctgtgtttttaaattaagggaaatgccatttaaatatggtttttctctttgtaatatactcacctataaaaagtctttaaaggtaatgctaactgctttggcagaaattcaggcatatatatagttattttaatacaaggctatttgtttgcttgactgtttttaatgactactcattaacaccatgatcttatcctcatttcctctgcacagagcttgagaggtgctgttcacagcccctgctgcctgctttctgaggtctccaagatgctagctttctacttttccactcagccctgacacctagttcatcatttgagataagccccagttgtcggcaaattgcaatctcatcaggtctgcaagatagcatcttgtttgactcttttcaacaccttccattaacactttgggactaggtctttgggaagagccaggcctcaccacatgggcgattgtggttgatgaacagattctagttttccccattattgacttcattaaacttgacagcctttttagtctccagatagggtgaaccttttttcactgacccttattaagagctgtctccttaagaagggtcattcgagaagggatagtgggggccactccttctacttccaggaaatagctgattttggtaaacaactttgatttagtttttagagttctttcacctccctaattaggacagccacaatttatcaaatgttagcaatgcaccaaagcctaagaatgatcttatttcttcctccttattcatgggttttattactactatcctaatttcctcatatggaaatgagcctcaaaaacattaaataagttactctaggtcccatatcaataaattgacagagctggaattggaatcaacttaagtctgacttcagagcttaaggttttaaccatcatattctaccaccttcataatacctttagttactttattatattttaggtttaccccttgttattggtcttcaaaatccatgagttcattctgattttatgaggtgtattggtaatctattgtttcatgaaaacttaccccaaaacttagcagattaaagcaataaacacctattatctcattcaggctttgtgggtcaaaaattcaggagcagcctagctgggctcagggtctcttatgaaattgtagtcaagatattggcccaggctgcagtcagtcacctgaagccttgactgggctggaagatgtacttccaagtttcactcacatgcctggcaagttactactcattattggtagaaggctttcgttctccagcaatgtctgatcctaattttattttaccatagattagtgcagtcttcacatgaggtttcatttcacctctctttctctctctctctctttctctctttctttattttttttctctctctctctcttttcccctggcagtcttcttttggtcaagccatttgtattagtttgctaggtttgccatatgaaagtaccagtggcttaaacaacagaaatttattacagttgtggaaactaaaagtccgagatcaaggtgtcatggagcattgttttctctgaggcctctgtctttggtttataaatggtgatcttgtctctctgtcttcacatggactttcttctgtctctgtgtcctaatcacctcttcatataaggatactagtcatgattgaggctcatgcatctgagctcattttcacttactcacctctttaaaggccctgtcttctaatacagtcacattctgaggggtgttaggacttagggggttaggacttcaacatatgaatgttgaaatgaagtaatttggctcataataccatctttgtcctttgtatgtcttgagaatttccttttacactgtcttacctattacttatgtcatttctccattcttaacctctctttgcctcaagttcccaaagctattgtgcagccaactttaagagttaactgcctgcctttctgattgctcgttacacttgaaggacttaggatgctatacctgaaggtcttagagagttagactggtcctccaagcttatgaattttctagaaactttttaacttgcatatggtattctcctgaagaagctgtggctaaagtcagatatatttttataaactattctttgatcatgtatgagtgccaaaaaaaggagtctttaattactttgagggaggggtctgtgcatctttcttaacccttttcctggctgccctgtagatattccagaaagatttgatgtcttgtggaatggtctgagaaccagatggaagctagatgaagaacaaaatcaaaagtgtctctcttgtcttgcatgatagaaactaatatcactaagaacgcaattgagagcaaattattaagaatatgcactgaatgtgtacaacagccagtgtttgttcctcatcagcacagggaagcattcttttttttttttttttttgtgagtaattttattttattttattttatttttttttattttatttatttatttatttatttattttttaattttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtggctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccattgatgatgagcatttcttcatgtgttttttggctgcataaatgtcttcttttgagaagtgtctgttcatgtccttcacccactttttgatggggttgtttgattttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctaaggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcattatttctgagggctctgttctgttccattgatctatatctctgttttggtatcagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagctgaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgacagagggcatccctgtcttgtaccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgatattggtctcttcagaaattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatctctgttcttttacatttgctgaggagagctttacttccaactatgtggtcaattttggaataggtgtggtgtggtgctgaaaaaaatgtatattctgttgatttggggtggtgagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgttggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttttcctggataatatcctgcagagtgttttccaacttggttccattctccacatcactttcaggtacaccaatcagatgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctggagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgaggacgggcagactgcctcctcaagtgggtccctgacccctgacccccaagcagcctaactgggaggcaccccccagcaggggtacactgacacctcacacggcagggtattccaacagacctgcagctgagggtcctgtctgttagaaggaaaactaacaaccagaaaggacatctacactgaaaacccatctgtacatcaccatcatcaaagaccaaaagtagcacagggaagcattctaagcttttgccaggacgcctgcttattatatgctatggtctgtccaaatcttctgtggctgccactacagcctgatttcccttggaaacttggcagcccgtgagttacgatggaattcccaggtgataatgtatctaatttccctcattgtacttcttttatcctgtaatgtgctgttgattcccacggctgagctgtgatggagaatagccattattattgtaatggcattattcagtccattaagacttaaaacatacctggtaaaaatagtgaaagcttacaagtcttcatagcaatctcaaagactaataacttagttgttagtcttttcctcaagtaaactttgacaggtgtttgggaataattctttcctgggctgatagtatttgatttgtactatatattgttctaagtaaatgcaggaccaatgctccatcctattcgaaaaaagaaaaggggtctctgtagagaaactattaaaaaagtttaaacagcctttacagaaacgtggtttggtggcaaagaaagggaaaccaccaccccttccaaagctcaccaggagaaaagtgagaaataaaatatcaaaatgaaattgactccacacaaagatatctgatcaccagacaaaacaagtaccaaagtgcagaaaaatattacaataaataacatcagattctttattcaagccaggcaaaacttatgtagtttttcctaaccaggttaattattttcctcatcttcttttcctttaatataaaaaagggatataagaaagcaagcctgagtatattcttggttgctctgtttcttgtgttagcctagccagaacgagctacaatagaaagaagttatactttagaaaacaatctatttaatataattcaatgctacacaaagctttatttcttaatatggacaattatttgctactggaaagaaagcagagcgagatatggccctttggggagatggttaaataagaaatacatttccagatgatgtcacatgtaaatagcactccgaaatcactaggcatcaaaattaatcaggctgaatccattgctttgtaaggtgtaaatcgctagccttacttaaccttacttcagtgctgggactcccgaatcgcgaggaaggtatgattcttatttcttcacacacacacagactgagtgttctcaagacaggaacatgattgagaatgctggaaaaaacattacattaatctacattgtaagagtaccatgcaaacatttgcttgtttccaacaccttgtaaatgtatctcgttgttgactcaaaatgaacatttggtgcagatactgagaaaaaagaatgtacttagaacagggatttcattacttctcttataggtctcagctgtggagattgtttagccaacaagaaacccaatctctgttaggtatcttgtctgagatgatattaaaaatattcaacaaccagtaggaaatggaaccaatgaaaatgactcaggtcccctgctgagactggcattgacctgttagttgttgaattgtggaaagaggggaaagggaccggatgatcggtggtaagggtatgtttgaagcagtgacattcatcatctatttatgcaagtattttaacattttaataattgatacagttatctgggtgcatgccagttgacaacttgccctgcatattgataattttaccatgcagactccactcctcaggtaactcttgttctattacactggactttatcatcatgtaatctgtcctgtccctctctctctctctctctctctctctctctctctattgaattctgggggtgtagtagtccattgtttagagggaatttagaagttttcctatattaggaagtgtattcatttcctaggaatgccataacaaagaattacaaactgagaggcttacaacaatacaaagttatcatatcatggctctggaggtgaaaagtctgaaataaaagtgttggtggggctggacacggtggctcacacctgtaatcccagcactttgggaggctgaggcaggcagatcacttgaggtcaggagttcgagaccagcctggctgacgtggtgaaaccctgtctttactaaaagtacaaaaaattagctgggcgtggtggtgggtgcctgtaatcccagctactgaggaggctgaggcaggataattgcttgaacccgggaggtggaggttgcagtgagctgagatcgtgccactgcactccagcctgggtgacaagagcgaggctacttctcaaaaaagaaaaaaaaagtgttggcggggccaagatctctctggaggctctcagggaggatccttccttgcctctttctaacctcttttgatttgctgacaatctttggcattctttggtttgcagctgcagcactttgatcacggccttgttgtcacatggcattctcacctttagtgcctgtgtgtcttcccctcttcacataaggatgcaagtcatattggatgacttatcctactatcctactatgtctatcctactccaatatgaccttatcttagctgattacatctgtagtgaccctatttccaaataaggtcacactccgaggtactggggggttaggatttcatcatatcttttgggagagacacaattcaactcaggacaggaaggaaaagccccggcaaccgaattgtattgttctgctagatgatgacaagtcataatgtagagaagttgctccaaagtgggatacatacattggagggcagcatagaatgaaagttttagaacatctatttatatttattttaatcgtattcctttatatttttgttatagtctgtttcatagcacatttagtgtataaatataataatacatgtctacgtgttaaaaatgaatgaaaatacctacattgggagtgggctgaatccacagaaagttttactgatggtggttcagggaatgtaagcaaaaggatttcaaaccaatgtaagagcatgaaatattaatgacatgtttcagataaaaatctctgtgtaggtttttcatagccccaattcaagttagactgggcaagaaatgagattatttaggcaaaaaaagggaggagcactaaattcatccacaattttaaaagtatcttctttcaggaggcttttggacagtaacatttccaaaaaaatatagtgttttatgccacagagaatcaagttgcattgtgtatactaaatggtcaagcattttcaagaacatgacaaaataaaaacatacaaatttatatctcaaaaggaaagtatcttctttcatgtcagatcatcagcacagaagccctcgatgcatgcaaaggcaagcacaggctctgcagatgagatgtgaagaagcaattagggaaggaaggaagggacagtttggatgctgggtcctgacccagaaacaacacggagtagatctcggatttgctttttcttaggtccaatgctaggacgattactttatctgtggtgaggaatgttataaaaaaccattgttggaatgccaccaaaatacttctttcccttttagcatcatcaccaagattctagaacgaagtaataacagttgccaaccttgagccattctccagctgttgtcatgtttcagtcagacaggaagtgttggcgagtaatatgggatttattgggagtgttcctttacgtgagtccaggaaataagaactagagatgagcttgggtgcctctgcttcttttatttctatggaacattctttggggtcagttttgaataatcactgggcattatcggatttctatcactattttttgcatgttcttgtgattattcaccagggaacattttataatactcatattaaatttttatttcttaatttcttgcctcattactcccatttgcattggctgcagactctctaagtattactttcccttccttgtggttcataccctaatcattgaatattgatgttctatttatttctatgcactcactttgtttttgaccaagttatatagttatttggttttcaggtaatgctttcttacagttactcaagaatgtatgctagaaaatgttgcccataactgcttaaacataaaagaggatatgttttcttgttttccatctatgttacagtctgtttctgaaatatcctttattatgagtagaataaaatctactggacttggaatccacattcccttttaaattaaaagtattcccagactttcaaattttacattccttagcatgatctcttctctataaagacagaagaggggacagaaaattctgactgatcatttcttgagctagaagcagctataatattcctgttctccatcctttataattactttctcataaatactaaactacacccccctgagcatctagaagatttaaacactgatcaaaggcaggtttagctgtatcctcaggacaagctgattcaatgaagaaaagctcaggctcttggagagcttttagaaagagaaataaattaacaattagcatttaacagcagtaaaaactgcttagcggaagcagacttgatgttttaggggatttgagatattcggagtgatgagatgaataggaaaaactgtgttccaattaggaagacagagtgaaaaggtgtgagatgtggtcttctagttcattccactggtgatatagagcctttcctggacagatttttatcttttttgagtaattattatccacgttataatttcatgcctgttgcttttaggtaagctcagaattatagtcatggcttgagtaaagatctcattgcagttgagtactagcagtaccactactcttgcatgagttgcattctctcttgaccagctctgttaatgggtgtccttatgtatgaaactgattttcttactaatggcaggattctgtctggttaggatattccctgaaatgcccaagggtgtattttgcttaaaagcaaggctggccagagaggtttggtttatgtatttatttttaaatttcttttgtacctaggataataaatatattcctctagtcttggataataatataaaattacagccatactgacaaaattaaagaagacattaacaaaaaattcagattaaaatataaagttcatgtctttggcaagtacacacaggattgtggttttgcccaaggtgtctaattaattactataatttttcaattccctgtgttcaataaaaacacgtctatgaaatgctattcataaaagcagaactcactggtcattaaacatgcaaatatccacgaataaatacacaattctctcttgcaggaaatgctatcagtagactaaataagtggtggacatttttctacagtaagtatttacttttcctacagtttgatcttaaaataccacagttggccagggcctcatgtgttgctggtgcaatctccgcattgttaatgggtatatgaagctcatgatgatgtccacaagatgataccgctattggaaaacttcctcattcttcctgtctaaccagtagcataatggatatgtgaatagtgcctgttttgtacattttccctcaggtaaactgtgataggcctttgggaataattcttttcaaggcctgaagcatttaaagtgcactgtatattgttctaaatgcaagaccaatgccccattctatcagagaaaagaaaaagggtatctgtgggaaactatttaaaagattaaaggagctttgactgaaatgtggtttggtggcaaagaaagggaaaccaccatcccttggtacagtattaaggctatatctgggaaaaccaacaaaacgtgtcatatgtggatagatcatgacactgacaccattagcaaggactttttttttttttttaacagcatttcttgtgctagtttcccagtgccaagaatggcttctttatttattcttgaactccaatacctatcacagtacttggtccttacttggtactcaataaatgtttgttgaatgaatctattttttatacttttgtatcaaactatcacatctgagcgattttgtaattttattcagctgatgatattctttataccagtgcaattttccatatgctcatgtgtgttttatttctcatgatatcagtttttctttctttgaactttgtagttccctgaattgcttagtattgtttatatatgactaaaggcccaggtggataagatggtatctttctttgtttattgtttatatatgactaaaggtccagtgaaaggtaaaaaatgagtttgttagatttcaaaatcagtcaaaaggtaaaatcagtgtgaagataagataccatcttatctaactggacctttagtccagtgaaaggtgaaaaatgagtttgttagatttcaaaatcagtcctaactaaaaaccatttcccctactggatgttgtaactcacatcattacaatttatggcttaatgaaacatttatttttctgaacaacttggatttcagtgagcagatttcttaaaataaggacattctatttttcattatagtactaagaatgctggaacaaatattttttctacttacatacttgagttcagttgaattattttatcaggtatttgcaagatgacctggaatatcttggaagttattatatgtaaattatacatacacatatatgtgtatagttcctggcattgggcaactagtataaggaatgctgcaaaaaaaatccttgctaatggtttcagcatcatgatatatatatacatatatatgcatatgtgtaattacacatatctatatgtataaataactatattaatatacttatataagctactacatattaataaatgatcaacatacctatattatttatatataaactatatataaatataactatatatatacacacacacacatatatatatgtagttgtagaaagggtcttttttagtgaattaagacttcatgaaaggccagttatagtggctcatcatgcctgtaatcccagcattctgggaggctagaggatcacttgagcctagtagttcaagatcagcctgggcaacacagcaagatcccatcttaaaataaaaaagatctcatggtaactaatatttgatatgtatgatatatgactttaagcaatattacgtgacatcacctttctcacattctaggttgctgtttacattttttgttcagtaatgaaacaaactcacgaggaagtaaaccaatcaacattttatgcatggagttttctaaatccttcatgtggctttggtagcattttgattagaagcccttgaattctgtcctgagtgcttacccattatctagtgatttacagagtttacaggaggacaccgaaatcacaggcttgaccgcatttacggatggcacagataccagatccaaaaagtttttaatgatctggaaccatgaagtgaaataaacaaggagcccagatttcttgaagacctcctctatgccaggcattttatgtctctcaattctttgagagaacctatggcatgaagttattaatttttttctagatggcaaaactgaaaataaagtatattcaattaatttctcaaggtcatgggattgaaaatactgtgactgaaaaaaatattttaagtcttcctgatcctagagtctatcttcttacattaaaataaacatattaaataaataagcacaatcagtttaggaaagatttgttttgatagaaatccatgcaaagcaggtcagggaatttcagttgaccacagattcaatggggaacatcagctaatgagagaaatgtacagtgcaaattatttcattgtacttagtgctagtcaggcttaataaagggtatgatactttggcacctcattgctttcacaaacaagaaggcattctgagtaagaaaacatgaagacaaagatcctaaacctttatcttgtggatgacagctaagaatgctcaggtaagaaatgactgtagtgacggcaggggatggatgagggctataacatctgttgcaatacatacactgaatggtgactttttcttttttaaattgacacggggtctagctctgttgccctgccagagggcagtggcgcaatcatagctcactgcagccttgaactcctgggctcaggtgaccctcctgcctcagcctcccaagtagcttggactgcaggtgcatgcaaccatgccccactaatttttttatatatttatttttagtagcaacaagctctcactatgttgcccaggatggtcttgaacttctgggctcaagtaatcctcttgtcttagtcttccaaagtgctggcattacaggcatgagccaccatgcctgccctaatggtgtttttaaaggaggaattagctgtggtcagtacagatttatttggaagaaatggaatctgtgcttagaagccaaaaggcccattattattcaataaaaggaagctctttagaacactttgaacctgaaagagttaatgaagcatgagacattagggttcccatatttagtttagatctatgtggcactatttttagaaggttacattgtttttaatattttatatagtaggccgggcgtggtggctcacgcctgtaatcccagcactttgggaggccgaggcaggcagatcacaaggccaagagatcgagaccatcctggccaatgtggtgaaaccccatctctactaaaaaatacaaaacgtagccgggcgtggcggtgtgcgcctgtaatcccagctacttgggaggctgaggcaggagaatcacttgaaccaggaggcagaggttgcagtgagcctagattgcgccactgcactacagcctgggcaacagagtgagacttcatctcaaaaaaaaaaaattatatagtataattctaataatgggatgctccacttcacttgcaagtacttgcatatggaggtgtttttttccccagtatgaggagagatcaacagtaaatacctatattatttctattgctggtcaatgcagaaaatatttgttaagcacgaagagtgtggatgtgtttgatgactacagaactaaggatttctcaaagaaacaaagagagaagtctaagttcaggtgtggaagcccttgcctaatttgcttcttcacttttgcccagaaataatttggccagggattgtgttactattgttgaattaaaccagacagaatcaggcctataagaagagccgtttagtaaaggaaatgattctgtgaaaattttagatttgataactgacatgggaggtgtttaccttcttttgaaaagcagatttaaaaaattgaattaaatatacacacagacttttacactcattttcagggaagcaagaactctatcataataatcaccaaatatcaattaatcagaaggaaaaataggcttgcaggaagagaaaatcagttcctttagacaaatggtattgacatagagattccaggtatgtttagttatataccatgcattctggatcaaatagagaggcttgtgacttgtatcagtattacctggcttcacagcagcaggagcagagaaaatatgcactatgtttagagatgaattaggagagtatgtctgaaagaaccagggatgcgtgggcaggtagatttggtcaggcatatttataataatgagccattggatttgggattgggtggagggaataaagtcagaaaaccattgggtcatcttccctaataaaagagaacgtctgtggagttataaatagaattgcctaatatttcatctaatagctttattcaatcattagaacctaagctttcttgtatcaatgtaaagtatgtgtgtgtatatatgtatatatattcatatgtgtgtgtattatatgcatatgtgcatatacatgtgtgtaatgaaaaaagaaaacagccctgaagaatcctcaagaaactgtcagacgtccttgtcctttaaaagctccagttgcccttcttgtctaaacacatcagtgcagtgtgaatcctgcattattcatgaacacataaggtctgtatttgtatacatttatctcttggctatttatttctataatctctgccccaaaccctcgccatgctttgtctttctcttttcctacttttcttttttttctggtagtttgaaaaataaacattagaaatagctattttattgcttacttctttcctttaacatatggcatttgcttaacctcttggagagttgtggttttctgaccctggagttctgatgggaaagataatgagaagtgtttacttagcatctaggccagcaagctaagaaaaacattgtgccatgctagtattgacaaggtgacagagagcccacacttgcctcacatgttggccactcccgatgctacatcccactttactcttgctggaggactgacattaatgcttactgttttgaggtctggacataatcctggtagattctaaaactcctagcaaacagtggtagacaagtcaagggtctataattgcgtataaacagaaaagtaaagacttacatatttaagcaacctgctaatccccatggtcatttagttccctagtggctatttttaatttgtcttgtttttagaggcactctgaaagcatgaggcaggtgaaagcgtgtctgtgtgttgcttgcatgcacatgctttttcaagaaggtcttcttcttttcttgtcaagactgcagctgtcaactgttccccaaaggtgttgcctagaatcagcatgcagcgctgtaggcaacctgtcacttagatgagacaccttgtatatatgctgtagttcactctctgacttgcctgtgtgcacaatgccatcttgtctgttagaagacagggccatcgtgagatgcagtttctctttgagatatatagtagctcttctttcttcaaaaggaaaaaataaaaaataaaaaaaagctactcttgctggaaaggtagagagaagggtctgcgggtgccctctaccattgtggtttcaatgtctaaatcttctggagaggattgctgcagtgatgagataaaagcagctgcctttccaagtactgtctatttgcattgatatttacattctttgccaaagtgacatcattaacatttgcttagtatttgtgccacagggatatgttttacataatttaagacttggaagtgatgataatgtatttcagatgggcagtagaggccacagagtgctgaatttcatcccctttcttcttaaggaccttagtgcataaataagtccctagtccgtatccctaaatcatattaacaatactgcttactgggtgccaacaatatgtctggtactggactagatatatgtgtatatattgtttagcccccatgacaacagtatgagggtaggtaccattatctccattatatagtaaagaagcaaggctagaaaaattggtgacttgcacaggtctgaattcagagacatctcaccgcaaggacttttctccttatgctgtgtcattctatctcccatcttgtagcctacttgtttcttcagatttaagaaacagaaaccctatattttctcaggacatgacacttgaaataacaagaaagaatattgtgggactctgaccttggtccgtttctgtctctttcattctcatctttactctaggtgcccagaaactcttctttgaaataaatataaaagatctgtgtttgctttgagagaaagccacataacattgtcacaagccagattattgaactctgccagatggcccttatttaccaaatatatgttttagttttatatacgaacagaggttttaaaaagataaagacgaacaaaattgtgtttaatgtcctgtatgataccttttgccttatttacaaactggtcctctctctgactgtacctgctcctgatgccccatcctcaatgtcctccatcagcataaaaaatgtgaaacctctttttcaaaaacaaatttaaaaaaaagtgctcagtctctcatcttgagatggagaattagaagcaaatttgcccttgcttttcttcttaatcttccttcttcccaccttctttccctcgctcccttctttcttctttctttcacaccatgtgccccagaatgacagctcagggaaagtaggcattataagctgagtagccttttccttgatgtcccttgaagggctccttatgttcagagaatatatcactgcatttgcagctcccccagaaatgccgtagcttggaggagcctattactcacttgaatctctttggtgtagacctataaatagattctcgtcttttccttgtaaccccctatagattcttgattcaagggtcaaaaatggagagatgagagttcaatcttcttggaacttactgacaccctagctcccttttaagaacttgtcctccttactaacaccatctacatggccatctgggtcttctcagctcagaaacaccctgcaacaatggctggcggaaataaggggagggcccatttgaattagcacattcccccacaagcacacacatccatactgccaggcctctgtttgtccagtttcctcctcttgtgctgttcttcccacccttctcctcagtgcagttcagatatcatctgtgtcccatgaagtctactctctcccaggggaaaccctttgaatttccattgcatattattctgtgcttctttttatgattaatcccatttaccttgtattatataaatatattttggtccttattagattatatatacttggaggaggacagtatctttctttggtccattggtgtggctaccacaggctcacagcatggcatttggttgcctaaaatgatatgtcttatccgttctttgatgtacagataagaaaagcctttatttagtttggctttcattttgttcaagaacagtggcacagtttggtttttcttgatatctttcccttattcatggttgcttttctcaaacagcacatgtggggcttaatacctagatgatgggttgataggtgcagcaaaccaggtggtacagggtcctgtgtgactctaccatggtgcacatttacctgtgtaacaaacctgcacatcctgcacatgtatcctgaaacttaaaatttaacagaaaaggaaaaagaaaaagaaattattataaatgtaaagtaattaaaagtatattatttaggagggacagtagatatcacaaaggtaagcatgtttcattctcaaatgaaatacacaaatttataaaagtgaattcagcaccagtggtgaatataaaaggctgttaaggaggaggagctaaagttttgattggaacttgaagaaaaggtatgttgttataggcagaaaacttgccatgcaggtgatcatgttagaatcagtgtcagacattaacaaaacattttcagtcaagggcagagagtaaatattttaggctttttggaggctgattacataatttgcacaatgaaatagtgggtccctttttcaaaaagcaataacgaagtgccatgagaagtacttaaaacataaagctctttttcctttttccatggtttctctctctaaacttgtcatgttgttttatatttgctcttcagtgtcattctaaggaaagaaaatgttaaattattagcatgaattttgccattcatctttatattatgccatgccagtcttaaataagttctgaataagaacttctaattcatttgcagaattactgacataggaaacatttcttatttcatagctcatgcagtgcatatatgttttgttcttaccagaaaactggacacactgcacagattaactcacctgtttttatttatttcacttcttgatatacacatattcaacaaacactctcttcctttggcttcctaatgagtaagaaaagactgaaaagaaaagaaactgagttgctttttcttttcttttccttctttgacataattttcagctgaggtggttggtcaattcatggaagtaacatgagtaagaaaggctataattaggttccttagtcatttatgtttcttagaatgccatcgttttctttctgtgttcaaagcaagttttggttccaatggaaaacatgttctttaaggactgtcagcatcccagcttactcagagtagatgtgagagactttgcaatcgctttgagtctcattgagtgtgcatcctaagtctaccagaatcttctactcccggggtattgtgagagctatagggggtgaagtggcaagaaacaatgggcatgtgtatagtatatccatatgtttatgcatctctcttttgctactgcacatgcctaattgtttcattagacttcattcaaaaacacaaattcaaagataaaattattaagtgtttcaagacggagagacaggagaatattaaaccaagagcaggtggtacagggtcctgtgtgactctactggctgcatacccatgaagcttcacctgggttttgcaagccatatggtctctgtctcaagtatttagctgttgtaccatgaagtgcggctataaatgatatgtaaacaaatggacgtgactgtgttccagtaaaactttatttacaaaaaacaggtagcagccagaatctggtctgtgggccattgtttgttgatccctagttaggcaaaaacatggagatgagaatatgtgagccttgtttgagaattgcttagctagtgtgaggtaagtcagggaatttcagaagaaagccaattatgaaagcatggattggactgtttgaatattttcctctagttgataaagtgactgatggctttagctactgaattaacgtgatcaaaagagtttttttttttttttggagatggagtcttgctctgtcaccaagctggagtgcagtggcatgatcttggctcactgcaacctctgcatcctgggttcaagcaattctcctgcctcagctttccgagtagtgggaacacaccactacttccagctaatttttgtatttttagtagagatggggtttcatcatgttggccaggatgatcttgatctcttgacctcatgatctgcccgcctcggcctcccaaagtgctgggattacaggtgtgagccaccgtgcctcgcccatcaaaagagatttttagtgaattaatatggaagtgtcctatcacagagataggaaggggtggatctgttaatagacagatgaacaagggagctattgtgagagtccaggtatgagatgataacaacttggagtattaagaagggatttgcaatgatggaaatatttgattccagaggaattttaagtgaagtgtcaccaggatgtggagagtgatttgatgttggggctgagagaagaaaagatgggaaatttcaaggtcttgtgcccggaaggctgcaaaatggatagccattcattccctgaacctgtattgtgtgtatcttctgtttgctaaaataaccatgaacagaaatggctggtgggctgctgattttaggtggctgcagaattttggtctatttgagttgatgttgggttgcctaatacacatgatgcttacaaggcattcaagatgtgtcactggcatagaggagtggagtgagggatagaagtaaaggtaggtagcccatcttcacagaaaggtgaattagaccagcgacagcagataccatctcccaatggagaaagcatagagaagagaaagaaaaagaaagaggctctaataccctaatcacttacataccctagtgtagtcctctatgcttttcaaattaagtagatatttcactttcctgtttaaccttgcctggaaagattgagaggtccatgtctagtcacaatgttagaatgaaataaatgtgtgaaataaatcatgtttatagtgtagatccccttcatcttcatctttgagtcaaatgccaaagccatttgttggctcagtaacgtttcacttagaaaatgaaacttttattttggctaaacgagtatggtgtcctggtcctttcccaaaaacataccttcaattttaccctagctggctgattgactgtttcctttacagatgcagtctagggatgctaagggcaacatcctttgtgataatgaaagccttataatgtattttttccagtaacttaggatgctgtatattaagctgtatattggtaaatattttgtctatgtggagaaatgtaaatgagatttttttttcttttcatcattcttctctacaaatgtgcattgaaaagacactgaactttggtcccatgcttatgcacaaggtataaaagttgcttatattcctaacctctccacagagttgtctagattcacaggactatttggtcaaatgttctgcaattcagttccactgcttgactgtaattcacctataaacccagaaaaatactgctggagttcagaggccctgactgttattagacagagaaaacctatagcacactggaacaatcacatttaaaagatttgcctcaagctttctatggtcactattactctttaatttatgcttttaggtttcaactttgaaatgatattgaaattttcattatgggcaaccctgaatctggaaaaatccaaggcagcttttaggacagtcacctttaattacccaccaccgttaagattaggaagtaaatgctgaaattcccatgtaagtgtattttgcaagaaattttcacactatgaaataattggtctttatctctcatcctgtctgattctctatcaagacatatcaaacatgcacccctctgctcaaagtgtaaaaaaaaagtttgctttttaaagttttaattaaggcttttgctgtgtgtgtgtgtgtgtgtgtgtgtgtgtgtgaaagtactacacactttagttgtttaggtgtcattgttgagacatttagactgtatttcattcaggcagatacttttactttattacattcccaaatgaggaaatgtgctgattagatggaaaagcatgtgtgtatcttatagtgttagcaatttggcacggtttttgttttgttagctctcagcatggttgccttcaactatatttacaccacatgggtgggcatgtgttaaagatacaaaaatcctcagacctctgaattgcattcctgaaggagaccttaattctattaggttggtgcaaattaaaatgccgttacttgtaatggcaaaaaccgcaatgattttcgcaccaaccttatactgcttattgcttttgcctcttctgtaatgaaaggcttctaactggtttgcctgcctttgattttagctttttgtgtagccttggtcatatcaagtttctgctgaaaaatttggcatggcctttgatttcccagtctcatctcctacaactcaccagtatgcaccggtagttccagtccgcaatacgtcctgcgctgtcgagcttacgcacctttctgtgtgctgtttcctctgctaagaatgtctagtgaacttctactcaccgtttaagaccagatttaaatggcatcttccttacaaataagttgattgatctatcattttattgattctgtcattcagaaacattccttcaatgcatgctatgttctgggaaactttctctaaacggactcaaacatttcttcttctgggttttcccagcgctggatactctgagtcattactaatccacactgggttcttgttttctaggctgcatccctcaatagactgtgaggtctttgtgagaatacaattgcttttgtgtttagttccatattcacagcgttcattctagtgtctggaacatagggttccactacatgcactacacatttgttgactagaaaaatgattcgttttatcaagggactgtcttaggaaatactaagtggggtgcctttctgatacattgtaatgaccacccttttctctgttctctaacgttgtatcccaaagtagataaactagagttttatccttaccaaccatctttctctcatctccatcctactttcccagcactcccctgcacccccctgctgtgtgcaaagctccaatcccgggaaaataccatgcagcgctttcattctaaaggggagcaattgaaagcatttctttggtaatttaagcacacagcagctacctttgcaaaagcctggttgctaaattatcccctcaactactcattttgcaaaagggaaaagaaaaaaaaaacacactggggggatagagactctaataagaaaagagtctgtgttttctttaggttcagcctgattcctctccacctcctctcccttcagtgactgcaaggctcctggtgtggctcgttctgctacttttccttttaatgttttaaatgccacaaatgcttgtcataaaccaccttcttaattatgcagaagtggagctgaatggttagttagcagttctattgcaattactgcactttttcaggtctgctgctgttttatgtggcactgttttctaagttgctgattaagatgatgtagtgggtggagttcttcttcccaccattggagaagggccgctgaagcctgggataatgagtccttaggcaatagtttatggcctaataagagttaaggatgggagcaaggaggagatggagagttatgctcattcatttccttcttaaaaagaaaaagccctctggttttgttcaacttttgcttctcctttgtccagtgtagatgctgaaattgctagagaaatatccatgatggctcttagcagtcctaatcttatttggacctgatattctgaggcttttaggcatcttcagatatccttgtgcagtgaaagagccttgcattggagttgaaatgatgacgagaaaatttaagaactgttgagaatttgaatcaatctcttcatgttgccatctctctctctctctttttaaagccaaatatgaatactgctgtgtgccgatcttgagccctgagaagctgcacttccagtgtagttctaggtccccactgaaaataaaataatgtgaaattgaaagcagcatgctattgtaaagtagtgcaatcattcgttcattcacaggtacttactgaatgcctactatgtcctaggcactgtgtgaggcccaggggatggggctaaaaacaatataaacttcttgcctttatggaatggcattctagtcaggtatactgatattaaaccaatctggaaataaatatatactcttcaatggtgctatgaaaaaaataaagtagaatgaggtgctataaaaaaataaagtagaatgagggaatggagagtgtgctagggcatgctattttgggtggagaaggtttctttgtggcagtgacattgaaataagtgcctgaatgaggcaaagcaacaagatgtaaggatatccaagaagagcattccatgctgaggaaatagcaggtataatcaccctgaaacaggaatgcacttggcttattggagaaacagtgggaggctgatggctagaagacagtgagcccgcagggcaggacagggggtaaagtgaggtcaaagagataaccaggagcatattgtgtatggccttgtaggtgaacaaatgggctttgaatttaatataatttaatttatattttaaaatcatcttggcggctgggtgccaattataccataaagaggcaaagtagaagactggagccaccgaggaggctgctgcaggaatctaggcaaaagatatattagtgtggtagtggcaagcgtgctacattattatgatgtcctcggccttcttaagtgtttgcttcataaatcagtagagttgtgagctgtgacttggacctgataatgaatcattacttattttaaaattgatacatacaataacattcttaattttttataagctcatataaaatattgaaggaggattggtcttattttgcatctgtttattaaacattagactggagataaggttgtgaggccctagagccaaataaatattcccagccttgcctggcagacaattattgggtgtggaggttacccagcctccatgttgcctcagtgactccctttcctgtccttcactaggtaggaggcaaaaagctcagcagtgacacacaggctctgctctcctaattgctgtaaagaactgtgctgtttcttcttcaaaatgttgattgcaggcagctacagggatgtgctcttatgttacagtataaagattttttattgtaaagaaaggagatttgttggcatggtgggatgtgtgtatttgtgtgtgtgtgtgcaagtagctgtgcttgcactgggagactattttactttgcttttttcctctcccattataggaagtaatttttggaggaaaatagtatgacagtcctgatactattttatttattttcttcttcagagtaggtacaacagaaaatcctgaatttatgcttgttgtattttttctccctattatatttctgcgtgttcacacccctctattaacagagaaagtttatgctatattctgtactccttttactctttttattaagagaaagtgagaaagctgtcctagaattatacaaaatatacatatatttttccacatctgaagggtaaaggaattgtaattcatgggaatagagtgttaagggcttatacaatgatatatactatatatatatcattgtttgtatgtatgtacatatattgcacatatatacatatcactttttggctctacttttattattttcaagtttcttttatataaccccagctgctcttctgcatttagttaagtgcagtcctaccatgtctagaacccccttctattctgcctacattcacgactttcatccctcaactctggtcccatttatctgtcacttagcattaactacgttataatgccatttatcccttttgtgcatgcattatttctactcaagtgggccatttgcttttttagggcaaatatcataatatgcacctacttatatgctccacatctgcatcaattcagacagtttggttgcaagcaacagatactataggcttagactacctcaagttggtcaggaatgtattaaaagtctttggggtagcttacagaatcaaagcaaagactaaaggaagaggtttccaaaaacaatcagagaatcttgggaggtctaagtaacagggactaattaatagctattttaggctgcagctgctagaatgcataaactccaattatttccccccattcttacaacagcctgctgaagcctccaaggtattgggtcatgtgcttacccctaagagaagcagaaaaaaaaatcaccttttgacaatcctacacctctgtgaacaatgggaaggagatgtaatttcccaaaagaaaaccgggcactgagtggcccaaaacaattgtcctctataatatcaagcatactttggtgtccacagttggagctctttacagatctggtgtcagtgatggtgacgacaaggagaaggaagagttgtaaatgactttgctcttttgagtaagtgatcatcaaatgtccttgcagtcagaatggcaaacaaatggcatggcctgtcagtatctgaagttaatttgggctggctgtcctttctttttggatatttaggtttcagtaatgatttcccgaaggccacaataataaacatgtgttatgttataaaaagcgggtgctgcatacattggaagcaaggccccctaattgaatcacctgtgctatgactctttcaactcctaaggcataattgaagcactatctcagttggcatctttgtggtttccatccacacattcttactttctggtagctggattatgaacaaccccaaggtcaggcttgtgtagaacccaacatcttacatattttactattgataaaatacaccctgagtataaatgttcacataacactttctctcatctctatagttatgtttctttcttatgaccttggccacatactttaaactccttgggaaaatatgctgccgttaaaaacgcttcacctatttcttgaaaaatgaccgacaagatgtttttcgtccaattctgtcgtatatttctattccctagatttaaatttcctggacttaactgttccctatagttagcagaaacattattttaagaacaatttaagttgaacttcatgtgaaactggctactgaatctgagtcgggaccttcttctggagggaggtaattaaatattccttattgatgctattttaaatgtgttgaatgaaaggagttaattatacagcagggaacatggcagagttctgactaataatgagctcaatgtttaatgtcttcatctttgttagaatcattaaagttgtttgaaccaatcagatgtttcaagtgaatgtagactcacagctaaccagctccaaatggcaatccctcacagatgcaggagctggtatatctaatgatgacttcaggaaaaggatggcgatatattgctttcttccatgcagtataatctgtttcagttggtcttccatcgtgatggtaaagagaaaagaataagtcttatttccaaaatttcatgtgttataatggaatgatgtttgtgcctggacatataaaagaggaaatgattttgttttttccttaaagttttacgtagccaatctctttggaatctggtgcaatattgacatttctggctgccaattcctcacatgataaatgcattaacactaaatcttaggatgcccaggaatcactagaggaccaagcactgtcctaaagaatggatctcctgtaatactgttgtagagaaatgtaggctcttgaggtcaggtttttcataccgtattactggtttgttatgtgtctttaaataaattttgcaaactccccgacactcaaactacttcctcttaaatttctcctcccttctgattgcttcaccaaacagcctgtggctttgtttttatttacaggactcctaagactctgtcctgtcctgtctatgctggggaatgtaaagtacagaagattacttccttggttctccatggaagtccttttacccagctgtgaggattgtaacaatgattggcggtgacatcactctattactgaacttcacatatgggagttgggagactttgaggaatcagtagggtgaatttaccaagttctcccatgagcccaggcagccggggtgtgtgtgtgtgtgtatgtgagtgtgtgtgtgtgtgtgtgtgtgtgtgtgtgtgaaggaagagtaagtgttaggacagaacagcagccatcatgggaaagggaaatcctagttccacctaggatggttacttcgtggagagggttactttgggtagttacggcagccttcagggttttcaagaataatataacatatatgatttatatttttgaacttcgattttaccactgcgttccctccagtgtacttagtagagataggatcatgtgtatcgagagctcaggctttagaatcccacaggtctggaatgaaatctcagctctgacttttactacccatgtgactttggacaatttatgtatccactgtcagcccattagataacctttaaaatgggaataaagtagtgcttgctttgcagaattgctgtatggattaaatgagataattcaggtaaagcacatagttgagtgcaaaattaatttatcacatattattagaaatgtggttgaagattgttttgttatttagatgaatcatatttaaatctttcattttcaagtatctaagacttccaaggactaaaacttccctctgaattttaccactcatcccagctggagatctaagataactatttttgtgtttgtttgttaattatttgacatgtttcttctcaaattaagggaaaattcttatttcggagtcactgttcagaatgaaaatgtgagactaagtatttgttttgcaaagcgcaacagaatagagaagaaaagttgggcattctgtagggcgacccatttggaaaaataaatcctaccccttttgaaggggagaaattaatgagatgagtgtcagtccctccctccccacccactgacctctctctgggatcacacaccaacagcctatgatgaagtgttgctgcagtgcaatggagcaaggttaccttcacagtaacagcttttctctggccagattactttatagccaaagatgtggttattttcacctaaacgtttcatttaaatacattgtaaagtgtgacctaggaaaacgagacaaaatcattctaagctgtatagagttggattgtttgtagaaatgctggacattaaccaatgactctcaacttgaatgtacatcagaatccccaggagggcttgttaagaaacagattcctaaaaccttactccaaagtaggtgtcaggtggagcctgagaattttcatttctaacaaccttccaggtgttgctgatgctgctagccaaggaaccacacttagagaaacaccttcaaagtgcatattttcgtgtcttactattcaaagtatgctccctggaccacctgcattagcatcacctgagaccttgttggaaatgcaaattatcaggtcccacttcagatgtaatgaattagaattgtattttcatcaactccctgaagtgacttgtttgcatattaaagtttgaggaacactgatctagtgattatagccaaggtctttggagagttgagaatctgagacagtcagccctggattcaagtctcacctactgccattttctagccctgtgattttgggggtgttgtcatttttcttctttttaattcccaatttcatctgagaaattgggatgatcatacttgaaaagttgtgaagattaaatgtgataatgtaggtaaaatgcatacaattagtagtgttgttaaattatgtcttcatttctttttatgtgaaacctgtcctgtgaaaccattagaaacagctgtttgaagaaggtatttgaaattctctctgaagtgttttcctatgtcctgttttgagagaagctattttcacagtatggcattagattgtcctcactatattattttgtgtatgagtgacagctgtagagatatataatggtttgagtttgccaagtcacagccccctcgtttgacctctgaatttaagggtgtgtgtgtgtgtgtgtgtgtgtgtgtgtatgtgtgtgagagagagagagaaagagatacagatagacatttcgttggaggaggagtgtgagggaaaacctagggttttctttcttctctaataataaaatatgacataggctttcaaagataaaattcgatttgtaatatttgacaacactggttagtcagccctaacctcactgatatattatgaagatgaaggttatgccagttaataaagtgttttgagaacattgaaaggtgctaataaaattggatatttgactttttatttacgtatgtatgtatgtatgttttgagacagagttttcctcttattgcccaggctggagtgcaatggtgcgatatcagctcaccacaacctccaccttccaggttcaagggattctcctgcctcagcctcctgagtagctgggattacaggcatgcaccaccacgcccggctaattttgtatttttagcagagacaggtttctccatgtttgtcaggctggtctcgaattctcgacctcaggtgatccgcccacctcggcctcccaaagtgctgggattacaggcgtaagccaccgcgcctggcctgacattgtttaattttttaaagtacagcccttagtgataatttttccttttctgtagccagagaggattctagtattttggcagttggacgatatcttatctctctcaatgccctcatcagttgagaaataagcctctttcttttagtattttatattctcaaagctcagaacatttcagagtcatgttatgtaaaaatgaggtataatggctgcagagaaaataaattaaaatgagaattgcgctaatgcaaattaaaagggttaatgggagcattttcttctgggtctcaatgtaggtctctgtacagatgattgaggggtttttggatcctgagtgttattcagcttggaggggctcttttctgaaattgctggctcccatacaaataggcctcttaggaccagtcattatgatgcacaccttgcactataactacatttttaacatttacaggtagggcggtggagctcttcactgcttagttactacccagggtaatctccttcaactgtaacagcaagtcaccaagttcttaatgagtatctcctgttggtccatggtaatgagggtaggtgtgtgggagaggcaaactgtaagacctttcgctgcaaatcctataagcacttgccactcaaagtgcgatccacaaaaccagcagcagtagcagcacctaccagcttgttagaaatgcagagtctcaggccccacttcagacccactgaaagagaatcagcagtttaacaagatctccggaggctgtgggggagactcacaggcagcttaaagtttcaggagctctgctttaagaaacattcctttcagagagggaacttaaactgagccaagatctaaaaccatgtgaactccaaattcagagaatcaggtcagtggtcaccagaacagagggtataataattggttataaaccattctaatagttgtaggtttaaaggaacatgtaagtgtgaggtcagttattcactgtattatgaaagatatgctttatagtttgcctcaaaaaaaaggaagtctgattaaatgtcctcaatctatgtggcagatccaagtaagaccccaaaggttaaaaacaaaacaaagcaaaaagggcaatgccgtgatcaattgcaagtcagagttaagatcaaaattaaaatatgaggtttgtaaatacaatggtaatagaaatttgacgttagcatacgaggctccccattgtttggaaccctggtttaaaagctagaatcaaaagaattttgtctagacctaatgcatactctcacttaagctaagtggaaatctttgcctctgttccagtaaccaaatctgtggcagagctgggagtggaggtattggtgagggttgtgggtggggagcagtgtcatcccccaacacactttgtgacagtttttaaggaattagttgatgagactcttgtttattctatggtgcagagagattagaggaagcagtttgagagcaaaggtcagactgttgatgctgggttgaaatagtctctaagatgcagacaggtatagatgtcctgccaacaaccagcaacacagggttgtccccagacttgctctcctgatattagagtctggctattcttctgaaccaaatacattattttactttatgacaagtgctattacatttaaggactttagagacactgtgattctctctgacatcatagcaaaatttttatgtgtgtgcccaagtactactactttttttttttttcctttggcttcccaagaagaggacctacttattgtttgtatcagatttttcaaggcaccttgggatataaaattttaagtctgctgaattggagaatttctatttattttcccaggggaaccctttggagttctgtcctactcagctgcgttatcccctagatttctgtaactgtattagttaggatgctttggagtgctagaaacagcaaatctggctcaaattgctccaaccaataaaaccaagtcactgacatgtaactgtaaccgcccaatgggttcaccttgtctgctgcctagatagaaccgatttatcaagacaggggaattgcaatggggaaagggaaattcatgcagagccggctatgcaggagaccggagttttactattactcaaatcagtttccctgagcatttggggatcagagtttttcaagataatttggcgggtaggggcttgggaagtggggattggtcaggttggcaatggaatcatagggggtcgaggtgaggttttcttaatgtctgctgttcctgggtgtggtggcagaactggttggaccagattaccagtttgggtggtgtcagccgatccatcctgtgcaaggtctgcaaaatatctcaagtactgatcttaggagcagtttagggagcatcacagtcttgtagcctccagctgcatgactcctaaaccataattgctcatcttgtggctaatgtttgtcctacagaggcgatctagtctccaggcaagaaggaggtctgctttgggaaagggcttttatcgtctttgttttaaactgtaagctataaagtataaactaagtttctcccaaagttagttcagtctacccccaggaatgaacaaggacagcttggaggttagaagcaagatggagtcagttaagttaatctctttcactgtctcagtcataattttggaaaggcggttttataactgaaaagaacagcctggctcgctcttcatgagacttgatacagggtacaaaggtgtcacctagagcatttttttctttctctttatttcctgtgcctttcctgcatctgccagaagatgacctaccaaggctagatccttgtgtacctctcaaatgttggccaacaactctggggccaactgctttccctttcaatttgagttggagagaaataatttttgtcccatcaatctcaggaaaatactttcaatctcaggaaaatatttcaaatatttccttcaaattcactgaagttgggttgatatagtttacctgcacagtctggaggaaagaatcctttttcccttttttgaggagatgttgtcttgctctcttacccaggctgatctcgaactcctaggctcaagcaatcctcctgcctcggcctcccaaagtgctgggattacaggtgtgagccaccatgccctgcctgaaaaaatcacttttgccagagggatagctgatttagttagtgcatgtgctctatccctggagccagggcagtttctaaatggaagtcagtggaataaaattctgggaagagaggtaaaaaaatgtttaccagttttctcagaatgccagctctgtttgacacttctctctcaggactttgaagactccaagaggaatgtattattatctatattctactgaggcaagccctgaagtcaaaagttttaagtgaaataggtggggttgtgctactggtctgccaactccagatccttccagggctcatctgaccatgtaggagtctagtttatggtatccacccagctggtgctaggaggtgagtgagaggaagaagaggcagactctttctctctccaattagcctctgcctctctgtttggttaataagatccatatatttaatatgctcaatgtgctttaatgtgttaccaaaccatttgagtctgttgtcacataggaaatgtagaacttttcaaacactattaaattcccttaatcgattaaagatactgccaaaatggtttacatgaaagaactaacataatagattaaaatatctttttcttttacatttattcattacattaaattttatgccatggttatagatctgaaactaattaaaacaattatacattgacttttttattcctaaatgtatcatgtttttagatgtgtaaaaataagaaacagattcagatttaaaaaataagctatgactcaaaaaaaattaatgtgaaatgcatctggaaaatttctcttttgaaactgaaatattcctcttactaaaaagttgacaatataactctttgtaacacaaagtatatcaggagaatctttggcaaaatggtgaaagaaactcttacagaatatgtaagtcacctaagttccagaattcaatctgtgctaagatttttatggctcagagggaaatatcatggactctttatgttataaaaggagtgaactatgtgattatatcttattctgaatatcaactgtaagaagcagattctcacgggcttcatccaatatgctcttgtaattctttctaacatatgtcctctattcacgaagaacaagaaaacatctccagtttaactgcattttttgtttgttttattaaattctttttttgggtatttgcacgttccaactacccagaaaattactcaaaatatttgccttgtggtctctgtggcactgagcatttaaagcaaactagtgtagttttggcttggtagagattgaacaccctttcgtgtttcaaatatttttagagaagaaattcagatacaaaagccatataagatttatcatcactttgacattaagggagcagccatgggttaaattacttgctttaggtgggtaagggaaattgatattacaccgattctgtcctcagcaccagactgtgtaatgtggggtcaccagaaacctctgacacagctcctgtcctcggggtgtttatgatgaggttttgagaaaagccagactaataagaattagattcacaatgccatgtcttagcaggatgatatagtttgggtacttgtcctctccaaatctcatgttgaaatagaatccccagtgttggcgatgcagcctggcaggaggtgattgggtcatgggagcaagtctctcatgaatggtttagcaccctccctttggtaataagtgaattctccctctgagtccacatgagacttggttgtttaaaagtgtgtggcacctccctcctttgctttctttgttcctgctgtcaccttatgatacccccctttaccttctgccatgattgaaagttttctaaggcctcaccagaagctgagcaaatgttggcacatgcttcctgtacgtcctgcagatccatgaatcagttaaacctattttctttataaattatccaacctcaagtatttctttatggcaccacaaaaatggccgaacacacaagatatgtctgcttggcctccaaaataaatctcaggtctctgattctgcctctatcaacctacattaggccaccatcgtttctcacctaaaccacaactatattcccctaaatgatcttcttgcttcagtttttttccttgtactggtttatcctacctatggcaaccagagttattatttagaatgtaaaacacagcggctgggcacagtggctcacgcctataatcccagcactttgagaggcagaggagggtggattacctgaggtcaggagtcccaggtcagcctgaccaacatagtgaaaccccatctctgctaaaaatacaaaaaaattagctggatgtggtggtggcacctgtaatcccagctactcaggaggctgaggcaggagaatcacctgaacgcgggaggtggaggttgcagtgagcagagatcatgctgttgcactccagcctgggtaacaagagtgaaactctgtctcaaaaaataagataaggcaaggtaagataagataaggtgagataagacaagatatgagcacatcataaaatgatcttgccaaaaaaaagaccattcattgatgtcccagtgcacttaaaaatcctaactctttcttactgcctggaaatctttacatgatcactgctaaaatctcagatcttgtgtgctacccctctgcccctaaggtcactaccctctgatcacattaactttcctgttctttgaagatgtcttggaacttgccattgtttctgtgtgaaatgtgtttttcctgtatgcttaggtgtatcactcctcgttatccagggttcacttacatctcgcctcagtgaagagatttagcttgattgccccatccaaaaagatcttatttgttaacttatttacatggatactatgtcttccccaacttcaagttcatgaggtctgtgtttctgtcttgtttatcaccccaggctcaatgtcttaaaatagcacctcgtaggctctcaataacagaagatggcaccaaattaatacactgaaaatgccacaagattttagataaatgtaaaaacattcaggctttgattatttggtgaacattttgaggcattacgtgagttggagcaaaactcttgaggttaaataatatttgaatgggctctgagaggcaaggggagcgtggccatgcttgtccccccacccttatctgtattctgataagaaaatacagaataaatttctttgaaattaaaaaataactcaaactctctgtaattatttttctttaattttctgagagaaggtttttttttaatttggagaaatttttaaaaattaaataaaaactagaaataatacttaatgtcttgacaaagtattaacttgatctagtttcagaaagatctcattaaactgcctgataaagtgattattcagtgccactttcatagagttttcagtaattatctgaaatgatttttagaatgaggcaacgttttcctttttttttttttgaaacagagtctcgctctgtcacccaggctggagtgcagtggcgtgatctcggctcactactacctccgcctcctgggttcaagcgattctcctgcttcagcctcctgagtagctgggactataggcacgtgccaccacccctggctaattttttgtatttttagtagagatggggtttcatcatgttatccaggatggtctggatctcctgaccttgtgatccacatgccttggcctcccaaagtgctgggattacaggcgtgagccaccgcacctggccaacatttcccttttcagtagcaggtgaaaccgtcttggtattgacacagaaatgctgataggaaaaggtgatgaactcatacacactaaaaatatgacatctacctctaaaagttttagaaatatgtggaaagcattcttggcccttttctcctaagttaagactgttcgcaaatcacttttgagagcgaagtgacgatgacatttttctcactcaagtcctaactcatttctaggcatataatttgaattaaacccttatatataattttctaattagatttttcttctttcatggctttttaagctttacataacctttgtgcttcctttttccattaatccttcaaatgccagcatcctgccaagagggtatttaccgcagtatttccatcattgttaacagagccacaagtttttttccagtatattgaaattacccatccatgagaaaatgcagtcttggatttttaattatttagttgacgcttattcaactatatgatgtaagtaggccttttctccctaatgttttattaccagttaaagcacagacaggtattttactttaatttagatatagagtaggtaacagagagctgaaattttaaaaattagataaattttttggtagttagttttatagttaatcttctctctttttttttttttttgagacagagtctcgctctgtcgcccaggctggagtgcagtggcgcgatctctgcccactgcaagctccgcctcccgggttcacgccattttcctgcctcagcctcctgagtagctgggactacaggcgcccgccaccactcctggctaatttttttgtattttttagtagagacagggtttcactgtgttagccaggatggtctggatctcctgacctcgtgatccgcccacctcggcctcccaaagtgctgggattacaggcgtaagccaccgcgcccggcctaatcttcttaatttgtcacttagagtagggcagtcgccacaatatggaaatgagctgggattagtgttatcactgggaagtgattgtaacttttgggtttgtaccaagaagtatatagaattgcttaaacttctgcatgatcaattactgcagatttttgcacctagctccactacgtagtccatcacatttcatagggcgatttctccactcctttatcatagaaccttaggagagaatgttcttttataactcccttgatggagttgcttaatgctgcctttaatttaattgaaaatggttgatcaataaagtcactttttatggatttatttctactgtttgatgtggcaaatcattaattatcattacctaaattagcatggattgccatgaaagtgaaaggagtaaattgctttatggatttcctagtgcatagtacacatagaacttttctaaatatacatcctcttcagcagttagtttgtgccagatttcaattcctacgctacaagttctccagcaaactagaggtgtccatgtccaagtggacatgctaaaaaattcaaattttacagaaattttacagagaccttacttttgtaaggtctccggaatctttaaaaaaaatctatttaattattgatagaattttagtgaccaccatagaggggagtacctgtgtaagcagaaagcaggaggaaatgaacccatttccagaaaacgaactagacattaaggagaaaaaaagaagagaaagaaaagtaaaaagaaaggagagcaaatacctctaggttttttattctgaaagcccatgttatgggttgaattgtgtatctcacctccgtcctccccgggaaaaaaaaatacacacacacacacacacacacacacacacacacacacacacagacaatattatacataatatgttgatgtcctaacctctagtacctaaaaaccttaaaacctctagtacctcaaaaattgtatatagtatgttgaagtcctaacctctgttacctgtttggaaacagtcttaacagaggtaatcaagttaacatcaagtcatcagtgtgggccctaatctgataggactagtgtccttataagaggaaattttgatacagacatacatagaaagaagattatgcaaagagacacagggagaagatgccataggcaaaccaaggagagaggcctagagcagctcttagaaggaaccaattttgccaacaccttgattttggacttctggcctctagaactgggtggcaataagtttctgttgtttaaaccatagcatttgtggtagtttgttacagcatcactagcaaactaatacagcccataatttatgactagcatttcatattaaaattaaacatattatatgaaagcttccccaaacactggaatactataatctataagagttgcattaactattttcatggaacgtcagaatgtggaatccaaagaaattcagagcctaagctgggtactatcaaagcattttataatcaaacattcaagtatgctctgattgagagaattgatttccatatgtatctttaataaaggaacccaactttcatactttcattgtattaacaagaacaaggcacagactttgttaagcctgattctgaatgttaagtaagccaagggtgaggaactaaaatttgtagagaattgagtcatgtagtgtctactctactgtgggactctggtgttggaattatcaaatgacaatgtgaatgcatcatagagatttatcctggactagcttacacttggaccaaaggtgatttatcaggcttatcattttatattgaagtccataaactctctcttctgcatccctctgttcgggagtgtgtgtggcatagaacaaatcagcctttggcacacattggaggaaagggtgtgtgttttgttttcataggttttttttagtgatgacaatcaaaagcccattttcttgattcctatggatatgaagccgattaagtattgataaggagtaaggtattagagtttaaaatcggggccatctctgagctacatggttaggtcagtggcacctttctctgaatccataatcctccaagccatttcaggccttttatgcagtcctactgcaacccagaactccttctaggccttcctctccaggagcagttatgagattgagtgttaactgcttataagacaccatatgctacacaaaactttttataaatgttgtgcttatatcaactttgacattaatgctattataatcctcaatttacagaagaagaaactgaggcttgaagcggttaaatgacttccccagagacacatagcagtatatgctagaggcaggactccaacccagaactggcagaaaagctgatactttcaaactttcaactaatggtctctgcagcctccaaagtatcagatttctccgtcaaatccttcttgcctggtctgtctgaccaactaatctctgataatgtaacgaaggttataataaatcccttccagagaggatatttgcatttaactggatgtttatgaaataatgtgctggcagaaagaaatgatactcatggtgggaatttctcattctttttctggtggaatgtataatcttggacaaatcatgaccgcaggagtcttcattttatcatctataaatgccaggattgggttaactactgtctaaagatctcttccagattcaaaattctatgattctttcacattaaatgcaactccttttcaacatatgtgtatacttggccctttattgaacctttttataagctgccaattggaaatacacagtcacggtagatatgacaatgagcaagtcacttaataactatcagcctcagtttcctaatctacaaaaggaggctattaagagcacctacctcacagtgttaatattatatacacaagtagcaaaatgtctggaacagagcaagggctcactagctatagctttaataacgtgataactgatggtgtgatcagttctattatcatctccctgcagaaatcacagtttatctaaggttatagtaaaagcacccatcatgacttcttttaatcataaagcatttcatgcagagtgcatattttaactttgtattctaaaggcattggtgtctcactaaaagctgggcagtatttatatcaaacagtatatcatctatgtgttcatttatgcatgcagactttcacccccctccaagctatgagaacaataggcgctttaaaagtctgaagcaagaaggatattagctccatgaatctttattttaaattacatttctgagttagaagtgtcaaaatggtagaacaagttaagcaagattgcattccccagtagggctattgatgttggttgcaaataaattgctggagcaggtgatgatagcaaagtccatgccatcttttatttagcaaagtatttctcttgttaacagctccttctgcatgctttcctttcttctgtttcacatcaatcatatttgacacattgcccaatgtcagggtaaaaaaaaaatgcagcgtctggctaatcatccagatgtttggcctcacactgactgaaacatctggttgtgtagctaaatgttatgttctttcatccagttattttgtgttctgttagacagaactgaagaataaaccctaggatcttcttctattaggataaagcttatagaatctcgaacttgagattccagaaccaaggccttactggttctcatagttgcacagctgtcagcagaatccggatcaattgagataatgtgtgtggaagcattatatagtatgtggaggcattatatggatttgagaagctcatgttaaaagaattctactccctttacttggttatacaatggccaaagaatgtttgtcttctggaaagaagttttaaaacagaataaaaattaattggtgttagaagccaagatttcagagctagaccaataataataacagctaagatatgtctgatgctaactctgatccatgaactcttctaagtgctctgcatagatgtaaaaacaatcctttgaagtggaccctactctttttttccattttacaaatgaagtaactaaggatgagagtgcagttaacaatttaccccagttcagaagctcaaaatttggattcagacaatttgatttcagagtctacgtatttaacttgtaaacttcctctgaaatcaaaatgtttattcagcttccaacaccatcacttattaaacttggttttgtcaccttaaagtggggatagcatgacataccttaaaaggattgttgtaaaggttaattgaaaggatgcatgtaaaacatttaacaatgttgttttttggtaagtagtaagtaaaagtagctattttttctctatgttatgcaatatttggaatcaaatatttcaatactaatttaaataatatattctaataatctcactttctgaaaattcattcaatataatttttttttcttggaagaacattcctagcaggttaagcacttttgatcaactcttgatataggctgttcttaaaataattggaagtccacaaattatatgtttctggaaactattctgaatatggaaaattatattcctttttctttttaatgaacatataatgagtatgtattaaggggaagatatatgctgagcttcctcttgccttccttttctcccccttcatttctgtcaccctgcctttcctatcttcacaatggtcctgtacagtaaactttgtttgcttttgcatttgaactttaggaatcaaggtttttaaagaagctgcatcatgtatcataaataaaaacgaaaaaaatgaagtgtaatattttaaactgttttagaacatgaggctcagtgttctatccaacaggctatgaaatattgctgttactaataagtatgatgatgaaagccactgattcttggacaactactatatgcctgacatattgctgggtgctttgcatacattttctcatttaacgcttagaagttcttgtgattgacacttgggtatcatgagcaactttgctcaccattttttcctatggtccggcgtctttagtcacttgtattactgttgttcagagtgacctttatttgattcatttacctttcagaatcttctattactcatgtatgaggaccacacatttataattagggagtaaatttggtcatcaactcggataaggcaatgggcaaatctgacatgttttcaaagacttttcagtatgctaactttcagtagggctggtttctataacagctacgacatcttttgtcaacactcaggctgattaaattgcaagattataatgttttccgaccctaagtgaaagtgacacattcttgttcttttagtggcttcataaaagtcaaatgtttaatctcaggaggaaatttaaaagatggaagtaaaaccttaatgagatgcaacataaataatagaagtccctttgcgtgaaatgacttgtgatgaggtttcttcaaaggaacaaactataaaatggagtgtttcagaaacctaaaatacactagtaaacactgcgttttaaaaatatggtatcaatgatactcagcattcagtaaataaaaagagttagacaactggtgtctgtaaaaatgttaattttccaaaacactataaatgtatcaccaaaaaataaacattttttaaaaaaattaggtgactattttcatgaatttttagtccatgaaacctgaggagttacttgaccacagcaaagattctttctaatcctttatccagccttttgtgcaatagtacctcctgttccactcacatttcacatgcctgtatgcatgtacattcagatgtgcctgtctttgtctcccagtgcttgttacacagaaggtattcaagaaatggtagccattctcacaatatcattcctattaccatttaaaaatgtatgtggaaaagggtaaagtgcaaacctgggttgttaaaataccggaaggatatctataatttaacaccagttcatttttgttttcaaatcactccaaaatgccctcacttattggtttagaaataatgtaacaaaacaaattgtgttgtgtctccaaagaacattttgctaagtgccagagctgtatataacactaaagtagatgctgacatatgaggattgtgagagatgaatggtgatatttggcttttgcttcccaagtataggtcgtgtccgaggtatagataattgttgttggtttatgataattcgacttgcggagttaggtcagtcagcatagatgcatattttttggatggttttttaacaatgttgcttaaaattttaaatcagattatttgccaaaggggggtgacaagatttggttattagcaaaaaggaaaatattaatctagatttgtttggtcttagtactgattatgaataagtcatcaatagttaatgataaggaatcagtctgctgtgccatattggtagatgaaatgctgctactcctcctattcctgggcttttctgtcccccacccccttccttccctccttcctctgtccctccaactcttcttcacatctcccaactcccccaattcacttcttttccactgcatgccatgttaccctatgcctagttatgatcctaattgtaaccctagttagagtagacacaaagtaaactcaggagcagggattataaagctcaaaattgttcctcggctccgcattttgtgtttattaacctattttacccttgcagcaactccaagcaagtctgtaaattttagcattgagagttctccattttgtgagacccctctgtctggtcaaagtgggatgacagttggtcactatagcattcaataattatccactatggttatttttattcttacagcttttattgaaagtttctttttaaccatagtgccaaagacaaaataaacaataaatattaatgattttcttggcttctatttatgatattgttattttacttttaaattctttggtatcttctgccctttcatcttttctgttctgttcagtcaagacttagctgatcctatctcaacctcaaacatatcttttctatttcatctcttgactagttagaaactttcacggcagctaaaatctcccacacaaatctgagtaaagaaaccctagaggtcaaagattgtagtgtaaataaaagtattttcctttatatatgatataatttatatgtgttatataatatgaagtctcaattagaatagggaaaatgaaattcaataattattagagtattatttgcgaagtgttctgctaatatttttcctcctattaatcaaaattagttttgtattttttttccatagcaaagtagtctaacaatagagaagaatgtcttttaaaagactaaattaggtgaaatctattctttttgttaaattatcctaatgtaaaaccaggtggcctgattaaaactagccttctttgctgcctcctactgtttcaagaaaaaggtcgccttaacacttagtttctcttgctgtcttttgtttggagtatgtgtgggggtgtgttatttatgcaggcatagctcctcattatgggaactccaagagcctgattgtgactgttttttaatgccgcctgctgtgttgtccttaaactcttgcttttcctggaatgcacaactttctcccagctcctggtttagccattggtgtcatgtcttcatgctgcatccttgtgcctctgaaatcgtgttcaaaagagtgtttatgtttcaaattcatccacagtctcaccacatttaaagataattgcagaaggtaaaacactattaataggaacaaatttactagcatctcttttactatgtgtcttatgcataaagcagtttctggttgttgggttatacagtgcctattgtgatagtctattctaccttcacctcccgccccactgcctccccatttaactaaagctcctgctgatatgttcaatttacttttttttcttttttttgaaatggagtctggctctgttgcccaggctgaagtgcagtgatgcgatcttggatcactgcaacctaagcctcctggggttcaagtgattctgctgcctcagcttctggagtagctgagactacaggtgggtgccaccaggcctagctaatttttgtatttttagtagaggcagagtttcactttgtggcgaggctggtctcgaactcctcacctcaagtgatctgcccacctcgtcctcccaaagtgctgggattagagacgtgagccactgagcccagcctgatatgttcaatttgataaatgaatgtgttgaaagatataaaatgtgttaatccctaattgcatgtggctgtgatatttaatatggctgattctaatggagtttgtaacttatggggaacactatgaatgggatattataaatatttgtatgaagtaatacaagagacatttcaacagaaaaccatgtgatctatgccctccatcattattttctttctgtgtaacaaatgaccaagtaaaagtagtgaattaaaatatgagtaagtctattttcacagtattcataatttattataaacttcttttttaaaaaaataaaaaaaattaacttctattcctttaacaaagcaaagcaaaccaacattattatcagctaatgccatttgatttcggtttggtttggtcagtctcagggtggccaatcatttaagttttctgggactgttccaatttaagcactgaaagtttcacttcctgggaaaacacacactcctttgagtatttaccgttgacttccaggtgacccacttaagggcttcttccagaagggcaggcaataagactatcaagactcttcaaagcactcttccccaaagccattagatgaggtccaattttctcagcttgatatttctgagaactgctcttcctttatttccaggatttaagaaaaataaaataaactgatatatatatacatacctttagaaggattcagaaaagaagaaatggccgtttcaccccaatatgtcactatagatatgaatgccactcatagaattgacacgtcatgtttttaacttctgtgctttaggattttcctgtttgaattgtttatgtgcatgtgattttggtggaatttcttcccctttcctctgttccttgctccttcttttgctcagtcagcataggaacatagctcccacactaggaagggctggaggttagtaacatcaagcagtgggctttcaagttagtttgcaccttggtttggaagtgtttgctcaggtctcagatacacaggagactgtgtaatcactcttgtggcatctactacacacagcacgtgagttattcctaaactgagcacaggctcctgggtggtgaatcctagtctttttatctcctgcaggctaagccttggtatttccttcagattacaccaaaaccaaaataatgggcaatgttgtccctgaatgttcaaattaggttgagtacacagagccaaagactatcaaaagaaagtgtcctggccgggcatggtggctcacgcctgtaatcccagcacttcgggactttgggaggcagaggcgagccgatcacgcggtcaggagatcaagactatcctggctaacatggtgaaaccccgtctctactaaaaatacagaaacaaaatcagccaggcatggtggcgggcgcctgtagtcccagctgctccggaggctgaggcgggagaatggtgtgaacctgggaggcggagcttacagtgagcagagatcgcactactgcactccagcctgactctgtctcaaaaaaaaaaaaaaagaaagaaagagagaaagaaagaaagaaagaaagagaaagaaagaaagaaagaaagaaagaaagaaagaaagaaagaaagaaagaaagaaagaaagtgtcctaaaagaagtggtggtacctgtggggcgtgtttggtgtcagagtgtttctgctaaggttattttaattagcctcctcccaaagccctccccctattctccttgaggaactgtttgaccgtcacatccttagaaaggccaaaccactactaactctcctgaccctctgccttatcctcatacccttaaagatgtgacttaaaagagaaaaaattatgttgttaatttcatcaactagggcaaaggggaaaaatgttcatttcgatgcaggaagttaatgggagatgggaggaagctacggttacaattcccataatacattaatgtatatttaatataccaccttgatttgtggcctcaagttaaataactacatatgtttgcagcataattcttttcataattgtgtagcctcaatgggataacatttgtattagtttccataatcgaaaatgtcaaatgcctgtttccaccttccaagtattttggttttaggtagcaaagacaattctttcaatgcgtatctgttctcattaagttctgattgctttataaagaaataaagtcttttcccattgttctgctctgtggaagtcaccttcagagtaagggtgggggtgactgtccttgccaatttttaagtaactgccttgcaagggtgattccctacagagttattttctgcatagtttccctctgggtacagaatgtgggaaagtagatgcaacgcattttagagtagtcatttgctctaataattagcattatagtacagtgtatgggctggcttcctgttgaggtctagatttctacatataatgtaggtttttctattctgtcctatattaatttcattggagttactctttatcagagcaaacatccgtaacatttagtctttttttttttttttttggagacagagtcttgctctgtcgcccaggctggagtacagtggcgtgatcttggctcactgcaacctcttcctccaaggttcaagtgattctcctgcctcagcctcccaagtagctgggattaccggtgtgtgccaccacacctggctaatttttgtatttttagtagacatggggtttcaccatgttgagcagagcaataactctgtagggaatcacccttgcaagccagttacttaaaaattggcaaggacagtcacccccactattactctgaaggtgacttccacagagcagaacaatgggaaaagactttatttctttataaagcaatcagaacttaatgagaacagatacgcattgaaagaattgtctttgctacctaaaacgaaaatacttggaaggtggaaacaggcatttgacattttcgattatggaaactaatacaaatgttatcccattgaggctacacaattatgaaaagaattatgctgcaaacatatgtagttatttaacttgaggccacaaatcaaggtggtatattaaatatacattaatgtattacgggaattgtaaccgtagcttcctcccaactcccattaacttcctgcatcaaaatgaacatttttcccctttgccctagttgatgaaattaacaacataattttttctcttttaagtcacatctttaaggatatgaggataaggcagagggtcaggagagttagtagtggtcttgaactcctgacctcaggtggtccgcctaccttggcctcccaaagtgctaggattacaggcgtgagccactgtgcccagccatttgtaatatttacagagcattgctctttttcttatcatggaaagttattccaatatctattcattctatacacatttattaagcatctactatgtgccaatgttaaagaggtgaaagtgtaaccttggccctcagactgactttttgcaggttatgctgaaagatgaatgctcagtaatagctcgtgccttaagacgtggccgagcaagctttggaggtaaaatagctcatggagtttttatttatttatttattctttaaaaatggtcacaaagatttcagataaacaatctgagtatggctaaattatttttcttaggtaaacataggaggcaagaaattaaaagggtgggagaaacattaattaggctatgctcttatcaagtagtgtgaccttagcgaatttacctaatctttttgaacctcagtgtcctcatttataaaatggaggcataactttttatgaagattaagataatgtgtgaacaatctgtgcagtagtagttgctcaataaatggtagtgattttcacatgtatttggactattgtagaatatagaaaagaatatcatgcaaactctagtcctttaaatatgagtgaggaagaggaatcacctgtgtgtatgtgattaaagctgttagctatgatgaaggcagggtgatttttctctgaagggtaattcgagtacagagatattactttgaagaagtaatatgttaaatgaaatcattggggctgaaagtggtaacaacattctgggaaaggagccgtttactctcttcacctctaagataaaccataatgcatgcatgtatttaataaactgtgatagctagagctgtttcactggggcatcagtaagctatcctcaacccccttttcttttcttccagcttttcacttccaaccccctaagttttatcagaattagttaatactgagtccagctgaatacattgcttgttataaatagaatgctttctcccttcctctgcccctgaccaaacaattgattacaaagtttatctgctgagtgcggtggctcatgcctgtaattccagcactttgggaggccgaggtgggtggatcacttgaggtcaggagtttgagactagcctggccaacatggtgacaccccgtctctataaaaaatataaaaattagcccagtgtgttggtgcatgcctgtaatcacagctacttgagaggttgaggcaggagaatcacttgaacccaggaggcagaggttgcagtgagctgaaatcacgccacggcactccagtctgggtgacgggctaaatagaatgaaaaaggaatgacccatacctgaaatgtttaacataataaaatgactgatatcgattgatgacgttgagagcaatgaccagatataagggaacaatgtgtttttacttggattgtagatatcaagaatacaggagaatggaatgggagggctaacaactctagacaacatggctgcaatctatgactttgcattcttgctataatttactttcagtgcttttacaaatgtaagactctcgaggccagcagtgtatcttttacgctattcattctacttttataattattattattattattattattattattattattatttgcaacctctgcctccaggtttccaacaattcttctgcctcagcctcccgagtagctgggattacaggcgcgggccaccatgcccagctaattttttattttattttattttatttatttattttttattatactttaagttctagggtacatgtgcacaacgtgcaggattgttacatatgtatacctgtgccatgttggtgtgctgcacccattaactcgtcatttacattaggtatatctcctaatgctatccctcccctctccccccaccccaccacaggccccagtgtaagaaatacaataaacaaagtatcttttattttggctacgtagttatgttgagggtcattcatcgtcctccagtttagcctatttggaacggtactggttaatctcaataaacaaataacattgtcagtttaattgttcaattattggagggaaataaatatatattaacctaaatgttaaattctgcaggaaaaaaactgattagacatagacaatatcaacatgggtttgttaaataacttgccttccaacaggacccaaccagaaattggaacctatgtttcatagaaacatgattcttagaaatgatctttacacaattgtaaaacaaagggaagattatgtgacgcagatgccaagaaatcagacctaggcaccatgtacaagtatacaagcaatgccgagttcatcagtcccatggctgctgctaaattgggctttatccccagcaaattaacacagttccagcaggcacgataagtttactctgaccagattactgggttgaatggcatatgccgttattttagaaagatgcagaataacatttccatttagagtcctggcagaacaaagcttggatttgggcaatagataaaaacacatagagagtatttgcagatgcatgtgatagatagaaatggtgagtgaccatttagaaatttagaattggaatttttttttttttttttgagtctcgttctgtcacccaggctggagtagtgcaatggtgtgatcttggctcactgcaacctccacctcctgggttcaagcaattctcctcccccagcctcctgagtagctggaattataggcgcccacaaccgcacctggctaattttgtatttttagtagagacagggtttcgccatgttggccaggctggtctcaaactcctgacctcaggtgatccacctgcctcggcctcccaaagtgctgggattataggcgtgagccactgcacccgacaaaaattgtctcttttttgatatttcctagagcagtgtggctcatttagattgaaatatctgtcagaagctatataccagttccattgatttcaacattaaaatgtctccacatattcttccgcatccttcttccagctcatagctgtaattagtgttatgctccatggagtggcagaagaccagctgaacaaacagccatgtacgtaggaacagttccaggcagctaaaagagcttcttcctcacttgccactatcttaaatggtatctggtgtctacagttgctccttctactttcttaagaaaaaaaaaaaaaaaatccaaatggaaaagaggactctgaagacaaattagtcctttacaattataattttatttgatttcaaagcagtacttggtatagcaccagtccaaacagattggaagaatgatattttcattccagctcctgcatagaatatctttgtgcttttcaattgctttagggagcttgcaacaatagaatcctgttaaatctaacaccattttgaactcttccttgccgatattgtgataagaaatttatacctggcccaggtttatctctgttgataatgggcttcatggctatagggacatgttgatatggtgagctagcacctatcattttgacacctactctttagtagacatagagaataatgggtgcttggggtaaagtgctggagaagagtgtcagcagtcagtgtgtatgaacctagtgatggatgtctctgtgtttgtgctgtggccatatctgtatggctatcattctttcttcctcttctcatttcttttaattttccttcaacagtctttcatttgttgcttcaattcactccatttctccccagttcttcttttttctgtcttctataattctagataaaattatgacatgacttaaaatatcctccttttttgtccgtgattgctttcaatggttctaatgaccccattggaagtctggtgattaggccctgaggggccacagtaatggaaaccttgtgttcagccttcataagggtgatccaaaaatgttattacattacttacacctctttctgtaagtattttttcttcattcacttcgaagtatgggatgcttcccatgtgcaggagaattagctcattcataactcaaaggcaagtaatttcatgttttgctatttataagagaggagtctatcatgcaaggatgcaaaggagtatgaaatcagtcacaaatgtaggaaataaaaggcaataagcttccattaaaccaaacaaaagaaaaattaataattaggcagtctctttgcaagtacataataataatactctatttttcaatgaatcaattaggtaaaaatgaaacaaaataaatgcaaagagagccctcaaaaatatatcacttttacatatgtaatataagttgaacatctcattagaataatgtgacttttttaaaatttatttttgcttcctagagttcataaatcttcaggtggtaagtaggggttctttagctattcataatgcaacttgcttaggttaattagtagagaccctttcccttcacagctgaatatgagtgcccctacttactattcaaaaatccccaaaaccagcactcttctatatattggtgcttggaagagattgtatttttcattgacctgcaatattaggtattttattataaataaagtctcaaacaggctttattttatttgtcagattctcttttggtttcgtctcataaaatattagctgaatagttattatataaaaaggaaatgatcagaatatcacatttcgggtggtggtgtttagtttgtgggttccttcatgtgacaggttgaactgggtggtagagaattctgagttctgtacaacagagtgattgatttctcggtttgcatttcttggcatctggcagtgacaccactgcagaccgagagcagaaaatggacagtagggaaaaatgcaacatttctacttggtccagctgcctttgaaggatgctgatgtttcattttttatttcttaccccaaacatatttatttgctgagtcattaaatagggcaagtgttatttctttctttgtatttgccatctcaccacagaagagttttattggccgggcgcggtggctcacgcctgtaatcccagcactttgggaggccgaggcgggtggatcatgaggtcaggagatcgagaccatcctggctaacaaggtgaaaccccgtctctactaaaaatataaaaaattagccgggcgcggtggcgggcgcctgtagtcccagctactcgggaggctgaggcaggagaatggcatgaacccgggaagcggagcttgcagtgagccgagattgcgccactgcagtccgcagtccggcctgggcgacagagcgagactctgtctcaaaaaaaaaaaaaaaaaaagaaaaaaaagaagagttttattaaaccatctcgaatcgatattgttttggcacaaattgcactaataacttgaatatatagttttgtttttttaaaggtgccttcaaaatctgatacgtataatgtatgttaaaattgatatttctgtgaaagaggttaagatcagaccgctttctgattgcagagataaaattgatagttaacaagtatttattaaacatctattatgtgactagtactatgctagggcatgatgaaaatgattcaagatgaaccatgcaagcacccctctcttcagcacctctgtgtgtaaaacataaacagaatgctatgattaacactgaaagggttcagtccgggatacttgggataaaaatcggagcactgataagttacttgtcatgtacttacttttttaaaaatttaaaattttttaattatgggtacataataagtatatatgtatggtatacatgtgatattgtgatacaggcatataatgtgaaatatcacatcaagataattggagtattcattacctcaagcatttactgtttctttgtgttaggaacattccaattccacttttttaatttttaaaaatatgcaatacataattgttgactatagtcaccctgttgtgctatcaaatgctagattttattcattctatcaatgtttttgcacccgctaactgtctctacctttcccttctctccccaatacccttcccagcttctggtaactgtcattctactctctatcttcatgagttcaattgttttaattcttagctcccatataaaagtgagaacattccatgcacttctaatttagactcttctcctctttctctgtcttctttttttccatagctcactaattttgggcatctcttctcatttacagtagcttgctgctcttcattcattaattattacaatatataattctaccaagaagcccaaagaactatagtgtttttatgtcattattctcagttcagaaagaaagcatgtgtgtggcacagggaaggcatttgaatgaatgtatgcattttctggatagcattctcgaacagagatttgatgagagtcacatggataattttaacttttctagtagcaatattaaaaacacagaaatagcttctcaataactgaatcagtaatccatttttaaaatctttttcaattcattaaaattaaatagaattaaaaactcagtcccttagtcttttttttttttttttttttggagatggagtcttgctctgtcacccaggctggagtgcagtggcgcattcttggctcactgcaagctctgcctcctgggttcatgcctttctcctgcctcagcctcccaagtagctgggactacaggcgtccaccaccacgcctagcttattttttgtatttttagtagagacagggttttactgtgttagccaggatggtctcgatctcctgacctcgtgatccaccagcctcagcctccaaaagtgctgggattacaggcgtgagccaccacgccctgcccccttagtctgactgaccaaatttcatgtgtttacggattgacaaccatgtgggtagtgcaggttttggatgcatggcaggctgaagcttatgtagcacatatttgaccttcacattttattaagtctaattttttaaagttttgtctgttcatttacatgtggaaggatgatagaaatataggaagagacatgacagaaagcttgcctaggactcagatcaaggattcagatttcccaattccggcttcagggccctgttctgtaacatcacatcagggaaaggaaaatgagagaaaagaagaaagaataagaactaatgttaattcatgtcagacacagtgccaaagatctttatttgcattattgttattattttttaaaaaataaatagactagcacgtagcctagcttacacacttctcattgtatagatgaggaaactgggaatcagttaaactttataaccacaccaagatcattgagctagtaagtggcaggcttgggatttaagaaagcttgtaatgatgttacatttgatggtttaaactgtgctgtgggaagggaatccaagaagataatcccatgtttctgcttcttgtgatgtttgcaaatctgtgttctggagtaagtctttgagttgactcttggagcttctgaaacgtctattggatatactataaccaaagataaataaataaataaaaagatcagggttcctgaacgttttcatctttacattgattgcaatgattacaagtgatcatttcatcacttggagcattattacctctatggggctttacatgatactgactttgtcaataaaaggacatattaggagcaggatttctgtttgggccagaacaaggggacataccctatttttaaaattccccagtttaggaattgaagtgactgcatactaaagttggccaaatttcatgtggctatggaatgagaatatatgaaaagttggttgtaaaaacaattaagaggattggggcagactattttatggatcccttcctccttagcttctgaaatgaactaacattgattctacaaccacttattaaatacctactttttgccatggctgatgctaagtgttgaggctagaaatgcatatgaattatattttaataagcacagaataaagaaaacttgtcttcctaatttttactttaaaagacttttatctcattgtttaagtgccataattgtacaaagcatgctgttctgagttcagtgtttcttggctcattctcagtcaatactctgcatagcatctttgaattccttactcatcaaagggtaatgagttaatttgtgtactctacctctgccaccttttgagctgtgttgttgaccattccctatacatttgcatctctgtctgccagaagatgtaccaggaaaataaaagcagcagaaaatcttataacttcccacctagacatcagtcaccatcagagtttggtctggaaacagaaaagtttatttaaaacaaaattggtactctgtgaatatttcaaccatttgttccatttaatccccattagtgaatttgcttagattaatttttttgtggattccatttccaagaatgaaagcaaaataattacatcaaaaggccactgaaatcagccaaattctctggcaggaaacttattctattcagtcacattcaaactatcaggtatgaaaaatacctttcaccactggataatacaacaatggagttggaaaatcaatcgtgtggtaaataagcaaaaactacgtgcaaacagaggaaagaagagttgttctgaaaatggtatttcaataaaagttatagtgatgacgagcagtgtgatgatgtaggaagttccaaaactaggtagagggtataatcaaaggtgggtacaatggaacaagcctggaggcaaggacgggccagtcaggaacaggtgggcttatagtgaaagaaagtggaggctttagaagtagagtatttgatgaattcttccgtccattctattttggcttctatgtcaaggaggatgacagatattcattgtgtagttttataggaaaggcgattggtagtgacttcaatgttataaagaacttggccaagtccataaaatgtccatggtgtataacaaatcttttatggtgagtgatccatggaattaggtacttagaaaagtcgattgaaacatattcacagaaaggcaaaggtttgatgacctggtgcatggaatgagacagagacactgagaaattttgattgtacaagtttttcctaatatcccacttacatcctgtagcggtgtgggcccatttattcttttttatgtttggtttccctgtctcatggtaaaatcatggacagatgttacccctcaattttctctttttcaattatttctgatccttctcactttaatcagtttacttgatagtctctgcgctagtgtaatttctccagccttttgaaaaatgtagacgcttgagccagacaaaagcacttcagcaggaacatgactaatcttgaagacatagagcagggctgataatgtacgccaggaactgtcagttaagaaatagtgatactgcattgctgactcacagtcagctcatgggtcactatgctgcccccattctgttgagatttcagtacactttccgtatatggagtttctgtgttggtacacatccagaaggtttcttgggcgcattgaccttcacatattgtttggttaatttacctaacttggtattaatcagacagaaaagacaaacatgaagtaaggaaagtcggcctttgctgttctcccttgaacttggcttcacttctatccccaccatttagtaaggaagaacagccccaatttattgagttgctatgagccagacactgtgtaagcactttctacacattattgcatttaattctccaaagaatgagataactattataatctctgttttatagaacaaccagctaaagtttatcgggttttttttgtttctgtttttttgggtttttttttgttttttttttttgagatggagttttgctcttattgcccaggctggagtgaaatggcgccatcttggctcactgcaacctctgcctccggggttcaaacgattctcctgcctcagcctcccgagtagctgggattacaggcatgcgctaccatgcctggctaattttgtttttttagtagagacagggtttctccatgtcggtcaggctggtctcgaactcctgacctcaggtgatctgcctgcctcagcctcccaaagtgctgggattacaggcatgagccaccgtgcctggccaagtttatgttaaataactcgtccagaaggtgtagtgggatgtttgactccaaaatacatgcttttaccgcctcaactgactgagcttgggactacctctaactttcattagaaacacaaatctttttctaataaactttcttcttcttttcaataaaaacatttcccacaaggtgacttaaattcattcacaattaggtataaatactgataagagcagttaacttgttttaagagtctaatatgtgctaagccttatgccagatgctttacaagcattatcttaaaccttgtaacaattttgcaaaaatgttactctattttatagaaccaaaacccaagactatgaaaacctaaatatcatcctcagagtcatacagcgaagcagaaattgtatcagctaatgagacttagtgccatttctctcatattgtgtgagaaaaatggcaatgctcaataaatgttgttctaactgttccaggtatcaagcagtagaaaaagaatatggcagatcaggtggattttgctgtcagccctggaaacactcagctggtggctacataatccatcatctcctgaagctttcattgtccacattttttttctaccctttagtcatgtgtttgtaaggaataaattactaaaatacaccataccttttaaaatatagaataaaagctcacagagagttagggtgacagaacatatgattcaaccttctgccttctggcagacagtaggctatttcttttaggtgggtatctaggaatagatacttgcatataatattttttttttgaatcccagactggtcctactaacattcttgattaccacttatttaagtgaccatcaaaccagttttatatctgatatgtttaatccaaataaatgtctttttttaaaaaactgtttaaaaaatggtatttaaatccttcccagattttagctgtgtatagtctggaaggaaacccattcacatggttttatcaggtttgatatttaatagatcaaattagtaaaacagggccctcacttcacaggcacggtgaattctttgttgataagatctatcaatgatcagtatggatcattggatggcagtgaacgtatacgtttgtggggaaaattcttatgcaccttcatagtaatggtactgcccattttatttgaggataattaaaacacaaaatacccaacgatgctgtttttattgtaggtatatgttaattcctctagagatagacaagactctaaattcatggaactttaagtgggatgttccacaaaggaaactctttaaaataatatagaaaaataaataagtaaatgtcaaccaaaatggcagaacatttaaaatcagtctgccaaatatcttttctcactttacttcatttgttgaacaatttatatgctgatatagatggccattttaacagtgtatacaaagcatttatatccacacatgtacatttaatcaaacctacatgtctacatacacatacttaagacacacatagagagtgtgtgagagagaatcaactcatcataattgtaaaggtgaagaaaattgattccttaagactaaaacacaccatattaaacttggagtttatattttgaaaataagattcaggaagtcttctaaagcattcgaagattgattagaaagataaatttcggcacacagggtctctgttcttgtaactttccctgtggtagcttatccctctgtataatacattttgtcatcattctttctttcctccctgatacaataaaaataatttccaaggttagattctatcttgcaagagcttttccccaaggaggtgcatgcatcttcttaatttattatattatataataattcctcataggaaaactaaaggcaaattaaaaccacatggagataatgcctgactgtgctttagactgttgtctaccactggctctttagaaaaagatcagagatacccctctcttgattgtccattttcttgatcatgcaatgtggtattttaagttctatgctggctttgatgcttttgttagtcaaggtgcatgtgtgaatgtgtgaattggatatgtgaatgattttaatattagcttaaataaaacattactgggaagacaaattttctgaaattcccattttcctcttccacttcccctacccccaaagaaacttgacatattcgtttcaaagcatacactgcttttttactatttttatttttatcgtgcatatcacaaccccttcattagtagacatcattgagcattaactgtgacttaattctagaaaaaaatatttttgagatacccattaagatatcacccctgacaaatataaaaagagaccttgagtttacttcattttaaataaatagactgtcttcatttcctaactctgtgaatctgacgcttcttatcaacaccccaaattactgtcaacaaattcaaaaccatctactgatgaatgagatgtttaggtccaattctgatatgccatgctcattctcatacagagaaatacctacactcttttaaatatagttgttattgctgtgacttgcacctactaaacaaatgtaaaaattcttacagttcaagaaataccagtgaagtgtatattattgccctcattacacaaaatgctcatggaaaacactctatcaattccaattatgttctggggggaaaaaaaaggaaactgaataaaaagcaatcccagaatatttgactgggctggttggttatagctgctgaacaatatgtaattgtaagaagtgtggcaaaatgataaaaataaactcagtatttgttaaagaaatgaaaacgtggcaataaaagattccggaaagcgatttagttttttgcattacttcttcattacttgattattttactgtttcatttctatttacctaccaagttgattcttttgcatctggattttgcacaattctttcaataatatacggttcagtggctataattacaggattgttaaagttcacattttactattcatcttgttatctctggtaatggaaggttggaataaatgcacataattacatggttggtcttaaattatttttatattgctcttgccaggatatactcgaaaagcagtatttattctctaatatttatttttggtggtagtggttttagcaaaataaaagtaataaatacataaatggactggtcccacgagcttactatctatggtttttttcaaattaattctaacccattcatctctctgagcctgctaggggcaggaggtgcttagagtctatggaagaaaaacgtcatgtttcagagctctggtaacaggaaaatgtccctcatgaggtactcatcatttgatctattattttatctatttgtagcagagtaactcagtaacctacagatctgtggaccaacttactaaataaggtgtcaaataagtttgatttcattctaaagcaatgccatgtcatgaaagtaaagtgaatttttttgtttgtattatactggaaatagtctcattgtactatatggcactcaaaacattttataaaaatcttagcactatcaactaaaaattaactcataagctcccgtaattaactgaacagatgactccctgttggccaaagggaccccagaaaagactgaagaactgagttcgtggccattgatggaagcgaggtcagaaacgcctcattacatgccctttatgttagagtttaggcacaactgaccagcattaacattaaaatagagatcataagattaactaaagggactcattgtgacactaaaataccacattctaaataagacctaaggccatgcaaagcaagggttaaggcatgctctgcaaaccgtaaaatctttttttaaaaaattaatcctgcataatgtggcttactttccaatctgactctggtataccctcacatggcagatagcagaccccttatcttgacttaagcatccctttgtattgacctcaagtctttagacaaagcttaactctttcaatcaattgccaactaaagtatctctaaaactcacccatgacttgtaagcccatgcttcaagatgtcccaccttttcaggccaaaccaatgtatacttttcatgtactgatttataattttacctacaattcctatctccccaaaatgtataaaaccaagctgtaacctgattactttggtaccaattatgcaagacttcttgggtttgcgttttcttgggctgcaccattcatattggctcagaataaacctctttaaaacattttacagaggctgatttttccatgaacagcagcatccaaaaaatccacaggatacatgtatcaagtatttattaagtacctacgatatgccaggcattgggctatatatgaaaaacagtgttatcagacatccacctagtgctcctgattaaaaaatggatgtgagctcattttacctttacggaggtccagagatttaaattacttgactagtccctcagcgagtcaggagaagaggggttaaaacctgattcctccagttatatagtcatttaatgttcttggacttaccagtacttttgagtttttgtgttttttttttttttttccttaaacacaaaactacacccccgcctccagctcccaccccctcccacacatatacccttttttcatagaacaaaatttggaataaatggactttaaatgaatgcattgttttgactctgcagggaaatgacatagagaaaataaggaatggatcgtacatgctcatgcactgtctggggcactcctgctgaagtctcaggagtgtctttggtttgttgtctgagacctgagagttaaaaagcagagtgccttttggaggaacacgtgtctctttccgcagcgggacgtgcacttgatacacatcagtgggcatgccatcagtgcctcgcagctcatctttctctttagggtggctgtgttgttcttccgatgactggcttgccctggagaaaaatactgcttaaatattaagattagattagttttcacacagccccattttaaccactaaatttaaatccctcagcaatctacttcccaaccttccctaggcataatattcagtttaataaatggtttgtatgccattatttctcatcaatatataaaaactaaaaggaattttaaaaatccatacatcttggttgagatgaaatttgacttgatgagaagagattattcttagaaatgtttctaattcccaatcaaggcattctatttcaaaatgtaggagcatggttgaaagaataaatctttagaaaataatgtatgagcatggttgaaagaagaaatctttagaaagtaatgtatataataatatacatatatgtatatatacttatatataagtgtatatgtaagtaatatatatctctcacaaatattgttttagtcatcatcatcatcatatacacgtgaatatatgtacatatatgtattatatatggtatatggtatatatgtgtatatatgcaagatatatatgagtatatatacatgtgggtgtgtgtgtgtgtgtatgtatatatatatatatatatatatatatatatatatatatatatatatatatacacatacatatgactccaaaaacaattcctctacaaattgtgtgtcacttccttgacccattacctccccaatgtatatatcatgtgaatatcaaacaattgaatgttttgttggtacaattggattcattcacacggaaacgtggagtctatttcttccttcaaatcctcatcctccaattaattagctgaaaaactgactgcatctctgattctctaagaagcatggaagagaaagaaatgggaaaccagctagcagctcattacatgaattcaaacagttccctttgaagggaaactttttcctggcatagatgatgtcattgatgagattgcaagggtaggcattgtataaagatgagatcctttttaattctgttttcaaaactataaagctaaaatttttagaattgaaatttcagttaacatgacccatgtattagataaaatgtctctttaaagcctgggagctctccaaggtgtggtgtgtttcctatttgctaggtacatgattacgatgcatatggatagatgtttctgaagtgtttccttctaagtgcactattgccagtcagatttacacccaagtagcaaagatgttaatgccatgcaatcctattaatctaacatgttgcttttgtggattagaactactcagactctaccttttagttgtagttattttaaatctttaatactgagctatcaaattttcttttatgatacaaagctactaagtagaagatacttgaatattccattggctgactgatgtgtttattaggcacttactctgtgcccaacacaatgataaacattctcagcaatatcgtgaaagtttaacacaggattcctggcttccagaaatatgatgtttacttaagaagagataggaacatatgtgaaaaagttaagcttcatgtagtatcttaagatgctaagtttagtattctggtggtggagtttcttatcaacaatgtttcacagaagatattgagctcagcttttcattatcaaagcaattgcatgaagaagaaatttgagaaagtacaacccctggtaatgattggagcctctgaaacttttgtaatgtcaatatccatagcatgactattttttatttccggtactgatgtggcagaagttgtggagtagtgtttttgagttatccgctgtttaggatcctgtattaaaagaagtatgtcggctgtgcatagtggctcatgcctgtaatcctagcactttgggaggccgaggcaggcagatcacctgaggtcaggagttcaagaccagcctggccaacatagcgaaactctgtctctactaaaaatacaaaaaaattagtcaagcatggtgtcgtgcacctgtaatcccagctactcaggaggctgaggcaggagaatcacttgaacccaggaggcagaggttgcagtgagccaagatagtgccaccgcactccagcctgggcaacagagctagactctgtctcaaaaaaagaaatatgtctcagtagtgcagttatccttctgtaggtttgtattggtgttcagcaagtatctggtaaattaatgaattaacaagagaatagtttctatgaagcagaaatgcatagcaaagaagtggggtgttgaaaggaacagctgggatatcagttatacaggttgaaatgtggcattggtacaatgacatattagttatactcttacaagttgtccttgagtgggtgcttgatagaagttggcttgcaaaccaaaaaaggttaaacacttgtcatggcctcaggctaatgaccccttctaatatgcaattctgtttttctcattctgagagcaaaccagatgccccatgatgtgcccactgttcttttgctaatgtgttcatcctcagtgccttcattaccagtttctttcatttgacatgcaaagatcttttttcttggctcatcccagagaagtggccgggcaagtgttctcctgagaaaatgttgatgactctggcacacagaccacatacaatttgctgcttcctcacattcacactgaagttggctaaggtgcccagagagaaaccctgagccctgactgcatccaaaaccagtcattagggatgaccaccgtgggatccctcctactgggtgcctggttaaaactgagtgtcagagaagagactggtggctttgtcattgactttcttgttcagatgtaagagcatcatcactgggagaaggaaatgtgaattgtgaaaataaataatgcagatagaagagtcggaagtacagaggagtgttcctagagtgctttatatggagctctattatggtgcataccatggtgtgttgttaagttagtttacgtgtcagtttcccctttacactgtgaaatttagcaaagcagagactatgtctgattcatctttattccaagtacctcacaaaggtaatgctagcgttgaccttaataagcatttaatcatgtttattcatttattttttgaatgaatggataatgattaaaattgaggtttttatctcttgattatggagcttaactcattgtgagcccattgacatcctgaaatacttgctgaatgagagaataaatgaacagatttaaaaaaaaaaaaaaaccctgaagagctaagcttaagccactatttaggctttgaagttgatccatgtggtcttttgttttggattgattgtagggactaaagaagtacttcatacgttgtgttatctttctgctcaggtcactgtggacgatagatagcctttacttctccgctttctcaattttcagccactggtattcaactgcaggccttctttaaaaatgtacctctttctttcaaaattttctgaaaagctagaatttttttgttttttgttttttccaggaaaaaattttaacttactggagaccaatttcttttcttaaacctgtctctgagctgagtatactgtatagtccctataatgattttggtaaatccttaagcataaggtggtcattgtgtgtgacggtgttttctgtttagtgaagacaaatggtgggatgagtctcctgctaggatgtgcagaaatgtgagcattagtctcaaggtacattccgtaaagtgttggtgccaggtgagtattgaggttgatagcttctgtgaggcctggtttcctggggttgtgcccatgttcatatgacagctgcttccacaataacatagcaggtgcgtagctcaggatttgcccactttctgcaagtggacactctcgcttgtatctaaaaggcctctcccatggtgccagaatgcctctgacagcattttcagagctgtgacggcaggactgtagctttatggtgggagcttctatctttgtaaatgccactgatgtcagctctcaccattaaccattttcttttgtcaaatgggagagattcaggactcatggaagtgagagactggcatgatgaggcaaacagggggcagtttaactggctgtttggccactttcccccactctaattctccttctcctttccataaaacatgctttccaatttctgccaataaaagcctttttaaaaaagtactagtctttcatttttttttttgcataccttgttgttattccttctgaaccagtagtaacacaatatacgaagtacattctcttgggtataaggccagtgtataggtgggaatcccatagacctaaaaagaaaaacaatctaggatttctggatgtgctctgaagtggcaccttctaagctgcagtatttgttcaacagtgtttttccaacaaaaaataggatgagttcacctgtgaagcatcctgaagggaaacaccggtgcactgggcagggaacaggagacctagatatacttcttcttttttttttttttttttggtagatatatttatttatttatttatttttattttattattattatactttaagttttagggtacatgtgcacagtgtgcaggttagttacatatgtatacatgtgccatgctggtgtgctgcacccattaactcgtcatttagcattagttatatctcctaatgctatccctcccccttccccccaccccacaacagttcccagagtgtgatgttccccttcctgtgtccatgtgttctcattgttcagttcccacctatgagtgagaacatgcggtgttcggttttctgtccttgcgatagtttactgaggatgatgatttccaatttcatccatgtccctacaaaggacatgaactcatccttttttatggccgcatagtattccatggtgtatatgtgccacattttcttaatccagtctatcattgttggacatttgggttggttccaagtctttggtattgtgaatagtgccgcaataaacatacgtgtgcatgtgtctttatagcagtatgatttataatcctttgggtatatacccagtaatgggatggctgggtcaaatggtaacaacaggtgctggagaggatgtggagaaataggaacacttttacactgttggtgggactgtaaactagttcaaccattgtggaagtcagtgtggcgattcctcagggatctagaactagacctagatatacttctaacataatctgtgactgtgtgcaggtcatgctaagtatgtcagactgccattttctccttgaggctggaagtgtggggagaaggggataatgtagttgagaatccattactggccccaccttggacagagagacaggcaggtaaagggtacacatgtgcctggatggtgctgctactggactcttgtttacattaatgtgtcaacagtgtgctccaaggttctattaggtgttaacaggtgtctcaagaaaaaaatgtttcttaatgagatcagtttgtaagaattctgggtgaacacgttaattagtttattcttttaatgcgttgaatgttttttttttttttgaaaaataatagaatcccttcagaattcttaatatgatatggtgttctgtatattttcaagaggagaggtatatagtgtttctcaaatttatttgcacatgaaatgcctgtgggacataatatctctgaaggccgatgttccttgaaagactgtgtgaaatattgaactatatgatctctgaaagttcttgaattctccattatcatcagaatacctggcccttccaagcccttgaccttcgtctgtggagtattgactctagctgccttccagacattgtcatctatgcttcttttcctctgaggacgatgaaccccggctgttctctcagtacccctgaaaaatgggaaattgtatttttttcttctttgtacccaggagtctatgtataatgcataattctcagtcaaaaggaacttgcttacttaagtgctcaaaggtttttgtcctgtggtttttgtaaggtaatcccacaacatccagataaacaaataatcacaagacataaccttccagagtgttccataacattgatcacaatcaaataatgaggcacgattccatgaaacattaggaaaattataaaggcatcaggcagaaaaccagcaactagcaaatggtttctccatgatgattttgggttcacatttcacttccatatataatacaacttatgtgcccatatttcatcctctggaagcctgccacattatcctctgaatgaatattaacactccttgtactctgaagtagcctctggtattctggtatttattcaacaggttttgaacaagattagtggattataattttggcttcaccacattttaaactgtgtgccttctctgtgcctcagttttctcctctgcaaaatggaacaatagaatccttttcattgagttattctgaggattaaatgagtgaatataggtaaagcacgtaggacatccctggcatatagcagtcaatcccttgtaaaatgttagctgcagtgggtgcaactgactgcggccagttgtcaccacctgtgacatttaccaagacaattttgggtaaaaaaggcagatttattggagaaagtacaaagataccttgcaagaaagcaatgcgcaggacaatgggctgtctaccaagaggcaggagctagagggaagttttatagggtcatactggaggggctatgtccagataagttgtgcagataaggtcctgctgctagggctatgtccagaaactaggtatttgggaacatgatgttctgtcagtcggttgtctgtgataagccatctcctctctcagaacaattgttctccccaatctggggccccttcttcattcttgcttatcttattaggactccacattaactattgttgttattatcatacacagactatctctgaaaggatatataagatatagataccagccataacctctgcaaaaagatacaaagagactagggagccggaaagcaaagatagaggagtaggcttacttttccctacatatgaatttactctattgaatattttaaaatcacctgtgttttaccatcaaaaaaataaaataaaacaagcatcaatatttacaaatgaagaactgaggttccaactttacgattgactttcctaattcaattggctatttgacttccctaatagttaagttagatttgagccagggatttgaactacaaaaaccgtgttttttctagtctaccaccttatatagagagatatgacagaggggagagatgagaggtgtgtgggtgggtgggtgagggtggaggaggtggtactggatattactgaaaaacttttgatgatattgaattctttccctgagttctgtagattttggcactggtctcttgtttcttctatttctactgtgagtaaacaaccattcccaatcctccagttctaacttgaatttcagtggactaggctgagtggatgtacaagggcaaacctgcatggggtgtagggaaatataaatagattggcactgtggaagtcagcatatgtttgcttggcacccaaccctcctatgcctttcatttgctgaatattaagcatctcatttttatctgtcctctttttgatggaatggacatgcaaatttttcaaacctacacaccctcttctttctcttggacaaagggagtaattttactatgaatccatcatgtgtcccaaggaggcaaactcaaaatttgtctgcaaaaagcctttcattcatttcttttcatgtaagaaacaaaattggcaactattttttcatagcttgtaaattccaagaaacttagtatcttttcttttcacttgctctgcagccaaaagcatattgttcagcattgcgaattcacaatactcactgctcctcagtcctggctacaacataattttgaaaagtttatgcagggaccatccgagtaataaatcacagaggaggactgctttaactgttcaccccttagctactgcctgaatgagctccatgctttatcatctcagaaggaagctgtctcaaatgcatgcttcattttattatccaattgtaacccatctagataaatttaacttcctatagatttgctgcctcttagtattcatatcttctccagacttttcattaatattatgatacttggataggagtattcccctccctttcctttataatgtaacagctttaaattgacatttggtgaatgtatcatcattgctattcaaattaggtcagtgtttttatttcattatgctggaagtcctcttagctgcgaaatcaagtttgaatgtctgttacctgaagcaatgcttctggcaaatgtttcttagaggtttttgcaagccagaaattgtcaggcacctcccccactcccacttcttatttctatgtggtttggttcatataaccatttaacatatttttataaagcggtagttgaatagagtataaaataggaaaaaattaatcatctgccctttaagaggtttctgtccactgtgtgggtgttggagagggaggtgggggaagagaggggaagggaggcagatatgcaaacaaaaatcatactatgccatggttttggtacagtcagttaatgtctaggatataatggaaacgtgggaaaaggagcctcttgacgtttactaagacttgagaatgagtttttttcttaataatctataaattgaaatccactctttctaaatgtgcctttggcactgttcttttgaattaggaaatacagaaaaacagttaaatttggttgaacgatacaggaagtactcagaaaaggcaaccatcttaccccaggagagatcaaaagacattcacagattatgttaacccaaagttttggcctcatttctcaaggaaggggctacatcttttagaccacaggcatttttccccagttttgaaactgtgaaggtgtttaggacctgagagattattaataacaggtttcaatgcctgacactcttggacttaaatgttcacctacactcaatctgatcatggacaaactacttaatctcactgagcccatgtcctcatccataaaatgagggtaataatagttccacgttttagtattgttaggatgattaaataaaataatgcatgtaagtaaaataacccagctattggaacaatcgctgctgtataataaaccatcaataattcttagcttttgctatcattcttgctactgttaattagttagtggttctcacttttttctagaaattgctctacctctgtttctcaactgagatattatagtttaagactttgattatgataactagatgataatttagatggtgtctttttttttattatactttaagttttagggtacatgtgcacattgtgcaggttagttacatatgtatacatgtgccatgctggtgtgctgcacccactaactcgtcatctagcattaggtatatctcccaatgctatccttccccccgcccccaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgtagatggtgtcttgatcagcaatctatgctttgagtgttttttgttaagtggctaatgcagtttgcatatttgtcccactaaatctcaagttaaatgtaatcctcagtgttggaggtggggcctggtgggaggtgttagagtcatgggctgagcactcagacttgggcaccatccttgtgacagtgagtgagttctcacaaggtttggctgtttaaaagtgtgtggccatttacctatataacaaacctgcacatagtgtacatgtacccctgaacttaaaataaaagttggatatttttcaagtgggcttcatccctgggatgcaaggctggttaaacatacgcgaatcaataaatgtaacccagcatataaacagaaccaaagacaaaaaccacatgattatctcaatagatgcagaaaaggcgtttgacaaaattcaacagcccttcatgctaaaaactcaataaattaggtattgatgggacgtacctcaaaatcataagagctatctatggcaaacccacagccaatatcatactgaatgggcaaaaactggaagcattccctttgaaaactggcacaagacaaggatgtcctctctcaccactcctattcaacatggtgttggaaattctggccagggcaatcaggcaggagaaggaaataaagggtattcaattaggaaaagaggaagtcaaattgtccctgtttgcagatgacatgactgtatatctagaaagccccatcatctcagcccaaaatctccttacgctgagaggcaacttcagcaaagtctcaggatacaaaatcaatgtgcaaaaatcacaagcattcttatataccaataacagacaaacagagagccaaatcatgactgaaccactcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatctcatccccatcaagctaccaatgactttcttcacagagttggaaaaaactactttaaagttcatatggaaccaaaaaggagcccacattgccaagtccatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcttatctacaaccatctgatctttgacaaacctgagaaaaacaagcaatggggaaaggattccctatttaataaatggtgctgggaaaactggctagccatatgtagaaagctgacactggaccacttccttacaccttatacaaaaattaattcaagatggattaaagacttaaatgttagacctaaaaccataaaaactctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctatagaatgggagaaaatttttgcaatctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagaaacatgaaaaaatgctcatcatcactggccatcagagaaatgcaaatcaaaaccacaatgagataccatctcacaccagttagaatggcgatcattaaaaagttaggaaacaacagatgctagagaggatgtggagaaataggaacacttttacactgttggtgggactgtaaactagttcaaccattgtagaagtcagtgtggcgattcctcagggatctagaactagaaataccatttgacccaaccatcccattactgggtatatacctaaaggattataaatcatgttgctataaagacacatgcacatgtatattttattgcagcactattcacaagagcaaagacttggaaccaagccaaatgtccaacaatgatagactggattaagaaaatgtggcacatatacaccatggaatactatgcagccataaaaaaggatgagttcatgtcctttgtagcgacatggatgaagctggaaaccatcattctcagcaaactctcacaaagacaaaaaccaaacaccgcatgttctcactcataggtgggaattgaacaatgagaacacttggacacaggaaggggaacatcacacactggggcctgttgtggggtggggggaggggggagggatagcattaggagatatagctaatgtaaatgacgagttaatgggtgcagcacaccaacatggcacatgtatacatatgtaacaaacctgcacgttgtgcacatgtaccctaaaacttaaagtataataaaaaaaaaagtaggatattttttaaaaagtgtgtggcgtcttcccccttattctctcttgctcctcctcttgtcatgaaatgcaccagctcccccttcaccttctgccatgagtaaaagatccctgaggcctctccaaaacctgagcagatgccagcatcatgtttattcagcctgcagaaccaactacacatctttaaaaaaaataaattacccagtctcaggtattcctttatagcaatgcaagaatggcctaacacagtggctttttttttcttttaagtatattttatatttagatgctactattagcagatgatttgtgcgtatgtcttgccctgttcagctttgaggagtccaggcccttatgggactccttctgagagtggggttcctattttccttaggaacccaagacagttctttcagaggatttcattgatctgttgccccatggtgctttgtggcacataatgacaaagcatgacaggcaggctcacagccctcgactcatgctagatctcggttcattctgtatccagggactccagttcatcatatcccttacccaggcctctctcctagctatgtctgtgtggctcacagatactctagagggagaggcaattaatttctttttggcggtgagatggtttgcctgggtccccactccaatcttatcttgaattgtagctcccataatgcccgaatgttgtaggagggacccagtgggaggtaattgaatcatggagatgggaattcatgttctgttgtcatgatagtaagtctcacgagatctggcggttttataaatgagagttcccttgcacatgctctcttgcctgcaaccacgtaggttatgcctttcttctccttagccttctgccatgattgtgaggcctctccagctatgtggaactgtgagtcaattaaacctctttttctttataaattacctagtctcaggtatgtctttattagcagcatgagaactgactaatgcagggggttatttcatgtcagacattgtcgtaagttgtgtcttccttggtgtcttagttttttctgtgctgctataacagaatacctgagactgggtaatttgtaaagaacagagatttatttcttatagttctagaggctgagaagtccagatcagttgggtggcatctggcaaaggctttcttgctgttttgttctatgatgaaaggtggaaaacaagagagagaacaaaaggtgtctaaatttggttttatagcagatccattccttgataaccaacaaactcccaggatgataatattaatccattcatgacggcagagcccttgtgacctagtcaccacttaatgctcccacctctcaccactgttgcattggggattaggtttccaatacatacctttatggaacacattcaaaccatagcatttggcaaataacccaaacccttctttcctcatctgataattgggaaaataatagcaactaccttgtggatactttgtgagaatcccatgcttcatgcaataaggacttaataattgtaagttgttaaattgtcatacatgctccttttagttatgaaaacctgtggcttttgtctaagagttgaatatgagaaggttcaaggactagggcttttatccttggatctctgtagcatgctgaattaatgaaaggtctgtctctctctctctgattaatcaaaaactctgactagtactagtgaaagtcaggtttgaacaattctgtgaagaatggatttggaaggaaaatatgaggcaagaattttaaaaagttgtttctgagttgaatttgatttacatttgctaactggaaaaagatcagggtataatcagtccataatattgaaagcagtttggaaataccattgcagatacaggtaatttaaaaaatctacatgaattaggtccaggagcggtggctcacgcctgtaatcccagcgctttgggaggccgaggctggtggatcacgaggtcaggagatccagaccatcctggctaacacagtgaaaccccgtctctactaagaatacaaaaaattaggcgggcgcggtggcgggcacctgtagtcccagctactcgggaggctgaggcaggagaatggcatgaacccaggaggtggaacttgcagtgagtagagatcgcgccactgcactccagcctgggcagcagagcgagactctgtctcaaaaaaaaaaaaaaaaacctacatgaattattcttcctgtgacatatttgtcattcttcatctctcctttaacattcctatcttcatccttcaggccatcctctgcctacctctttctgctgctacagtgtaagttgaatcatactttccaaaatatgtaaatgaaagtcagaagtaaggcaactcatagtgtttcagtgactttgatttcaatctcactcaagactgggagattctcctaaattctagcaaacttgtgcctctttcccagccttataagaaactgtccttctatctaaatactggaatgccactatgtgaagcttcaaatcagggtggttattctgagacaatggcagcttcttgggatgtggtgtaacatgtactaaatcattatgtgcacatacatttatttttaatcaacctgcgtttacctgagtgctgtggtttgaatgtgtcccctaaagttcatatattggagacttaatcctcaaggcaacagtgttggtgtatggggcctgataagaggtgattaggtcatgagggctctgccttcatgattgaattaatgtcattatcacaggagtgggttagttagcacgagagtggcttgttctaaaaggaagttcagccccctcttcctctcttgccctttgcctttggtcatgggatgaggcagcaaggagtcccttgccagttgtaggcccttcgaccttggacttcccaggctccagaatttcgaagaagtaaggctctgttctttgtaaattatccaggctcagatattctgttatagcagcactaatggacttagtcaccaactaaatgtaatggacaagaatggcctacattaaaaaaaaaatgtgattagaggatcttaatatcttattctgtagtgaactttagaatattttagacactggagattttctatcagatgtatcctgtggattcaataggattcattttgagaggcagctttctgaagtggaaataattctgtactccaggcacagtaattgggttcaagccccagctctgccatttactgggatggggagaaactcttggacagcctgttaggcctttttggcttccacttttcttgtctttaaaataaagttaataattttcattctgcttcactcatggcatagatgtgaggctcaaataaaaaaatattttggaaactaccctgaaaactgtagaacattctacaaatattatctaacaaaatatatgaatgcataattagtgtcttcaagggatgtcataaatatcgtaaaactaaagggtgagctgtatcaaaacttggaagggattgggatgaaaatcaaactgtctaaaatagaatggccaaatacattgggacttggctccagaaagaattaatgagaattacacagattcatatcttctccattattccattggtcacgtctaataacttgccatgaaattgcattgatttctacaaagtgattgcatatgctgttgcctcttttcaactgcacatgtcataattcatccatccagatcagtattttacttttaggaaaagagagatgctaactttttctcagaggagagtgtttagaagtctatgttctatagtccctcctagagaggggggatttcttcagtactcagcagctaatcttttttttcttctctctctttttccttttttattatactttaagttctgagatacatgtgcagaatgtgcaggtttgttatgtaggtatacatgtgccatggtggtttgctgcacccatcaacccatcatctacatgaggaatttctcctaatgctctccctcccctaacccccacactccccaacaggtcctggtgtgtgatgttcccctccctgtgtccatgttttctcattgttcaactcccacttatgagtgagaacatgtggtatttggttttctgttcttgtgttagtttgctgagaatgatgatttccagcttcatccatgtccctgcgaagtacacgaactcatccttttttatggctgcaaaatattccatggtgtatataccacattttctttatccagtctgtcatcagtaggcatttgggtttgttccaagtctttgctattgtgaacagtgctgcaataaacatacatgtgcttgtgtctttatagtaggatgatttataatcctttgggtatatacccagtaatgggactgctgggtcaaatgttatttctggttctagatccttgaagaatcgccacactgccaacaaacatatgaaaaaagctcatcatcattggtcgttagagaaatgcaaatcaaaaccacaatgagataccatctcatgccagttaggatggggatcattaaaaagtcaggaaatggccaggtgtggtggctcatgcctgtaatcccagcattttgggaggccgaggcaggcagatcatgaggtcaggagatcgagaccagcctggctaacatgatgaaaccctgtctttactaaaaatacaaaaattagctgggtgtggtggcatgcacctgtagtcccagctacttgggagtctgaggcaggagaattgcttgaacccaagaggcagaggttgcagtgagccaagatcctgccactgcactctaggctgggtgacagagtgaggctccatctcaaaaaaaaaaaaaaaaaaaaaaattcaggaaacaacaggtgctggagaggatgtggagaaataggaacgcttttatactgttggtgggagtgtaaattagtgaaaccattgtggaagtcagcaggtaatctttttacggtctgagtaatgaggaacctggctaatagttgccattctagatagcattaagggtgaagtctttgctcacagaagttggtgtatccagacagacattgtaattacagcagagcaaattaccatactctgaaagagaagaacacagaaagcaacaaacacatttaaagaagactgtcccagaaataaggagaagggcaagaaatctaagcagaatattccacttgccatttacagcatagacaaggacagcaaaatggaaagtcacttatataactgcaggataaagagatgggtgagatgaaatatactttctccgaatgaagttcactgtatgtgtagtggattaaatgagattgactatttttaaaaagcctgttacaaagaagaacaaatttaatagactattaagaggtaaagaggaacttttaaaagcacatattgattaaaacaaaagttatacactttgggaggccgaggcgggcggatcatgaggtcagaagatcgagaccatcctggctaacacggtgaaaccctggctctactaaaaatacaaaaaaattaaccgggcgtggtggcgggcgcctatagtcccagctactcgggaggctgaggcaggagaatggcgtgaacccaggaggcagagcttgcagtgagcccagattgctgccactgcactccagcctgggtgacagggcgagactgtctcaaaaaaacaaaaacaaaaacaaaagttatagttcagaatatttattgcatacaactcagcaaacaaagttgacctagatacaagagtattattggaatttgttagtgaatacattgacaaaattctgttatttttgtttaattatcactaggtccagtagggtggaagtcagaaattttgacttaaaatatcagctaattgaattagttatttcaaatcaatgtctagtttggataagaatattttataaaaaaacaaatcatagtattaggcatagtttatgcttggtggcatgtagagaaatataaaaataaaagatagtgaaatctttttaaaaattgtgttgaaaggtataatcatttgtgttaatgtattattcaaccaggatgtaggaagaacacacatgtcactgagctttgttctggggctggaaggaagtgcaaataacaatgatgataataataacagcagtagctaatatttatcagatatagagcttgttaccaccacagtaagcaatttgcatggagtatctcagttctcgtgattagtcaggtacacttcttacattggtttttcggattgagatattaaagtccttagaattgaaagaacttgctccaaatcatacagctaggaatggtagactagcgtttttactcaggcagtctcaagataacatttgttgagggtctattaacaaccaggcattgagatggtgtttacacatattagttatctcagtggttcttaacctgggatgcatgttaaacttaccaaggaagcattttaaaaccctgatgcttaggacctacaccaggtgaattaaatcagaaccttttgagacaggggcaggacttggcatcagtatttcttaaatataaacattgtatatgtaaatattatatcaataccagtatttttaaaagtatcccaggggagtcagccttttgaattactgtccatttaatattcaaagcaaagtctatacatttgtattattcctattttatttatgaggactctgagattcagtgacgataactgacttgctcgatcaaggtcacttacctggtaaattgctgagctgggatgtaaatgcagttctgtctagctaaagagcccgcattcttcttgatgcctcagtgtctagccattttacccagagcaataaattcacttgttcctgttatttagtgtttatcatagaatttagctttagcctcaatttcattttattgtcttcactattgagtactcacaaagggagccagttaacaacatctttggaacaaccatcctgtgtggagcattgtgctaattgctgtgggaaagaacaggggaagatatgaaatattccctttacaaagatatctactgttctgccagggttcataactttgggcctgtgacttgacatctgggtggcaaaagaagtctcatgaattgtttgggaagtattcatagttttcatcagattgtaacagagccatgagccaaaatatttatgaacttctgccttgcttggtatgtaaggcatttgattccagaagcagtggcatattatcttgaattttcttcataaaggcaaaacagtgccttttcaagagattttgagtttgatatactgtcaaaaactgtttacagctaagcctagtaaaagatgttgcatatgtggagtgtgtgtgtgtataaaaaaaatgcaggctgtgaggccgggcgtggtggctcacgcctgtaatcccagcactttgggaggccgagatgggcagatcatgaggtcaggagatcaaggccatcctggctaacatggtgaaaccccatctctactaaaaatacaaaaaaattagccaggcgtggtggtgggcgcctgtagtcccagctactccggaggctgagtcaggagaatggcgtgaacccgggaggcagagcttgcagtgagtggagatcatgccactgcactccccgctgggtgacagagctagactccatctcaaaaaaaaaaaaaaatgcaggctgtgaatataaaacaatgaaataaatttcattagtggctcagaaactagatctgagaacaaggatttggttgtttctggcaataaaacattattaagaaatgtgatatcatgaggtaaatatcttaaagaattgtattcatttacacacatatatgtacaaataaatttgcacacatatatacatgctatgcacatatatactatatatacacatgtatgtattatatgcatgcaccaatacatgctggcatgttttatgcaaattgatttttattccatagctatttttcctatataatccattatttttaaatgtattaataattttaatatcaccataaactgaaatgagtaaagaggcctgtaatgtgaatattcatatatggaacataatacgggggttgcgtaattataggtccatatatgtattgtatttcctgatatatttatatatgaaattgctagtatgtgtgaaagatatctacatatattttactaataagagatatattcatatatatatatacaaatatatgctttatagagcctaagtttggggtggaacaaatgttctcacccttgtttgattatgagaaccacttgcagagctttttaaaaacctgagtcccttttacccttgattcaaattcagtacatccagagcgggtcctggtgctgtttttaaaacattccttgaatggttgtgttgctttgcttgagaagcagccctgtagtttgtgtacaggtaggaatgaggaaggaagggtaccagacaacagacaggtaagacagtcaaggggaagaggccaggaaaatttctaccaggagggtggcagtttattgatttgcttatgttaaaatagttgagtccgcgctgtatctttttacttgattaatttaatttacacaaaccaaaggtcaatatcaatgattaatgtcagagggaagggtattattattatttttaaccctacttctttttcaactactacatatctgaccttgcagaggaaatcttggagagaaaatagccactttcatacgactatcccttggtcaatgcgctacttattaaactttattttcccactgaagaaagaaaatcctaccttcagggaataaaatagagattcattttctgacctcctagtataatgctaaaggaaaagcatacaatctctttggggagggagctgttaggaaggccagaggcagctgtcttggaaacatacagaaaggtgctattgggacagagcataatttaaagtaggtgagattggaaaatagggatttttccttctcttttacatttttttttcctttcttgaacatatacagttcttcagttaagtgttagcctgagattaaatataacatttatgaagctcctttcaaaactcatccctgcatgtgaatggaccatttcctcctttataccactgcactgacttctaattacatgcatctttcatgaaaatgtttgtcagactgtctgatgttaaattgcaagataattgataacaagacccatgtcttaatcatctttgttggtgctaaatacgtgtttattgaatgaatgaacaaacacttggatgaataaatagactgtaattgttagtaactccatgagacctgcacatttctttgttattggcactttgcctccctgtttctcttgagcttcatggttctatatctacatcacaggtagtctagtgtaaggttgaataacaacactcaaattaaaaagtaaaaatcttaagatgcttttggtacctaagcataatcataaaacaatggtcttgtttaatttgaggaggagataagtgatcaaacccaagaatccataaatttggcctaagtattggtatttatttccagagatgggcaaggaaagagtgttggaagaaaatacaaggtaagttttacaacctgtgagtactcagaacctggactttcatgtcttttagaaagacacattgacaataggcagaaaatccttagctacaactcactggctgaaagcttggtcagttaaattgtgaatttacatggaatccaaatgaagtgttcagacatttcaaacatctcttgcttaatgaggttctgtgcctggctagcaggtcagcagtctgatttcagtttacagatgcagtcttaaaaaaggaccctgagatcatctataacacttccctgtcttcctttgctccagctgcattcatcagcttccatcagggttcacagcaatgaaattaattgacaagaagctcaatcttaagagcactctgaactgtatactcttgccatccacccgctaactccaatcctacatgaatgaatgcaagtgtagttttttgagaaggggccatggctcaagcagtgccatatatgtgccttctatacaactggcttggtatctggtaaaatttccattgcccagttacaaactagccagtcccttgcagacctaggatcctcttagaatgccctatcaggaagttctttgcaagatgttttaactgagcaatgaatttatagaggaggacttgaataaattgtttcaaaaatgaaaccatttgaacacaaatcatgtctttcactaagacccagacaaactaactcatatgtactccacacatctcagtgtagtaagcagatggaaaatattcattgttttttttttttaccaatgagacactagtaacaaagagaaagtgtagaaattcttcaagatccctagaggctgggcaatcatatttctagcaaaactcttgactttcttcctgttctcaacctctgccattaaaataaggaaatagtgctatcaaagtaaaagagaagcatctgttggaggggttcaagggggttgagtctttaggcatcaaagctaggagttggctgggcgtggttgttcatgcctgtaatcccagcactttggaaggccaagtcaggcagatcacctgaggtcaggagttcaagaccagcctggccaaaatggtgaaaccctgtctctactaaaaatacaaaaattagtcaggcatggtggtacatgcctgtagtcccagctactcggtacactgaggcaggagaatcacttgaacctgggaagtggagttgcagtgagccaagattgtgccactgcactccagcctgggctactgagtgagactccatctcaaaaaaaaaaaaaaaaaaagaagaagaaaaaaaaaaagctgggagtttcattattcctcaaagaaggcacctcagaccaggttccatagggcacgcccctaaagagcccaaccttctcagggttctaaaatgtatcttaagcccaagcaaaatccttgactttccatttagatgccaatatgccatcctcataatattcattctcatggaattttgagttcccacactcttacatagctcccaaagccaacttattttactgctgaaaaatacttcagtacacttttattgctgacactggtttctctatacttcccccagagatattcatgttataagtaaatctttttccaaggtgtgcttcatctcctggctggaagcaagaaaaaaaatgttcaaagtattgtagcactttttacagagtgtgtatcatgaaatcaataatcatttattgagtactgactattcactgtggggccagatattgagaatattggagagcaattagatgtggtctctgactccaggggtctacaaacggcatggtggggaacaagctcattagatgaggagaaaaaataataatataagtgagtataaactcaagaactataattatgcattgattaatgaaacaaatactgaagatttactttttaaaaagcgttgtgctcaaggctatggcagatgtaagtttataatatgaccacttacattaatttgctaggtttgccctgacaaattgtgaaaaactgtggctgaaaacattggaaaatcagtttctcccagttcgggagaatagaaggccaaaatcaaggtgctgacagtgctatgctacctctgaaggctctaggggagaattcttccttgccttttcctagcttctggtggcggccatcaattctgggctttccttggcttttagcagcgtcactccagtccctgtttctgtggttgcaaggccttcttccctgtgcatatgtgtgtgtgagtgcatgtgtgcatgtgcacctgtgtgtgctcctgtctttacgtgacctgatacgaacactagtcttttatttggaacccaccctaatccaatatgacctcatttaaactaattgtatctacaacgattctatttgcaagtaatatcacattctgaggttccagggggacattgttcaacccagcacaacccttaaatatcctattgtcttgttggaggttattttatgggattcatttttggtgttccatggcttttcagaggaggctcagtgtccactgatagtctctgggaagactacgtaggcataggtccgaccattgctatattttcttatatctatgaaatcctaagttaacattttaaactacagtctactgtgtgtcaagtgttgtcctaggctcttatttacttaattcaatcttatcctcacaacagcctttgcagtatgattttttccattgtatagatgggaaactagttcagaaagtttacttacttacatgagacttataagctaggcgctgggatgctaaacaaattagttccaaagtctactattcaggctgaacttatgcatttctggtggtgaaagcacagcctacataaccattagtttgtgatttagaccttagcccaaacattcgtcattatcatatttgaagccaggatggacccattgttccagatctatatactgtatatcagttagccatatcaattaataatcttttgatacttgtcaaagagcagagaaccgcagaaattaagagtttattctcttcattaaaccattaaagattggaggtggctattgtgaattgggcatgaattatagcataagcctatatatgttgcatatagccccccgtaacaagcctccttgttgtcttttgtgttcctaacttatgagcagggcagagattatcactgaacacattgcagggtaaatgtaggactctgagtcacccattggatttttacaggctgaaacatttacagtgtcctgcttacaattctcaagcatcagttaggtgcaggaacacacaggcagagtcagtagctgcccagggaactagtgtccagtctaatctcttcacaaactttgtgcgtgattcaggaaggattattacaggccaaattttacccatggacctgttttgtttagtaaaatattttcaaaaataaattttggatttgaatgactttagggaaggcaggaatgatctaggctctcacaagccttagtcattacccctggcctgaattacatatttatgtgagccctctagtccctggaagcagttctgtttgtcaccctgtacttagaaaagtggaaattaatgtatggttcctggacaggcagcaccagcatcaccagggaactttttagaagtgcaaatcctctagtcccacaccagacttactgactcagaaactctgacgtggggcctgtaatctgtgttttaacaagccttctggttgattctgatgtgcattgtcctaggagaaccactgacttagagataagttaagaaactcttcctttcttgaagaatagcgtcttctgctttctaataatgaacttttctgtaatgcctcaagatctacaaagatgtcttattttgcttccagagtcacgtgagaaaacagtaacaatttgagggaggtgttgctctttcagctttatccagagatgtgcggtggcttgttccaggtgttatatgacaggacaatggacctcaaactcaagattctttttcctctacacttcactactttaactctcctgattattttgtggactgatgaataagtacgtgtaaactgattttagttttcctggtaatgaaaaaaaaaaaaaacaatgagtattgttactcttgtaataatcacatcattttttgtctttctttctttttctcattttatttttagacagggtcttgctctgtcacccaggctggagtgcagtggcatgatcacagctcactgaagcttcgaattcccgggtttaagcagtcctcccacctcagcttaccaaggagctaggactacaggcatgtgctgcaacacctggctattttaattttttattttatttttttttatttttgtagagacagggtctccctgtgttgctcaggctggcctagaactccctgggctcaagtgatcctcccaccttggcctcccaaagtgctgggattacaggcgtgagccacttcacccagcctttttttctgtgtctaaaattcagttactctctcattcacttaacagtttagaaaatactaactatacaacatgtactacgctagatgattttttaacttaaaaatgtgcaatgcacatgcatattcataataaaaatccatctttctaactcctgagaggtaagcaaaaacttattttactgctgtaaaaatcacataattggggacaaaaacttgcatgtaatatattttctatgagactgtattgactttgagagtggttagagttaatggtttgaattagcataagtaaaattaatgatattgtaggtcttaaatgtaaatgcaattttacaccaggcccagaagaaattcccctcacctaccttaattggtcagatgaaaatatttggaagaaatacctcattcaattttttaaaagcatattggctacttgccaccattgaagaattagatctcaaactaaagggattgtcgggatgggcttaaacagccttttgatttgttcattaattcatcaattcaacctctcacaaaacaattgtatgttgaatgactgctaggtgctgtgtgctatgctaggtgctgctgatacagttatgagcaagacagactcagaatcttataaatctttttgtacaaaagacaaacaattatttcagtgagttgattaaatttaatattaatatttaataaagcagaagtaattatacctgcaaaggaaaaataaagtgtgtttttagcacctataatttgaggactgtgggatggtagggttatctgaaaagagataaataatttgttgtatatttgtttcttttggggggtgaatgccatgtgccatgatgtgggaattaattggaaaaccataggctatgggagtcagaagagacattagaggctctaatatctgtcccacttttctctaatttagaaatctggaggctgggacccagaaaaggtaaaatgaattaccccaaagccacacttagtgaatgaaagatgtgtgaacggacatatgcatgggcctccttaatcctatgctagggatgaggacatgcctttcccaaaaataggtgaaattaccatatgataaagaacatttttagatattgggagtagggtagggtacaaggctttggaacagcaaagttaatcagctcagtagggggaaggaaaaaggaagagagaaagagcaggacctccagtggaacaagagtctgtggactctgtcaccctgttactccctcttaatcactcagatgatttgctttttctgcttctatttcaaaataagctgctaaaactgagatgcagtgcagtgaaagcacatcatgatctatgttctcatttttgcatggagggagtgagtaaagacctcctacttaggtagtcatcttgctgtccctgcatgtagactaaggctgtgagagagaacttggtgctttataaggcattccctgtgctggtataaatttgacccttgcatgtgagtgatggtgagggacatctctgagaattgttcctggtacaacatgtgtggatttcaacatgggtactgcatgctggagagatcttgatatgacccaaaagcaagaccagaggcaagcttgacacgatggagcaaagggtggaaaggtagaaaatagaatgaaaaatttttctttgctgtcacctcctcgattttattcaaatcttaacccaaacaactagattgcattactgggctcttaaaagttttgttggaaaagtgctgctaaagaataggaagacaatctaggcaatgccattcaggccataggcacggacaaagagttcatgaggcagacaccaaaagcgattacaacagcagcaaacactgacaaatgagatctaattaaactaaagagcttttgcacagcaaaagaaactatcaacagagtaaagagacaacctacacaacgggagagaatgtttgcacactgagcatccaacaaacgtctaacacccagcctctataaggaacttcaacaaatttacaagagtaggatctcataggtttatttacaataataattcaaatgtttcagatttgtaattgtcctttgaaaccattgctttcctttaattccagctataccaaagactctttggaatgggtaaattatttctacttgatagactaggaaagtgagtcacaaaaaggctcgcccagagctactggttattagttgtgtgtttttctctcctattccacactcgagaaaaccccgaagaatagggggtggttaatggtaaaaagaaatctagaagaagagttctggaaatgaaagacagctaggttttgagtttctctaagaaaaggtagggggcaatggatttaaactaggggcatacactgcgattaaatatcgaaagaaacacactgagatttaaaaatgtataaagggcttatgggaacgaagaactaaaaagaaaatatgaggcaagaacatagggtggcgacagaacaaggctgtgagacgtgtgcttggtttgtttaggctttaaaacttgtcaaagtttaccgttttctctttcaagagggatgaaagaaaggatggtgcttcccttagtttgtttgctttcttctttcatgtatctgccctggcagatatgcatacatgtgcaggcccgtgtgttcgtgcacacatatgcacacagataaagtgggaacagagagaagccagtgggtggtggtgagagatgggggcagaattgatgcatcagggggcctaaatccatgcaatgatcaagttcatagcaatttccccaggagactgtatcatattccagtgaaggggagtacggcaggaggttgccatggcaacaaaaggcctgaaatattaactctgactagcaacaggccagtgaaacagcctagctaggatttatggcacattatagtgtgaaaagcaggagaaaattactgtaaaggcaggaattatagcacaacagaacatataaactcccaaatccgtcttcctaattaaaacagcatgctcggaggtagagcacatagtaaggccattagcttaaatggggatgtgctatcatcgctttgttatcaagtttaatgtccttaagactaactgtgtgcactgggagagtgagagcaagggtaagatagtctggagacagatggaagcaagactcttgggcacttgaattcttctcaaactcattcttggtgacataaggtttcttcagatactagtctctgatcccacaggagattctagaagatgccttgatccttctatttgtaaataaatcatcacttctcaggcatgaaggctgagagactgataccacagtcaatccctctggaacccaccaggaagagaggagcaactaatcaatgaggtttattgttgaggaaaaaggatcttggatctcccgactccctagaggggaaaataactcccttgttgtcacagacccaaactttcttttatgtcttagtcaacagcctgcccctaagtgtttgaatttgcaatgcctggaggaagtcttccatgtaattcatactttatgagggaacctttgtcttcttgtgattcttattagaaactcccaatttctcgaactctaatccaggaccttagtactcagtctggagatgggtcagggaaaatgagaaaaccattattttacaagggttcattgttcatcctttattctgccagccattcaacaagtatttaatgaataccttctacattctagtaaatgctgggaacatgtccatgaacattaaacaaacgcacaaataattacttaataaacagttaaatatacaaaagaaagtacagaatgttttgaaaattatgaaaattcttcccatagcactatctttatttccctatcaccatagttgccaaagtgcccccacctgacattcttttaggtttgccagatgaccaagccctacattcccacagctatgtcagcaacatactcaagatcatcctttagacattgcattcccctcccctcccctcccatcctctcccctcctctcccctcttctcccctcctctcctctcctctcctcctctctttcttgagacagggtcttgctctgtcacccaggctgcagtacagtgattcaatcctggctcactccaacttctgcctcctgggctcagatccttccacctcagcctcctgagtagctgggatcacagttgcatgccacagtgcctggctaatttttttttctcttttgtagagatggggtttcaccatgttgcccagctggtctagatctcctaggctcaagcaattcaccctcctcggcctcttaaagtgctgggattacaggcatcagccactacttctggcctgtgtttttcttttttaaagataagacctaaagaggattttgactattttgaaaatatattcatatctgtgtatttttggttattcacttccaggtcctaaagttgcaattaaggagaaaaaaatcattgattattcttagtagttttgatgaggtaatgcaaggtttttctgtagcaaagtcagcatgcgtcgtgaatatggttaagctatgtatgattaaaggattatttatgttttatttataagtatttgctatcaataacagctcccaaaagtaagattcaccagtattactacagcatatgggacttttgctgtagattaataatgccatgatattttctttaatgaaggtggaaatgattgctttattttaacaaagggacctctatggtccccctgagtttgagccttgaatgtagacgatcagggatgctatatcacagctgtctccctgctgataatgactctccttggggtttcataatttctgcctgaaatcctttggtttcctctcaggaggcatggagtgaatttatagggagattcttcaatccagacacaaaaaaaggttttaaaattttttgtgtgtctccatatttgactttctgtctcccattctcatttcctttactttcatgtgtgtgttttcttcttactgtgccaaacacataataaatgctcagtatttgagattaatagatataatcattattattttgtgttattctttctactcctcccttataaaaaaagggattcctcccttcatcatgcttcccatgccttcatatacttcttattggtttgcagaacaggcatagttatgatggagaaagtaaagaataatgattaaaaagaataataacaaaccacataactaactgtttgggtttaaatgacagaactctcaaatccatcttcctaattaaaacagcatgctcagggatagagcacatagtaaggcttttagcttaaatggggatgtgctatcagtgctttgatatcaagtttaatgtccttaagattagctgtatgtgccttgggagagtgagatcaagggtaagatagtctggagacagatggaagcaagattcttgggcagttgaatccttctcaaactcattcttggtgagtactgtcactttctaggtgtgccttaggcaagttatttaactgcttcgtgccccagagagtggtgggggaatcaagggtaggacacatgtgagtcactcagaacagtgcctagtctttagtgaatggaacttcgggtgttcattattgttgatattgcaggtgtaaagaatttgattcacacactcctatcatggattggagggaagttgaatattggttcatatcttgttttaggttctggtttacttgctgcctgaactaggaatataattcgggatttgcagctagtaagttgaaattaagaagaactcaggcctttagattaatcaagtacatatacagtattgaaattatgtctttttatcagtatctttccagaggcccagttaggggagctcctggcatgtgcccggcatgtaaggagtgtccacaagtgtttgcagacctgcactgaacactatttctcttttgatatgatgcagtttaacatactcaaaagagttgagccttatcccctttgctcctcaaaaccaaacacagccagttttggattaacttttattcagtcatgttttatgctgtagggtccaacctaaattttctaggacgcagcccaactaactgaattctttatgtcacttgaaggataacgtcactacagttaattttgataataacatggtttgaaggattcctaactgcttgcaatttatgtaatattctcagtgctctgtgaatttgtagtctgatgaaaacactgaaaagggaggtaatgtttactatttctgattattattctgtatccctcatgcagacctaacctcaagcatttgcagccacccaatgactttttttgaaggaatttttactagtgggttcatctggggcagatgaaaatgtttgcattttagacactccaaatacagatataaaaactttatgtctcctcctccagctctaccttcaactttcttttcactttctttcctactaagagcacatatttccaggctcattcttcatccctaaactctgtccctctccttactcctttgttccgtcttttgtcctctccctggaatttctggtcatttgcattaactacacttataagtcaaactttctttgttcctttgtgggtgtactcagaacatcattacattcaagtaaattcatgtgttttttttctttttttgcccttttatttaaaagcactcctactggccattagaatagttaccagaaatctcctttggtctatggataagaaattctgcagaacttttcaaccaagtaattagatcatattatgtctaaactggtgcctttttctcaactgaatccaagtaggagtatagactgttaacaccttcaactgagtaaactgcaatctttgcaaagtgaattaatatatgaatgcttgctaaggcaagataacacatttttcaattaacaaagtaacaggagctcagggtagcatgtgatatatatatatattctgctacatacatatgcaggtatatttttcaatcaacaaaacaggagctcagggtagcagactacagatatacatgtgtgtatatgtgtatatatatatgtagcatactacatatgtatacatgtgcacatgtacatatttatctgtgtatatgtatacattatgtatatacatatataggtatatgtatacatatatgcatatgtaggtatatgtatacatatacatatataggaatcctatatatgtagtctgctacacatatatattcacatatatatacatgtatatatgtagtctgttgtcctgagctcctgttgtttgtcaattgaaaaatgtgttaccctgtcttagcaagtgtgtgtgtgtgtgtgtgtctatatatatatatatatatatatatatcctcaaaattttacctagagtaaaaaaatgaaatgcctacattacataaagacccatatgacaatattaattctgtgagctgagacatattcatgccaattctccataccttctcccccattgcccattctccagccctttgttgttcactggtcctaactctgctttcttactacaatggcccacttactgcatccttagtttttgacattttgaaatcacaaggttctcatattaagcatggacattttctttacttttttattaattacaaccacagaacttctctcgtcccactccttcttgttttgtctttgggtaaaaggaataaattatatatttatcataaattttaactctacaaaatggccatatttatactttcttcagatttctctcagttctagttaaggtttttttttggcttccatttgccccttatttgattattatactccaagtggctgaagaaaaaatacattcaatataatctgtctgtaattttcatgtcttcctcattaccgtaaaatataatgcttatttgagacacacacacacgcacacacacacgtgcatactcttggcctagatcaaccacacagattcatttattttaccttctcattaattagaccctcaagcctcttaatgttgttttaacactaatttgttgagttctttctggcaccaaactaccccaaactccatgaagaactgaatcatcaatgtattatttataggggcttctttcgtgtgttcgtttaaaatgtagttatctaattaatttattaatttatattgtcaataactattcccagaaggttttttttttttcagatctactagagaacttaaagctttttcttttccaggaatggccaaaatatccagaaggacaatatcaagtaataattaaagttataagctcttggtttgaattcttgctccactagttatgtgaccttgagcaaattacttaacttctctgtgccttacttttgccatttgtgaagtggaaactaaatagcctttatgtcccagtaacaatgcaaagtttattcattgccgattagaaggggcacactgttcaagatgctcattaattcattcactcattttatgtaatgactcatttatcaatcctttgttgagtctcaaccactgtcctaggtaatgctgatacaatcttatgttttgaagctcgccacaaaatttgatcaccactagagccaagatttaacacattatttcatttaatagctattttgagtcttcagggtacaatttacagttttgggggggaagatgtagggaaatatgactcgtcagactcaattaagtgcatttactcagggctacccatctattaagtggcatggttctctaaccccatagttcattctctttttctgtgcaccactagtaggttttgcataaggtaattttgtccaagtggttactgtgtgggtcctgttcacaatcttgatcatgattgtattccaacttctatgtcagagtttgcaagcatgtggcttataaactcaagatggctggtacaatgttgttcaatatttaatggaggggtattaccaagatctagttttctaggttttcttgagaaattagaaaatctggcaacactaagtttgtaataataccagggacaactagccaaactgccctattttgttgaatcatgtgctgtctaagtcctcacagtccttgccacccccaaccctgcaatcatcctacatgtagtgtttctatttatcattgtatttttgcttttatatctcttacatcttgtcacattgtatagcctgtctagcatttgaatttttgactcctgttttaagctagagatatgcttgtcactgaacacgacttgaataaggaaatgagtaataattatgactctacatgccctttatagtacacaaagaactttttaaacaaccatgttatactgctactttgattttacagtagtttgctccaaatgagtcaaatggtatgtagtagagtcataattagaatccagaacaattggtgtaagtctagtgcttttctcatttatctgtcattcattcatttattgacatatttattcaacaagtaaacaattataagtaaatgtcaaatatattctagaccgtatagtggatgctagagatatagatgtgactaagatacagtcccaggctttaagaagctcatagtctatttaggaatgacagataaacggatttttctgagtgcattgtgatgtgaactgagaaatacacagggtatgtacaaggtgccatgttaacatcaaatggcatgtgattgattttatctgtgactcagacatacctctgccactgtagggagtagtataattgacatgggatcctggccagtctccttatggtgatggtggttaatctacatgtccctgagtatcatggtctttacagaagcaggagagtgaaatgtaaaaagtgctggaatggaaatcagggcaccaagtatatatggtcctggctctgacatttgcttgctccttgacgttagaaaaatcgttgaatttatgtgtgcctaaatatcttcaccaaaaaataaggaggcataagaggggagataccagatcttacaaaataagtaggttttatttacaaatacttatggattagtgggggccctttcactaggctacaaagaatttgaggctctatctatgcttagttttaaagaatgctatggtcaaagaagctatgtttgtcataggcactagaggaagggatagaaagattctgagatctaggggcaaaagggattttgagagtgcaagtgaattaaaaagctaggatcagctggctcagtggctcacgcctgtaatcccagcactttgggaggctgaggtgggtggatcatttgagttcaggagtttgagaccagcctggccaacatgatgaaaccccatctactaaaaaaaaaatacaaaaaagtagccaggggtggtgacctgtaatcccaatcccagctactagggaggctaaggcaatagaatcgcttgaacccaggtggcggaggttgtaatgagccgagatcacaccactgcactccagcctgggtgacagagcaagactctgtctcaaaaaaaaaaaaaaaaaaaaaaaaaggctgagatcaagtttctgctgcaaggacattttcattagttaaaataagaaggggctaataccaataaaatgcatagcaagttgactattcaaaccaaaaggcctccagttgaagttgtgttttaatttaagcactagtagggcccagcaaatcaaatattgaaagatgctaaaattagtctgattactttgtgagtcatcaaattgatttgactgtccttgcccttcatataatgtcccaatagacacttaacctgactctacttccttgaatttggcaaagtaagcacgatcattggagttactgcttttgggattatttatttatcacatcacctctgccatcattacttcccactcgtctttgtttggcttactttctactgtgcttctctctatcaaatctttgcacctccttaggaagatctggaagtcacctctctgtaaatctgagaagttattttcattgttgttggatgataatgcttaagccagtgttggaggctgcacaagtaaattacatggttttagaagcacctcctccttccatctgtgctgtttggttgtattctttattggatctgggatgatatgacttctttgcctggggctgttgctgccattacgcagttttggattcactgttgcttcataccaatgttggtgctgtaaatgtacatgataagagttccacagtgagatggactacaagacttctggacccagagccccctaaaactagatccaagaccagattatgcactgctactgaggttggcctgctatggtacagactgctcctccttccccaaggatacaggcacttttacatagagggtacaacagatcttgacctgcaggtgttcaaaaatcgactcataacttccctcctcttatatctatcttatcagtaaacaaatattaataagtcataggaatgaaacatgcgactctttttggttttgttggagtgatcatgccagaactgggactttctaatcttgaattcaaatcatgagagttaagcctgtcatgaactgtgagtgcaagctgacccaggaaccatgtggttctcaaaaaaaaaaaaaaaaaaaaaagcttatggctctttttgtgccacaatggcagaattgagtcattgctacaggcagtgcatggcctgcaaaacctgtgatattattctctgctctgatattaacatagctggaatgtgccccaaatgtatttcaatcaagagctttcatgtattttttgaaataacctggataagaaaatccagattttagactcaccattctgcgggggagtgggggcggcagggggtcattgatcctgtttgttttctctcttgcatgctgtccttggagatcagaggattgatgtttgagtaagaaatgcagaataggaccatatgttaggcagggttatagacagtaaagcaggtcagcatcctataacttgatgactcaatcatcctaacattatgccatctgggcgctgatactgttcagctctcccttttcttatgaaaagtttgactcaggtcaaatagggtgtctttttttgtttccttagaattttgttttctcttccttttagggattagttcttttagtcccacctttgagataaattttataatttcaaattttgaattctgatctaaaccctcaactgttctttctcccacagtaaagaagttaaagcaatcgtagcaaaaaatgtagagagtatttctttccccatccccaactttactgagatataattgacgaataatatcatatgtattcagggagtacaacataatgtttgatgtatatatacattgtaaaatgattaccacaatcaagctaattaacatatccatcacctcacatagctaccgtgtgtgtgtgtttgtgtgtgttaagaatatttcaggttcactcttagcacattttaagtatacaatacattatcattaactgtagtctccatactctatattaggtctccagaatgtattcatcttataacctaagtttgtactatttgacccacacctccccatttcccctatttcctgacccctggtaaccacacttctactctctgtttctatacattcaacttttttagattcaatatataagtgagatcatgcagtatttgtatttctgtttctagattattttactctgcataatgtcctctaggtttatccatgtttttgcaaatatcagaatacccttctttgtcacaggatgaataatatttctatatatatgtgtgtttatacatgcatacatatctctctcacacattttctttgtccattcatctgcacggacactcaggttgatataatgtcttggcttttgtgaataatgctgcaatgaatgtaagagtgcagatatctattcaaggtactgatttcacattttttggatacataattggtcctccatatccatggattttacatttatgaattcaaccaactgtggatcaaaaatatttgaaaaaaatgtgtctgtactaaacatgtacagtttttttcttgtcattattccctaaacgatacagtgtaacaactatttacttagcatttacattgtattaggaacttaagtatcttaaagatgatttaaagtatatggaaagatatgcttaggttttatgcaaatctgatgtcatttcatgggagggtcttgaacatctgaagatttttgtgtctgtgggaggtcctgaaaccaacccctgtggatactgaaggataactgttactcaaaagagggattgctggatcatataaagttattttcttaatgcattcatgtatgcactagtgtgtgtatgcctctatacacccatgcctgtcactctatgacctgttgtcatatctgtacattcatgtaacaatcgccatgtttaagaaatgtagcattgagcctatgtcttaactgatgtatcctgtttcaatctatcttgaagtggccaatcaccctatccccaaagatactgctactcaaagcatggtccctgaaccatctaggaacttattacaaatgcagaaccagagaactcatgcctgatatactgaattggaatctgcatttaacagatttcttggtgactcatatacatgttaaaggttgtgaacactgttctaagaaatgtcttcacttcttattcctttggcttgcagtgattaattgggtagaggaggcagcatatcagaatcattatgaagcttaaaataaagtgtgcctgggttttagacccaagattaaatctgaagcgaaaccaaatgtctgtattttttaatgattccaaaggcaatcctgatgtacccaacacagggcaagggtatatattgcaaggagtcacagaatctttttattcttttcttttaaacctcctggcaaccttctcttttgctgcctggtcaacaaagattatctaatgtggttgatcagcttttcactgtcccgttcattcttatgacaatttgccctaactatgcacaaactgagaactctttttaagggtaaataaatgttctcattcatcctcacaattgatttaaaatattgtaacattttctaaatatgtacaaacagaaagctatctcatagttcttgtatgaccagaaagttattgaaattttacaaatcaaatgcaaacaataccatgtaaatgaagaacattaacgtggcagatgacattttcctgagaataaagctctacttgcaacataaatacaacacaattgctatattttaggttctttagaatttggcacattttactgctgtatgccttgtgatttctcagttctgttattatttgtctctgtttgaacccatgcaaaaccttcatccacacagcttagactgtcattcagccctctctttctgcaaataaatctaatatatgtctatagtcagcccacttttcttctatgcagatttcattaatgaaagtagtaattcttgtcagtgtgattgcaagcacaaactcaaagataacattacatggcagtccttggttggcaattgaatggtcagtattcagttgaaaggtcatcaaccagaaatatggttagccattttttagaagaaaacaaattagaaaaaagtatggataacaactttggacaccaaagaatatttctataatatttcctgctcagtctgtagtggaaggcagtagagaatagaacttacaaacatagccttggagtgagaaagatctggaaactatttatgatagttctacttactagatgcatctcttggaacaagattcttcgcttctctgtaacttggtttcctcgtgtgtatgatggagatgattattatctatttcataggccaggaataggtatgatatgcaagaagcacctgtggccctatcttagcacatcataaggactaagttatcaggagctattttaactattataatgatgttatcattgttgcatctttattataaatgtgaacattaagtttttattaattaaacctgccacatatttcttccatttgcttcattgtactcttaagatgtttattcatttttctcacttcttgctttaagaacctggttattacagaggtgaaaaatcccatcaaaatgctagagaatttggcacaattattgcttatatttctcctattgctgcttttactgctgtagctgcctcctgaactgctgctgctgctaccatggcttctagatgcttctttgacaatttatttattttccagtggaacccatctgtgaagaagcccttcatagcagtaatatcctggggctgggcactactacaataatgatgctttcgttaatcaccccatgtaattttagtttttgctgataaatactacaataaatcgattgaaactgatgaaaatagctcaaaatttagagacatacagtatttcattttaccatcagcgtatttctatgtttatgcaatagggattgaaaaagttcaatccccatgctcaaaaacacatacttccagctctctgagatgatatgccagacagggcttttgattagaagccttatttttttgcctagttctagcttctgtatgagtggagactttattaacaaaggtaggtttggagcactcaacagaagcgtagagaatatatggaaaaaaaaaaagaagaagaaaaaagataaaagggaaccaaacaaaacaggtttacaactgttttactaataagagggaaaagtctgctcatgagttaaaccaagactaaagataaagaaagaaagaacatccaaaaccttcatgtgctttgtatttgtacatttctgacatatgcatgaagcatgagggaaatacagtaatacactgaggtatgctgccaacatcctgactattcctagtcattagatagcctagtgatgtttttcagttagaggggtgctgaccttactgttttcagtaattataagtctataattaccttttatattctttaagtgtatttttgtaatttcaggttaggtatacaagagtggaaaccgtgtttgatctgacgttttggctcttgtatgaggcagctttaaatagctgtcagatttggtttcattttagtgaagggttaagtaattttaaggcgttaaaaccatgggcaataaataaccatccacagtcatcgaaggaagttgcttcttagacaagagaatgaagctagagctgctagggacattagtctgataaaaagtcacatcagagaaggtttacctccaaatgattttggtggcaaagaagcctgtgcatcaacacctgcccttgagcacagcagtcaataaaaataaggtaacacaaagcagctctcttgaaaacaaaatcagagcctatactcttaagaagttcatagccgtcacaaaaggaccctcgtggcagtagaagctaaatggccaagaatgctggaaatggggctgcaagtcataaatggagaaagtctaaactaagagggtaaacagcaggtgacagtaaattggagcacttggccaggcaagccctgcatctgccacagtgagatcagttactggagagtcatcccaggcctatttcacactgccgtctgggaatgtgggactctaggttcttaagtgttaactatgggcaaaaaagaaacaagaagtataaagtcattgagaagattgtctgcagtagggcaggcatggatgaaaatcgaactctactttgtctgtgggtgaattatttaccttctatctgtcctgggtctgtaaaacagttataagaatagacagggttaatttgtgaaacttagatgaatatgaagtatgagtaaagtaccagacatttagaaatgctcatcaacatcttgaaagaagttctttcattgagataaaaagggtctttgtatctctttctgtaattcttctgaaaacagatggtcagggtagagagctggtgcaatagctcaaatggtaaatgacagacataagattcaaaagaagctcaataggaagaatgatcctaagacaaaatggatgaattgcaatagggttacataaaccatttccttaggtttagaaaagtcgttattccatttctaggtaggagagattccactgaaataatgtttctgtgctaaaaatgcaaaagccaatttataacttttaaaattataaattgaataagtgcaaagagtgtgatatggctgctagatattggtagaaaaccatccttctcatttgtgcccttattagatgtcatcaagagtcttgtgtgcctcctgctgccacatttaaagaggggagagagagagagaaagggaggggagagaaggatgaaagagagagagaaagacagaaagtgaggcatgtccagtatggtgaaatcagctgtaatcaattccagctcaaccactatgagtccttggacaagttacctcattgacaaaatgaggatggaagctccctccctggcttgacctaaggattggattacataatgcaagtaaacaactctgcacagtacctggctcataactgggagctctgattattcacaggaaagagtggtgagagacagctatgagataaggagctgcagaagctctcggtgatctgccaatataagagaagcttaaggcaggacatgacaactgtcatcaattatttagatacctgttatgtagagaagcaattctcattaatcagcctaactctaaaggaaagaaccaggaccagtagatagaagttatgggaagagatattttggctccataacagaagtaatgaaagcagtagtggtgtagtagtaggaactgagaatgcaaatagctcttggagtgttccagttcctgttctaaggactctgcattcttatttgatcctcagaacatctatgtgaggtaggtataattattattattttcattttacagatgaagaaactgaggtacacagtgaagtaaatttccaagaacatgtaaaatagaaatgaatgacagagctggaatttgagcccaggcattctgtctcttaacccatttatgctggaggttgtgattttttaaactgatgtatgacagaaaaatcagaccttggcaaatatcttgagcagtaggctataaataactcccacatgcttagtgttccaataatggaacactaggcataagtggctacacacattatctcaactgccccaaaaagtagctcaaatacacagggaaaggctgagtgactgtacaccatggttgctagtaaggggattcctgcactgagttaggaattggcctggataatctctacggtccctcccatgacatgtctgtcattttataaaaccaaaaagcaagcaaaaaacacatggtggcaaaagctaatacaaaacctagagtcaaacattcatgaggttttctcaatgcaaaagaagcctaaaatattcacctgtaatctatttatatcaaccttatactcagttataaaaggatggccatcttattgtcttgttcaaggcagagcagaagaaatacatttgaatctgggagtggtagtagaactaatagcagcaaggagagactcatgaatctttaggagaaaaaggaggtgttaacgcactgaacaaatattaactgagtgcctcttctgggctgagataagaaaatcattgtgaaaccaaataagaacaagcattgcaggccccagatatttagagactccagtgacgtttgggcttttcctgaactttagtgtgcaatgtcattttaaaaagtattttaggggaaatgataaattatagccagtttcataaaagaggtatacattatatttttaaaagactttatatgaactgaatcatttgactttaagtttgggtgtaaaaagggtatacttcaatttctctcaggccagcttgctccccagtaaatgacaaatatgggtctcgccgcactaagatattttaatatacttcagtgggaaaggctctgatccagaaatttgcagttgtgctattgataaaatttatgagaaactttcttctgtgggcctcagttttcacatctattaaatgtgctgatttaactaaactatctttatttcctttaggctcagacatttcctatttcttttatttctataactgtacttattttcattatgtagataccagatggcaaaatgtcctggtagtgtgtgcaggactcaaactgattctgggaaaatggggcacaagtgaattctaaggtataaggagctgaagtgagcagaagcctctagaatctatttctatttctgtcagctacagaatgtaggcccagtttaatattaggagacgttgtctagcttttaatattaggtttcagagttgcctaacaaaacccatagaggttgtttcttgcttagagtaatttaatgttataaggatcaggcaggtgcaacatggcataaaagtattacttgccccaatgccacctttaatttctctcaatctttcaaagcatcaaaagaaaaaaaagttctctctttgtctattgtttataaatataatttattctctgtgcttaggtgattttcatagataagaggacattcattgtattcagtaaaacttctagagcagtccttacactagtaacaagtttcctgggcaatactgctttgttatcagacttcaccatgtagatctcacatccttctcttttctgatcttgctcttatcatttcaaagttacatgtagagtgaggatgcaggtttcatagggtttttgtttttatctgagacagagtcttgctttgtcacccaggctggaatgcagtagtgtgagcatggctcactgtagcctcgacattctgggctcaagtgatctcctgcctcagcctcccaagtagctgggaccacagatacatgccaccacccccagcaattttttttttgtcttttttgtagagatggaggtctcaccatgttgcctaggctgggcttgaactcctgggctcaagcattcctccctcctcagcctcccaaagtgtaggattacaggcatgagccaccaggcccagcccatggtgttttctgacaaagctactccattcatttgctgtttgaagttgattagtgaaccacattttgatgttcactaccttcatttgcttttatattcaactgcattctttaagaatcttccctcagcagttagaaggccaaagataatttaaatgggattgagggatatttccctctcacattagtgctgtagagccacataagaaggtattctatggtagaaatagatttagaaaggtcaaatttgaaaaataaagtaagtccagacccgagtgataagatggatggctgtctagattgagcatgcaattctaatacttcagttccacattcttttttttttttttttttttgagacggaatcttgctctgtcacccaggctggaatgcagtggcacaatctcggctcactgcaacctccgcctcccaggttcaagcaattctcctgcctcagcctcccgagtagctgggactacaggcgccctccaccatgcccggctaatttttgtatttttagtagagacggggtttcaccatattggccaggctggtctcgaactcctgatcttgtgatccacccgccttggcctctcaaagtgctgggattacaggcatgggtcaccgcgcccggcctagtcacacattcttaaagatgtttcagcttttgatttttaaacagaatggtatggagaagggcttttgctggaggtgcttcagtcagttagcttcaactctgaatgaacaccgaagatgtcttggctttcctaaagactcaggctacagattcttgctcatggccaggggtaaaatgcccttcatccaatttaatgctctcccatgtgtagcaaacatatcaactactctgggttggcatatgggggttttagtaaaactgtgtaaagaatttgccatagaaataggaatagtctttcactttccattttgtactctgggtcttctctgattatatatctcttttggttttcctttccaagctccatctttatcccaacctattgggtatacatctgatcactgctttgctaacacgataatacttgagactaattaacaataccttagtgatactgcattctcaaataggaaaatttcaaatgactagaagaagactagttgatgcctaggaccagtactagaatggttaagttactggttggaaacttcagtgtgcttgtttctgcaggaggagaactgctttaatgtgaattgcattagaaagctcccctccacttttccttccccagtgtttgtctactgaatagcagggtgaaagcgtcggttgctctcatcgcctcacaatcaggccaattgggcataactgctttctggtagaattcatctcataataaattgcattcatggaagatgcctagtatgtggtaaacatggcatggacaggccaatactagagaaagatagaacactggctcagaggagacacaaacaaattgcctttctgctggctctgaaatattctttttcagtgtagttaaatataaagttgaaatgatgctaactacaccttgatccaaacaacctcttcattgcttggcttctgatgggaatgctgtaggtagccatttgttttaatgattgatttcactaatactgagtcacaattgcactcctcttgaagttgacataagatctccatgcacagaaaatgaattcattagaatcaaagtgattgtataagaaactcaaattatccaggtgttgaaatgcatgtctactttcttttcagacaatggaatcatttataaaacatatagttatttaaaacacagacacacatacagagactatcatatgggattgtgagagattgctaattaacacatacaaattaagacaaatattcattaaaacaaatattaattcctcaaagtttaattcttaacaaatattaattctacaaagagctaaaaggctctatgtaggtagataacggcattcagatttacctcctaatctttacagtaattggttttaagggttggagaaagaagtaaaggaggtaaaagaatgtacatagacaataataattatgaataacatttactaagcatctactatgtgttaggtactttgctaaccaagcttagcatttcacatatattatttaaaattcacattaactacctgaattacattcaattattttactcttcagggagatttgtataagttgtgtaaggtctaaaactgttaacaggaaagctgggagttgaactcaagtttctctagttcctgagccaagatcttagttgctaagttattaccacattctcagagcctctgaagcaataccactgaattcagggcttatgtttattctagcagcatctttctttacaaaggggtatgtaaaaatagtagtccttctaatttctcctccctccccccaatatttctgggattatgcaggcgatactttgcttttggaaagaatgaaatataggcaattgacagaggcagggtcctgactttcttttttaattttttttccttgatgatgagcataatcatgtgaataattaagcttcaagagctaaatgactgattggcagcaagctgactaactgttctttatttataaggatatagctttcatgggaaaatgtagggtggttggtaaaacatcagaagtctcccttgagatttcataaatgccatagcttaggggttaaactcacagacatttaagtcacatgttcttgagttcaagtccaagttgctggccctttgggacttttaactcccctatgatcgattgctataaattaaaactcagttaatagaatataatgtaagtagttatatatcggaaccaatgatagtacctacttcttagggttgtcaagagcatccagagagctaagttatacaaaggactagctcgatcactggcatgggataaatatttgataaatgtggtttgtaatattttataaaagtgacaaaaattcttatttatgtaccttttttactatgaggagaatcaggttggattcttagaaaaccttcagtgcctctgtcacagccttgcaaagactacttgggatatgtttatgttgataatttctccccttttatttttctatcagtcagatttataataagaatcagctgttctttctaaaagactattgtgcctttatattattttctttaattttcaataatcctatgaattagcaattattatcctcatttttacaaatgaggaaactagagatccgaaaagtaaacagcctcccagctaataaacagatgagctgcaataccaaccgaggtcttctgtctctcacaatccagttctaatattaaaacaaaaggctttgagaccatatgacccaaggtgcaatctgtttttcagatcagaagattgggactctaagatagaaacacggtctgtccagagtcacatagcaagttggagacagaatggacactagaccctaggcctctatttctggtctagagctctttcatcatttccaggctacttgtttgtttgcagcaatttgtatgttctgtagaggaagattgaaaagagaaatggatagaaagagagagcagagatgaggggatgagagtctggagagaaggggagagagagagagagagagagaaatagattcatatatgaaggttagatcaagggccagcatccaagggtggtctaggtagagtactgggaaccaatctcaacctggcaggagaggcataattaaccagtgtctacatctgtgatattatttgtccttgctccaaaatgacaatagtgattacagtagatgcagctgacagtagcagatgacacaacctcctttcacctcctggccagctgcagcgctaccatcaccagctatagcagctttctccctggagattcagctttttctccactgatggaaggctttccctccatcactccaatgtcagagcttggccgatttggttcctcaggagactgtagagaaattcactcccattgaagcattttcttgacattttgacattcaatcagagaaaggcaaaaggcaggctaagggcccaatcatcaggtccatgaagatcaagctatgttttctgagtacctattgatagaatgtgcaggagattattactgtttgccaaagctctattgatcttggctttgtgaagctcaaagtctgtttacagccacctataaaaaccaacagccacttcttttactgaaggttaacgtgctgtgtttatttaattgaatggaaatggccttgtgttttccaaatgtcattgttaataaattttcaagggaatctgtgactagtgtgtaggtgttgaggatgggagaagggactgtcatggggagggacggctgttggaatttgaagttgctggaagcaagagataaaagacaaacacatagatacgacattggaataatttccctgtatagaagtgctataaaatatccttactctatattagtgttgttttttaaacttgtcagtaagaattctcccctgggtgttttattctttagcctgcgtctgtttttgtttgttcttttgggtttccaaaaaatatatattttaaagtgacattgagcattttagtataattgtgagttttggggttgaatatttttcactattatttgatcagttttttccttctgtaagagatttaacagaaatggctaaaattaggagccatattagatagaggaagatattggcaatcctattgacctgctttttaagaggcgtgtttcaactaacaggaggagagatgcaaagagctttcaccaaagcaatcagaagacctgtaaacagcctcagggaactgtaaaagtctgtgagggtctctagtgtaccagatgaaaagcagaaactttaggtagccgtctgaatgtgtcaaatgggaatatcagaataactcactaaatttcctttttcaactttcctcgcaaggtttgtctttttatgtggtaaatgttggtgagttccatttttaagttttactcttcccattctacttcagtctccttagcaaacacacacacaaacacacacacacacaaacacacacaacacacacaaaattgttcttcttgaaagatacatgtaaatgaatggtgagtaaaaaattaaagtctggacgcagtggctcacgcctgtaatcccagcactttgggaggccaaggtgggtgactcacttcaggtcgggtcactcacttgagaccaggagttcgagaccagcctggccaacatggtgaaaccccatctctactaaaaatacaaaaattggtcgggagtggtggcatgtgcctgtaatcccggctactcaggaggctgaggcaggagaattgcttgaaccctggagttggaggttgaagagagctgagatcgcaccactgcactccagcctggcgacagagcgagactccatctcaaaaaaaaaaaaaaaaattaaaaacttattgtctcaaagcagccattcatttattcaaggaattgctaaacttttctaagggaccaggcactggcctgagtgctacatcgagagagagtaataagatcgaggatcccattcccacgttctgcacgtgtgtgtgtgcgtgtgtgtgtgtgtttcgatctgtgtgtgttggtgggtgaatggctatgcaaatacataacaatttaataagtcttatgatactgggagtacctgactctgattagggggcactgctttaatatctggcaatggaggatatatccatcttcattcgctccttcatgcccccatctaaccttgattaaagtctgatttcaaatagcccatttgttgaacattttatcaaggtttttcaggagcctgacagaaaatgtaaagtcgtcgtatgttttgttttgggaaatactacttctaaaacttatttgagtgtctcagctttttctttcttttattttattttttaattaaaaaaataatattatcttttatttgtctttaagagacagaaccatgtctgcctagtaccttcacttggtcaaatacctcttttggtggaaacaacacaaattatgtaggttgtatatacaggatgaactcggtttaaagataagacatgaaattcagtggaaatattctttaaattctaaacagagaaatcaaaacaaaggtatattcatactgcatgtgggtataagttttttcttacatatattatatatacatatataagtgtaacacttttaagaattttattgaccatctaaatatatagcaaaatcagctgggggtacaagagtgtaactacttccttttttcctaagttgtggaaaatgtgagaaatgagaagtaagcaagacggaggattagaatcacaaggtaggtttccctagtatgaattcagtacctgaaaatcttcttagttctgagtttgaagcagattctataaaatcctgtattaaaataaatacagtaggaattagcaaggatgggggaataggagtgggcagatatgttcttgaagagaataaatgcagaacattattctttgtcaattaatttttactttttatagattgttagactatttaacaaattcttatgagaaaagtgtgtttttaagtgatctctgggaagatgttcctgataataaattaaattaggactgtgcattgcggagcccccaccagttgtactccctctggtgaatttaataccagacgcaacctagttagaggtgacatgaaatcacagaatttgataatcttttttttcaaagttaagcaaatatagatgagctcttcttgtatatgtaagatgccagatggtgtttttgagaaatcgattcgtgtatagtaccagtccagacaaatgggtccaatccttctatagataaggcgacccacttttcctattcaaccatagggctccgttgtctggcacacattatttaacaaagtgacattgtggagtcatcagtaagaatgtggcttctggagtgaatttctttttgagtttgaatcctttgctgggtgatcctggccaaatttcttaacctgtttgaacattagtttcctcgtctctaaaatgtgagtaacaagagtttctcgtaggaactatgtaaaggtaaaaagaaactgtctagcatagtgcctggcacataatataatttcataaagtgtaactcttgttattaaactggatagctcaatagatattgctccagaaacactagtgcatgaggctgccattacgatcgccaaatgatagcagctgtgaactgccactccaagccctttgcagatgcatgtacttcttcgcaagggcttctagtcattgacttacccagatctatcgtcacctcttgaagaaacaaccagaaaacactttccctacttacagtgaaataagtgagtatccttctacagaaggacagttagttcttgaaccaagggacttcaatgccatatgagaaaaattgtcttgtatacaatatctttggagagtgaaagagttttaagcatcttgatattagaaattaaggctacaatgcattcaggttgcctataagttattcatttctgtatcttgttgtcaggaaaaaaaaaaagaatacttcaaaattaagttttttccatctaggatctcagatctcattgtataattttcatcattcaactggatttaataggtctatcagtatgtacagtaaattattttcaaaattcttcacctaatagctaaaaagtaagccctaatctggttttctgtgaaattgtcctcgacagaataaatagttcaggtgtctgaaaagaaaaattccatattcctatatctgggttgacacttaagactgcgtttgtgaagcctccttatatcttgaagacaggatgtatctatcttgctggtgagaattttgctgttctggagtctatatcaggtacctcaaacgtgatgagtgatagaggtcatgttttgttgtatcacagtttgttgaatctccctccttagagattcatttgactgaaaaattaacaggtttatttgtgcaaatggtagttgcacacccaattattgcttctgggtttcccatgtgactagccaagactcaaggtgaaagtttggcctgcagctttggcaaacaaaggagaagctaatgaatcataaaggtcacatcttcttgaattttcttctctttcttcactgttctgattacttttaaaaaatctctattccttatatattctgagtacaaaaactcattagcaagatttggttctgttgtctggagaattttctgctcactgcaataggaaggtgatccaggtaccacataactgtctccatgaagatgtttgcaatatgttatgagttttttaaagttattgtttgagaaaaggccatataaggagataatttttgcttattactaattagcttacccctcttctgctgttcttacatttatgactatttacttgtaaataaaagttattgatctttttagaagtccattggattctgctgcttttatttttgagaatcattttaacttacaaacacatattaccttttccaaaaagtgaccacatagctttgtgactcctccctcatatattttgagcacacagaaattaccatcctctcactgagtactatacatcggggcctctggctcttacctcctttctcagatccaggactgaatgcatagctgaaaagatgactttagtctttattcacaacctgtaaactaaagaaggtcattaaaaaaaattcttcgtatcttgcaaacaaaagaactgagatacctatctaagaatggcaagtctgagaagcaaatacctggctctagccctctgccataagtttgcaagcttgtgtagacctttgtctgagaattggttaggtatagaaatacacttcagcagagacttgacctatatgactttcaaatttgttatgattctacaattagtgtttgctaaaatcaaaactgtagaatatagtatagagagtatattaattgttggctctatgctgacccaaaatgaagtcttttaagagattagagtactacactgtctacatttaaccaggtgtcatataacaattaatgaaaattcaatgttttatacttagaatttttaagtaataacagatgatggatcaagattaaaactgtattgacagcctaagcaaagaaataaaatctaacaaaagaagctttaaaagaaatgaatgtaaaatcctatattttgattaaataaatcaagtttgcaagtaccaggtataggagttttggactgacagaactttacactaaacaagatgtaaaagttttagttgtacataaatttaaaatgaacctgccttactgtttcttttaaaaaaattaagaaaaaaaaactctacgcagtattaagttctattaatagacttctaatttattactaaattatgttgactcttcatctgaaatgtatctatctttttactccattaatttctcttcagtgatctagtcacagaccttattatcctttacatgacagtagcttaataatggtatccttgcttttctccctactacagtctgtcctctgcatgtagccaatgttatacttgatgacttaaatctgatcatatcattcccaagtaaataagccaacaatggtcctcaataattaccgaattaattattccctgagaaatggggcccctcagtgtaatatctcatctcaatcattttttttagttttgcagatagcacctgccatttctaaatatgtgtctttaattcatcttaaccacttcggattatgacatcctaaaattgccatatatttttatatttccatacttttgctcaggatcttctttggttaaaataatctttcctacttcacctttgaccaaccactgccagtgatccatgagattcaaatgtcttctcatttggaaggactgcctgataacctgctacctcagcttcaggagaaaccagttgctggcctctgtgctgttctcctacctctaaacagaatgtaaagtactattattttctcttcaattgacaaggcgcttctatgattgttcccatcttctgttggtattatttttaataaaaagatctcatatattgtgttaaagtactaaccttgagaagacccccagtctgaaagaagaatatttcacttctcccttccccattttcaatcacacatattattgaataattttggttaacatccttaatattctaaagtatcttgaaacagttattttttctattttcagaaataaggttttagtgataatactgaaaattctaaactgtgagcttttgtttcagggatagaaatttaaaaaatcatgaggtcttctgtcatgattttgaatgtttaatctactttgtccagtgggcttctgaatcttttgtgattggcacgtgttactgagatgcagacacatgcaattctggtgaccgagttctcaagctacagtttattatttcacactgcagtaaatgtatggactgagggtgaggggactgtcagaagatgtgtgtcttgggtgcctgaataatgcttcttttgctattcactttcatcttaatttagagtcatatatttcttgttaccttttggttttccccggcacctaacaatgtaatcttcacaaagcagtgctacattctaaatttatagtgcagtaaatgaaagaggttggatccattgtgcttcataattcagagggaagaatgtctgcagaaagaaacgtgggtattctttggaatgccatatgtgcaataattgaaacattttgaggaatttccaatttacctcttaggaggaattcaggtttttgttctttttgaaaagaagatgattgttacagacttgggaaatcctaaaagaaaaaagaaggactgttgggacatcctggttgttcttgacccccgcaagaacagctacagttctttcagatcacagcacttgaagtcagaagcctaagtgggtgtccagagaattcaatgccgaaaggttttgcccctcttaactctcctgaccactagcattctctctaccttagtgtgtgggtaggtctttgttatgtctccagactcacactagttttttaaaaaaaatacttaggtaaatagcagtgggaccccaattctctttttcttgtattccagatgaaaaagaaaaaaactcaccagtttaaagtgctcgtttcatatgttcacgatatctaatagatgttaaattttggtaccaggaagtgagagagtgatatgaaggaactagtgaaataagattttaatacctggcaacatttcatagatgataacactggtccacttgaacacttgccattttttattcattatatctggtctagatgggtctagctaaaactttattccgtgcaacacagctcttgcctatttagaagcctttaactgtgtgtttaattatcacctggagtggttcttttgcagagaaaacatagaacgtaggatccagtctttcacaatgcaaaagttgaacctctgtcacctggcatgcttgaggaaatttcagaagctttgtcctcaccttagacccactgaataaggtcactaaggaatggcacccaggaatctacattttacaacctctccatttaatacatatgcttgctagaggttaagcaacactgtgggctcacctgtagcacgtagcactaatcagacaagactcaatatctggccagacttttagatgataatcacaagaagcaataacatttttctgaaacaaaacaagtggcaaatgatactgtgaaatctctggcactggttacccaatatccacacataccccacttagctctagattagaaaataaagaatgagattcagcccagaggcagccatgcgcacaggtgcacaatttggaaaaaatgagaccaattcttaaaaaaaaaatcaagctgaagtcaaagaagcttaataaaaatgtaaatcctctttcaactggctccatgttttctgtctcttcatgaacacctgccacctggtgaataatgtcaaggcctctcagagtgggtcaggaaagcaaaaaggcccatggccggaaatgctattaggcattcaaaaatgaacaatccaggtaacaaaaactcatgtcagtggtgcaggtacgatggcgtattctcttcataagaaacactatgcaaatgaatcgcaaagcgtgagagagcagaacttttcactgctgccttctgtcaagttgggaacactgaggtgaagattgagtgcaggggatttggggtggggagggtcccctgtgaaacagtttctgaatgaaagtgagggaagcaggcatgggatagaaggataatttggtctgagatgcaagtgcggctaaagcctcagccagtcccacggtgagctctgaagttaggttgtcccttctgagatgacctaaattgcataaacggatctgagtctttgtacctcccgtgcccatccaaacatccagtcaccatatgaggccacacccattgactgaatccggttctggagagggactgaggtttggtgcaagttgtccgcagccaggacttccaacatctggaggatgagcaccctaatcttgaaggctgaattcagtagcacatccactgcaactgaatatctgattcaaggccaaaaattgtggagctcagagccacaacgggcttctgatcttccacaggctgctgaatgcccctggcagtccactgaagtgataatgttaaggaaggaaatgattagaagtaatttgctgagggatcagagttgcatttggagctatcagcaagtaatgaagcaagaatgtcaatcgacaggtgaatcaaagtcagggcaaaagaaagggaggaggaaatttgctcaaaaaaaaaaaaaagccattactttcattgaggcctgggatgaggtaagtagagaaagtttgcaactgccagagattgctaaataggaaaaaatcttttgtgcacgtgttgctggtgggattgggacatgaaagatgttgtgggacagaatctcactggaaaagtcaagaatcagagctggtttcaaaaaaactcaaccttcaaataaaggatcccctatctctatattgaacctggcaatgaatacctctttcttttccttattggttggcaaggatgtagaacactaagatacacacacacacacacacacacacacacacacacacatacattctttgtttgtttgttttgagacaggatctcgctctgtcacccaggctaagtgcagtggcatgatcatagctcactgcagtcccaatctcctgagctcaggctatcctcctgccacagcctcctgaggagctgggactataggcatggaccatcacacttggctgatttttaattttttgtagagatgaggtctccctgtgttgcccaggctggtctcaaactctcggactgaagggatcctcacacctcggcctcccaaagtgctaggattacaggcacgaaccaccacacttggcaaatatttaattaaatattaaatatatctaattgtttgataaaaagggagagaggctctccttgatggaagtaataggttctggaatgcagtgagttctgctcggaatgccctctgaccactgcctccatgtgtctaatataacctatgacattacccatagaggtgccgctttttcattgggggacactgctccaaaagtgcctggaaccaggttaaaccattgaggttataaggaataaagggcctttataataaagaccatttctgtgactgtgttctgaaactgataaaaagcacttctttctgtctttggtgtcttccttgatagttgtaataagaatagtagtagttattcttctttttcttttttcttgtttgatttgtaaaataaaaacacttttcctttcctctctggtgtttgaatgcacccagtctcatttcagcagtccacaatgacatactgaaagttgtaatagagctacagctttgctgtatagaggtccatggatatgttttctaattataatcattcttgagctgtttgtaactatttcagactgcttacccagctgtatgccactggcttgtttctatttcaggaatcatctcttcctcttctcctccttccccctccattcccaaatccccacattagtagcggccaagttattttcaagtacagtgtatatgtaagtgatcttgatctgctaagaaaagacatactgtttgtttttattgggcaggcagcatcctagggaaaaggagaattacaagtctaatttggttaggaagcatcctttttcgcaacagtgaggactgcaggtaccactaaaatcattgctgttcattactaattggattaagtcctctctgttccaccaaccctgcttttaaaatttcttctctgcttttcattcagaaactgcctcagcctgcactccgttatctacctccaggctttattgcaacacctcccactgcctctctcctggaccaccttgtccacgctgcacacagttgccaaattcaactttctgtgttgcaaaccttgttgtggctccccctgtgtaaaaaccttttagtgtttctcatctccatgaatcactaatccatggtgcttagtagcatgtcaaaggcccttccgaatctatctctagcctacctctgtggaccttatctcttggctctcccacctgcccccacccacacctctaccccttgctttttgcttttcttttccccaaattctgagctgcttatacgttctttcccttcatggtgttttatacctcagcgctttcatgcatatagttcccagtgtctggaatgatcttttggataaatagtgacacttcaagaaatatctttgtcccaacttcagaaacctaattttcattgtgatgaatagctcccacagttttttccccgggctattttgcaagtattgaggattcacatgttaatcctgaaatgtgcgttctaaaaaaaaaaaaaagctccatctgagaacccattaaacctctagtttaaatacccaggcattcttaaaaatcgaatttgcattgtctttgctgcagtgtcttctcaggtaaccaatgcagccatgtcagattgatacatcatgttgttaagacccccatctgtctctagggtagtagaaaagatgcagctacggaagagaacagaactgtgctcctgaacatggcatggctgccgaacctcacagataatcctgaagcaggcaatctctgcagacttctggggtgatttgagcatgtgtagcttttgctggcagctgagagaaatgggaagtcccctgagctgaaagttgggagcactacatcctcatcaacctaaatctgccacatacaatctctgtgatcctggggaagtcactggacctctttgagtcatgctgtcctcaaatgtaaaatgagttttacatttaaatgttctaaataagttcctttagaatgtttcaattaaaaatttatccatctgtatcagataatattggtgatctcattcaatttttttagttccctttttgattatttttgtacccccaggcctcagcgtggcttctcttgcaatagccagcatggcttgttcttaagaaagttgtcctcagtctactactctattgcctctggctggaaaaactcgggtaggtgcaaggtgtccaccagcattttctcctgggatcgggctgctgccagctctggcactttgcctgggactgtagccttgtctggactcccctttccctctgcgtgggagtgcttccttatcaatcatttgccctcgaatccatgtcttaggatctgcttatgggttggactcagcccaagatattctctatctaggtatcctggttgagtttgttaataaaagttcggtttggatttagacgagacaaaccaaacttggttagggtaaatagaggaggaaggtgccttgtttcctaaattgtgtttgataaagtgcttaataagggcggcttccaaagtggttccaggtaaagaagtactaaaaaggcctctttattaatgtatggattttctgtcactgatgtttgtctgcctatgaatagtttagactagatttttcaagtaagcactttataatatctgtaactctttctaggtgttttataaacaactaactgagtagagcagcaacaacaaagagctgtaagttttctgccagtaacttctagtttttacctcctcaaaagctattttaaacaaatatgtgtctaattaaatctcaagggaatgtgaaataaaaactggaatttgagttcagagtacctgaaagagcatttttggaaaagactttgtttatgccatttgtgcatatgtagatggaatcaaaatgtataagataataagagaaaggtgccattgagcctccaagtagaagcccgatgacttcacttatgcccggctgatcacccaagtgtacagttagtcatgatttgatatctgttgtagattaagcctgttgcacacagtttctaccctgatgtttggcatgggccatgcaccatacattgaaacaagattttgaagtaaatagaaccacattttccactttctttcatgcagttattttctctgcaagatgcattctggctccttttgtgaaacctcagatttgattctacaagctgctgagaaacacagcacctgcatgccacccaccaaagagagtgtttacatagtctgttgtacatagaaagcatgtgggtgtgagtatacgtatgtgtgatgaaatggttcaattgacattgtacttacaagataaactgcatgtatcaccaaattatttgacttctctactcagaaagcattaaattttgaggtttaagtagacattaaacatttataatttaatatacatttaataaaattaatatttatgaacacatttgccttgggaattaaaagtggaaaacagtgtcatttacttgctaatggccaccacggtgccatgcagttacagatttgatggcctgcatcccagtgacattgctccaagaccagagacaagaccattttttgtttgcatggagctaagtattattttcagaaaatcaaaaccaaaaggtatgttttgcttcctagctcagggtctctggagacctgacctgccaggtatcatttgctcattttatttaaagaaaataaaataaatattcaatggagaagttaaaagtctctttccaactcaactctatatctcaaagaattattttctcattctgtcaagccatgttaaaattttcaagtaaagtcgtaatcatttctacattttctttcctgtttgtcttgcatctcttaaaatggttttaatgttagaagctacttgacaatggatgtgaaaatagatttaactcagcaatcaatatattatcaataataatcattaatttatacataaacatcacatgggtagctttccaagtccatcctgttttttgtgggctcttatgctggttcagagatgatatatgccatttttataaggtgaagaagtggagcagtataaattgtaccaagcaagtattgagcactgcgaagttcactgttccttagagaaatgagctatgcatttactgctaaaaacaaacctttcataaaatatttttttgggcaccaacctagtgaaggagtaaggaaaagaagtggatggttttagcatttaccctatggaagcttatagcctggatggcaagatcaaattaacatgagaaggcagtttggtgtaatggttaagagcctttggattcagccaaggcagaaagtgatttgaattctaattgagcccctttttagctgtacaactttgtaaaagccctttaccttctatacctcagttttcttatctttaaaatagaaatgctaatatctacctaatagtgttgttactattgtttcttaaagattgacaacaaggcgtatgaacagcatgcctggaaaatactggatgctcctcataagtagttatttatttattaatatcactgacacaagtgaaataatccatctcttcctaccccagcacacttatcataacaaatttgtaatttgtatgtttacaatatcttttctgatgaattgatccccatagtatatttagagcagtggtgtctggatttgtataaatctctgtaactctagaacttcacccagtggccaatacataaaagattctaaataaatatttgttgttgtcattgtaataggggaagagtatgctccaaaacaaagatactgattttaaaaacgaccacactttcaaaaaaaaattttttttaattctagagaccagcatcgagagtaggagtactcagtacgattatttacggtaatatatttattgggtaaattaggcaccatctggtgtgctagcttagatggctctagttctttattaatagatatatgagactctggggtaataggttgctagatccatatgctattcaggagacaaatttagtatacggtaagcttgctacaggatcaagtcgcataagaaaatgaattgaagtcgaagaaatgcttaggttaacccaacaactctgataattgaccaatgtggcaagggccattctgttccaaaaataattaacaatatgatcagtactgaattaatgttgttacggattataggtttcaaattttcccttgttaggaaaatcaccttttaaataatctcatagggttttgaacaaagagcacagtgtttctttttttttaaatagaaacccatacttgagaaggtagcaaagagtagcaaagagacctggatctctgtagcaagttcttggcctggtcttcattttcaattctaaaaattttgagggaaataaacagctgtccaaacaaaatgctgaaagaatatccctggacaaacagaaaatctttttttttttttttttttttttttttttttgagacggagtctcgctctgttgtccaggctggagtgcagtggtgcgatcttggctcactgcaagctccgcctcccgggttcacgccattctcctgcctcagcctcccgagtagctggaactacaggcgcccgccaccgcacccggctaatttgtttgtatttttagtagagacggggtttcaccgtgttagccaggatggtctcgatctcctgacctcgtgatctgcccgccgcggcctcccaaagtgctgggattacaggcgtgagccaccacacccgaccgacaaacagaaaatcttagaggggcatcaaagcaaatcatatggatggagagtgtgaatatgaagaaaagcatattctttcttcacacacacacagtatgtgtgtgtgaagtaatcttcagccaaagcaaagactaaaatgacctgttcaataagatggaagcaaactttaaaaaacaaacaaacgacaaaaaaaaaaactgtcctccttctccgccaaattcaggatacatgttttatcagcccatgtgctattaatctatttgtgattattctatttcattttctctcccatgcttttctcatttcttctcctcattctaggtgagtataggaagcatcagggctggggccataaaaagcctgtggccaaggacattgcaataagacagagaattttagatacttcattaattatttttcctaccagttaaggattccttgtgtaatgacagaacaaggagaagacagcaaaataatactaatgctaataaaaatatgtaatacagagtacttatgatgatataagcattgttttgtttgcttagattattctgtctggtgttcttaacagcctgtatgctgggcaataaaaatagagtctcaggaaaacagaaccaagtttgctataatttggagagacaaaactaagctaagattctttaagtaatgttcatggggagtttgtgcatatgatttatcagaaagagctgcttctaccagggctcataataataatggttcccctgaactggatgctaaatttatcaactggttattttgggcttctcttgccagtaagcctatagaaaacaaaaacaaaaacttttgctataaccttgattattcagagaaaataaggtttctgctacacagcagggacaggacatggttggcaactgggaaagacactcagcaaatattacagataccagaaggaacctggagaaactctgattctttttcattttgttcttaaaaagcaggcgtctgaaatgtgcccaacttcagctaaagaaaaaaacactattgttgggtctagacacaaagcctgatttgctgattttatttttcttcatttagttattttattgttctgtaaatatggacttaccttttttgcttctttattttatcttttggtagaaccttgagcagggacaccctagacgttcaactgttccgtgtgatcagtgtctgccttaaaatgtctgaattcctgtactgcatttcccagtgaagtttagtgtttatggcaatcctcccgatggggagagaaatgagccggcgaggccaaaagcagcatctgtgacttgctaggatcagctggctctgtgtgcatgatttccacttcaaagggtacacagacaacttggtgatagtccatttattgcagcctggtcttgtcaattagtcaaagttatcttctatacagctacagtaagtaatgtaaaatcatttacaatataggtgttagaacagcagagacccttagagttcatgtatttgacttcctccttgcacagttgaggaaattatgaaatgcatgtctttagcttcttcattctacagtatttattgagatttttttatgaagaagaaggataaaaagatacaaacttgtatgaagttagggaactggagaagctaactcattttctcttttttttcctgtgtctttggcacctctattagatctggtccgtagtgggtctaaataagtatttattgaagaagtaatacatgctttataaatgatggccaaatagctgtttgaatggataaaaaagcttcataaagaaagtgatacttgtactacgtcttgcaggatgtgggagaattggaaaatgagagagaatagagaaattaaccaatattatagtccagccaacagcaaagattgaactaaaattctggtctggtctagaggtaaaccaataggctcactttccaaaagaaaatctgaagcatttaagattatttaataaggaagaatttcctctggtgtcctgaatgaggaatctttggggcaagaagggtcctgtcctatttattatccttaagaaattccttgctatttttagttctcaacatcagctacttctcattactaagtaaaagccagattacttaacttgcactcaccctaattcatcttatccactggcagcaaattccttccttagaatacttccccactggtttttgagaagtgaaaaggattaacatatatggcagtggagtgttttatgtaatagtctttttattaaccccattatccagctgttggggtgctgggtagagaaggaagggaggaggaggaaagtagttgttggcactgggggttcagagccgccccagctccttgagatgaagggatgaaaataaatcctctgtattactgaagcatgtgaatgccatgaagtagtgggacctgaatcaatacattgcatttacagcagagcaaaagaaagaatagggttttcagagtttatttatcctgcttctctgaaaaatacccgtgtgaactattgggctgagagtgttgagtccattgaatttgactctttcactgccatatctttggagagaatgccttcccaaagagtcatatccaaatgtaatgtccctcccttctcttatgagtgacttacttttggtattccactgggtggaaaaaagcttttcttacaggatatatgaactaataatagttatacgactgcttcggatttgtcgcgctccccttggataagtttaatatgattttgtacacattaattaattatcttaataacagacaaaatagaaggaagccactaccgtcctttccagtgcatcagatgaatcaaaatgaatcaaagggctgggcatggtggcccacacttgcaatcccattactttgggaggctgacaccagtaaatcacttgaggccaagagttcaaaaccagcctcagcaatatagtgagaacccatcactacaaattcctttttttaaattagctggacatggtgacccatgcctgtagtcccagctacttgggtggctgagtcaggagggttgcttgagcgcaggggttctagactgcagtgagttatgatcaccactgcagtccaacctgggtgacagagtcagaccttgtctctaaaaaaataaatttaaaaataacattaattaattaaaatggatcaaataaacacatacatattgtggagattgtgagaaataagccttgttctatgtgtctcaggtttacctgaactccaagtagccctgatgactatatggcagttatcacaataagcaacagcataaaggactttgagaaatcaacagatcttatttttaaaaatgaattttcttaaacatgtattcactcagctggcagtggtggctcatgcctgtaatcccagcaattttagaggctgaggcgggcagatcacgaggtcaagagatcaagaccatcctggccaacatggtgaaaccccgtctctactaaaaatacaaaaattacccgggtgtggtgacacacacctgtagtcccagctactcgggaggctgaggcaggagaatcacttgaacccgggagtcagaggttgcagtgagccgagatcacgccactgcactccagcctggtgacagagcaagaccccatctcaaaaaaaaaaagaaagaaagaaaaaaagaaaaaaaatgtattcactcaatatgattaagtacctactctgggctagatattaattagatcattgagagtgtaggtgtaagccaggcagccagacatcaattctcatggacttgcattctagaaggagattgaagagatgaggcaacagttgtagagaacaccttactgctcatgggatagaaaattaccactgggatgagggaaagttgctacttttgattgtggtcaagaaaagcttttcaggagatcacccttggcttgaggctcattgataagaagaggccagccatgcaaacatctgggggaagaggaaagagcaagtgcaaagatcccaaagccacagagatgtttatgtgctgggagaacagaagaaatcccagtgcttgtagtgcagtgagcaaaaggaagtatgaggccaggtaaagtaagaaaggttggcaagggtcagatcatggagggcctttggggctgttgtaaagagtttcatttcattctaaggcaattggaatccatttgagaattgtgagcgggagagtggtagggaccaatggccagtatgtgatgacaggtaatgtgatctatgctcctatttttaggggcaggcctccttaaagatccatttattgatttaacaatattaaatgaaagttcactatatgccatgctatagtgttctagggtttcagcagtgactatgacaggtctccagctttattgagcttacatcttattgaggagaggcagacaaaaacgaataagaaccgtgaagaaaatatagagtttatatgataaaaattaatgggatgaagtgctggaaatttcactggattggagaccactagggctacttcagtaattagttttgaggtctcctgttgttgtttctcagccctgatggtcaagaaattctttcctgttttgcttgtttccatttctgtctactgctttttattctgttgtcctcttaggtagtacacagccctttttctgaaagtcttatctctgatgaagaaaacactttttctcttcaaacagtaacttagtcttttgctttatttcctagagactctgatttcctaaagtttttcatatttgttctatgtattcattcttttcattatttttgttgctctccacataaaaatataaaaacttatcctgtaaagaagtattaatttagacatcatttagccagaatatagcagaagaattattttacagttcttataaggtacctactaatcctccctcctccctgccccctccctgtcttctcttttctcctttccttcctttctttttctcctatcccaaaatactagttaaatagtttctctcctttaaagtactttaaagataacttcttcataatgaactcttgtgtgcataagcatttcttttcctgttaagaagcagtggacaatttttttgttttaaagacattctagaagattttaaaaaattattgtggtaagaacacctaactgtgagatctatcttcttaatagatttctaagtgtacaatacagtattagtaactgtagacattatgttgtgcaggagatctccataacttattcatcttgcattactgaaattttatacctgttgattaaaactaaagatccttttcaaaaaatacttcttaagccatggcttcccctggttgtggactgtaacccttgatgttattgaccatcttgggattaagttccattaagaaagacagtgttagacattgtggagaaataatagcaaggaaatgtttgttctggtccaccaaaatattgagggaccaattttaacctccacatcgttccttctggggttttcaggataagaaaaaaggagctgtggcttgctgctatttcagtagtcaaataaatatttttaaattgcttgtttcattagtaggatgtttttctgaaaagacagagtatatacccctcaggatatttctgccaatgtgttaaagtatttgtaaaaaaaaataaaataaatggctttgtagaatgttcttgtttcccaaatggctactgattttcttaagaaaaaggtagcagcaatttgctgaaaaacaaaaatgaccttttattagtcaagagaaataagataactaatttagattgaatgtgtttatcctaccagggtccaaaatttctattttcatgtattctccttttcttataaaggctccctttggaactatctaggaaggacctgccaacatccttgaacagtgaccattcagtctctactatactagaacccatctgatgatgaaattttgactatatttttggagatttcattctgtcattggatagctctaggaagtgcttttacaccttttgagctctggtcttgagtccagtaatttttacgtatcagtccttgttctgccttccaaaaccgcataatcctccttcaacttgacgtcctttatgtgttttgagatggcccccatgggcttccaagtgtttctggctaaatatcctgagctcatacatgtgttcttcatacagcagcactttgaggcctctctccatgctggttaccttcctcccaagtctgagttttaatgtcctgtttaaaatgttatgaacacagctacttagaaagctgtgcagtcatctcagagtagaatcagacaaggacctccttcacacgaagtgcttcctgtgaggacctatgtaatctgctctgtcttctgctatcatttgtttcttcccttctctcctttgcatcatccactccagcgacactggtttccttgctgttcctcacacaagccaagcaccctttaacttccttttaaagccctttacccttatttcctctgccttgaactctcctccttcagaagacatggggcattctccctctctgcactcagattactattgctgtcccctcagaggggcctgcccttcccaacccattctaaacagccctcccccatcatgactaccccttgtcatgcttttattagcccttgaaattcccagacattatgttatcattccatttatttgtttattgtctgctatcattattagagtatgatctctattaagtcaaggactttgctagttcctgaatgtcttttcagtacccagaaaagggtctagcatatagaaggagcataataaatatttgtgaatgtattgactaatttactatccatgcagattatctttaggcagaggatagagaataagactttttagtacatatttaacagtgtgtgtagccatccatacagtaaagaattctgcaactcacagtcaccccaaacagcatttgagcttttagatactatagagcaacctgtgtctgtgtgtgcatagatatgtgtgtacatgtacacacttatgtatatacatacacacatacattcgtatacatgcgtgtacatttatgtatgtattatgtgtatatctctgattaaatgggtgaacatgtggtttggggacccgtgtccaagccctctagattgtagaagctggaaatgacaaaagtgaatgaagtgagggaaagtgagccagcaggactgctcactgcacatgaatttccaaggatacagttgttcttgaacaatcacagtcagtatatcaaaataagcgctttattgagtagggtaaaaggagttgctggaaagactgtaaattctctcgcagaacaaatgataactgagcccaggagcccttttgttcttgggggagggggcataaattccctgaaagtatctgtcgcagggaattgctctgcattcatcatgtccgcctcctgcatcattcatgaatgtcataagactctaaagaattggcacttcatagtgaagatgattaaatagccactatacttgtcttttctgctgcacagtgctttttaaaggaattccatttaggttgtagcatgccccttcgaatcccttcgcatttcttgcaacctgaggtctctgacatcagaggaaggcccttgcttgttgggactggacagagctggtgggctagcacttcagtttgcttattttcctttgatggagacaataggatctggaaaaaaaaatgccataaagctcaaagcaaatcattttttagggagtatagaaattgctgtttagattctgcagtgaatgagctgtaatttttttcagatattttcacttctcttatcacttccttgtggactaagaataatgaatcagaacaagacacttttatatatgatttgctattttatatattcaaatataaggcctcaagtcattttgtagccaataaagcctatgtatgcagtgtaaatactgatgtaacagagtataagatatagaatcggccaggcgcagtggctcacgcctgcaatcccagctctctgggaggccgaggcgggcggatcacctgaggtcaggagtttgagaccagcctggctaacatggtgaaaccccgtctctactaaaaactataaaaattagccgggtgtggtggcaggtgcctgtaattccagctgcttgggaggctgaggcaggagaatcacttgaacctgggaggtggaggttgcagtgagctgagattgcaccactgcactccagcctgggcaacagagggaaactccatctcaaaaaaaaaaaaaaaaaaaaaaaagatatagaatcttacttctgtcctctcccctgcatgcatttcttgtcatgtatacatattctctttctctctctccctctctccacacatactcactccctctctctctctaagtgccctagagtaattcttacttcccaaacagcatccttaagtgacagagtgcaaatgattgaattaacatttatctactcaggtatatgtagaatctaaaacagttgaactcctagaagtacatagtagaatagtggttaccagaggcctcaggttgggggttggaaggagcagatgttggtcaaagggtacaaaatttcagttaggagaaatacatttttgagatctattgcatagcatggtgactacagctaataataatggattgtaaattgcaaaattgccaagaataaatttcaaaagttctcaccacaaaaaataataagtatctgaggtgatggatgtgttaattagcttgatttacatcattccacatagtttacatatatcataacatcacattgtaccccataattatatataattatgatttgtcaattaaaaataaggccaggggcggtggctcacgtctgtaatcccagcactttggtaggccgaggtgggaggatctcttgaggtcaggagtttgagaccagcctggccaacatggcgaaaatataaaagttatctctactaaaattataaaagttagctgagcatgagggcacatgcctgtaatcccagctacttgggaggctgaggcacgagaatcacttgaacttgagagacagaggttgcagtgggccgggctcacgccactgcactccagcctgggcaacagagtgagactctgtctcaaaaaaaaaaaaattaaaattaaattaaaaatataaagttggtcaataaacaaattttcataagcacttatgttagaggcaacagaaagtatttagagagaacagcagactgtaattaggagagaggagctctgatttgtttccaccagtcatcactgtcacctcagacaaattctgtaacttcccagggcctcaggatttgcatctgcaaatgaggacacaaatggtggctccaggattctccttccactcttatgacacatggctttatgtgtcaggaggggctcagccatcaggagggaacagaaaaaaaaaaaaaaaagctcaggatatcaccactatttctgaggaactcataatttaatgatctctgcaatctctaagctctgctgggaaatgagctccagcataacacgggttctgggtctgtagtggcatcgctgactgaaagataggtcatttttaaaatagtggtatgacctttggctgtgatttcctcataataaacataatatgatttttgtgccaattttctgttaattatgggcttctcctaaaagtttatgagtttaggaagaatgttctttttaaagtagaactttggacacatgttaggagatccaattaaatagatggatcatggaaattgggtcatcactggttgttaccagtaagaggatcccttagagataatgtgttcacctgttaccatagaagtcttatgagctgtgcctgtaagttaccagtggcttcaaggcaggtagaccttttgagctttaatttgttcctagaaggaacctcttcacttctcattatccagactttccctagaagtgggagggctgatcaaaatgccagccttggccctttgcattctgctgctccagccatgtgggtctgatttgttcttactgctggtttaagagagattaaaaggagcaaagctgttctctaagtttcttgatctgcaccgtggcagccagagtcagaggaaatggagacaatgggaaagggactaaatcctagagagtgatgtgtctgggatctcgggaagcagacccagcgttcaaatgcaggcttcaaatactaggtcattgctttggagaatcttcttgcacccaaaacaacttgccacaacctatgtggcccaatgtgcagcaaaagctgagcctgagataaggacagacaggatatatggctgaataaagaactttcaatttccttttcttagtagacggacaagtatcccatcattaaaaaaaaatagccacataaaaaagcagtttccaatctaagtgcacatggggtatgccaaaatctttgcacatgattgacttaatcagaaggcccaatctaatggagagaagtactgtattaatttaaatatggcaggtgctttctaagtttattgcaagagttaaagaccaattatcttgtatttttccataaaattgcattttctaaaaagagactggtgtgtctgaatacatccatcataataaatcttcaagcttggatggaagtgactgctgtttatttgcagcatgtcatatctgtactattgaatcaatgctaaagttatcatattagaactaagatgagggcccggaaaatgagtttttatagactcacagcgtgattttgtgaataaaagcataagaccaggaccaggtgtagaaagtgccttattccagggcctgatgacctggaaggcaattttcaaatgtagggattatgcagtcacctctcacaaggtccagggtgaagaacaagtaagaaactttctattttctggggaataggcacactttcaaaggaggaagaggtattgagatgagacagagaaattgagatggaaagtgtatttgaaatatgtgtaattaggcaggagaaatgagaatcacaaaacactagcaaaagtcattgtcttgctaaaaataataaaggaagaaaaacaaagtataagctaaggctttgaaggtgataaaatattaagaaattttgcttctgtatttataggaaatcagtttttaaaagtataaactaattactaatatattacataataatgcagtgatgttgcttgtccatgataaaaggtaataaataaaaatttgtttaatgaataatgaaaaatagctttcacatttggagttgattttgattcattttgatctcttatgtggctcttggctgtagactatctttgttttaagaagagcaaacccatttgtcctaatattcctggagaattatttcattcaaaagaataaaaatatcagccaggcgtggtggctcacacctgtaatcccagaactttgggaggcagaggcaggtggaacacctgaggtcaggagtttgagaccagcctggccaacatgctgaaacagagatggtgccactgcactccagcctggacgacagaacgagactctgtctcaaaaaaataaataaataaaaataaaagtaaaaatgtcatgtatataatatagagagaggttcaaatacgctaagagaaaaagaagccaagatcatgtaagcattatgattacaaccacatgcagactatgtttttcttctggctgaaggccagagagaaaggcaagtagctgtatattcagtgggtgttatttggtcaaatcgatttacatagtcttgcaggtcttccaaatactaaatattaagtacttggaaaatagctgagcaaaatctgagtgcattctatgatgatacagtagcacagtcttgcttgggacttaaaatcatggttgtttatggtcatggagttctaaccaaacccttgaacacaaaattcagtgagctcaaaatgaaactaacactttcacattctaatctgtatttccttttctatctactattttatttgtccaaatttgaaaactctgaaccaaccccagatccttctttttttactccccaaatatcaaatagatcacaaaaggcttttattcttcatgtctttcatatctgcttcccctgatttctcatgctcactgatccaattccaattttcatctctcgtgtctggggtattgcagcagtcttcctctaaatccccatggtcacacattatcctccctccatcttctctactgcagacaaagttatttttctcaaactgtgcattttcccactgatcaatgtagtcattctccaactttttaaatactaaaatcactctttgaaaaattgatatggaactttgtttttttttttaagacagagtctcgctctgtcaccaggctggagtgcagtggcgtgatctcggctcactgcaacctctgcctcccaggttcaagcgattctgttgcctcaaccttccaagaagctgggactacaggtgcatgccaccaagcccagttaatttttgtatttttagtagagacggggtttcaccatgttggccacgatggtctcgatctcctgaccttgtgatccacctgcctaggcctcccaaagtgatgggattacaagcatgcaccaccaggcctggctacttttgtatttttagtagagacagggtttctccatgttggtcaggctggtctcgaactcccaacctcaggtgatctgcccaccttggcctcccaaagtgctgggaatacaggcatgagtcaccgtgcccagcccaatcatatattctttaacattgttgtattatttcccagcagtttgtagcttattttgttttaatgctttattttcctagtaacaaattctaaaacgatgttgaataatattgtgataatgaacatctctattttcctgattttaatggcaaaggctatataattttgccatttagtatgacaatactttgctgttgataatctctatcatatttagaacatcttaattctatcttaattaaattttagagggaatggctgctgaattttttccaatacttaaaaaaaatcctgagtaaaattatattcaaattctactttaattaggtaaagtaatgaattttgttaacagatatctttaagctgaaatacactacttttcatgtttctgaaatcatatttttcttctaatataccattgaaatgctattcaaaaaatgtttatcaatttttgtaagtgaaattaaagtgttttgtttttgtgtagcatatttattaggtattggtattaagattatgttggatttacaaatgaattggaaaatttcttagtctgtttgggccactataacaaaataccataaactgagcagttttgtaaacaacagaattttgtatttcatagttctggcggctgagaagttcaagatctaggtagattgtattggtctctggtgagaatctcttttctcttcataggcaacatcttcttctataacctcacatggtgaaaccttacatggtgatgtctgttttataagatcgtttgtccccaccatctcccaaagaccttaccctataataggaacacattgaaagttaggatttcaacataggaatttgcagggggatcataggcattgcagtccatttcatgaagatttctaaccttgcctgtagtatggtataaaatggagtaatttagaaattatctcttatcttaaaagttatgttgaaaggtagatgaaaattacctgtaaaatcacctagatctgtattttttaattattaaaacttgaatctcctttccaatggtgtctatggtcattagcctattgagtttttctactttttcttataaatctttgacaagttatactttttcctagaaatgatccattccttctgactttcaaatatattgctttaaagttgtacaaagtatgattttatatttgtaatcttttctattgtgatggttatataatttctaatgttctatttttctcctttagtttttatttctgtttttttagaggtttatatattttctttgacattttaaagagcaaactttgggatatttttaacttttatattatttcaaatattatcgggtaaatttcagcttttatttttaatcatcaaaaaccatcttatttatcttatttttgtaatagtgcattaaggtgaaagttcagtttatttatgtttattttccttattattatttgagacattttcttctgagtttctgagtaaagctttatctgaagtttatatgacttgatatataaagctgtctcttcattaatactctaattattaggttttggtcttttttactgtatattttaagattgtatgtataaagagtactgtttgttcaataacttaattatagaaatcattaaggatttctttgtcaacaagaatattatcagtttaacaaatgttccaatttgaaatatatacgaattactgaatatgcttctttggtaaaattcctgagttgcttatcacccaatcatcatggtcattctttgccaatttatttaagcacttactgtgcccctatgtgttccaggcactgtgataggtaccaggaattctttcatatccaaactcttctagttgtgaaagaacccaaatttgaactagcttagactacatgagttagctattaaaagttgtgtataagaaagacctggccaggcacagtggctcatgcttataatcccagcattttgggaggccaagacgggcggatcacttgaacccaggagtttgagaccagcctggacaacatagtgaaaccctgtctctactaaaaatacaaaaattatccgagcatagtggcgggtgcctgtaatcccagctactctggaggctgagacaggagaatctcttgaacctggaggcagaggttgctgtgagccctgatcaccccactacactccagcctgggtgacagagcgagactctgtcaaaagaaaagaaaggagaagagaggagaggagaggagaggagaggaagagaagcagaggagaggagaggataggagaggagagggacaaaggcacaacttcacaatatagattataaaaactaggtattttaaaaatgataagatttttctctctgtggccagatctaaattcaacagcttgtctttactctttcagtcaggattgattttctcatgactttctccccataagcagaaatgtggccacggcagctgtgtgtctcttatgtcacagttttatcatcagagaggcactgatggagtgtttctctggttccaggtttaaaaaaaaaaaaaaaaagttcattgaagttctctagcctagcttgggttaattgattacaccttagtccatctgctgtatataagagcagaatcttttacggacatgacaatttcagttcaaatcacatgataaatatggaggaaaataataatttctttgtgaagaggcttaatgtttcaagatagagacagaggatgtgctgcgccgatagaataatgaaagtctcctatagtcaaaaaacaaacaaataaacttgaggcagattcttcacttcaaggtgctcaccataaaatggcaatactaaactatttctagaactctatatagagtgcctgttagttattttgatcctgttacaactctttcagatgatgaggtagaagtgttgtcgccttcttaatcatggagaaactgaggctcagtgaagataaatgattgttttagaacagaagcatggactttaatagttgggatttgttcttttcatccaattctgacctgggttctatgattaagaggtatgtgtctcatagaatcaaatcatcacccttcaaaaatattagccagcttttccagaaaaatcgtgttgtatgaattaaagccacaaatacaccaaagtcatccgtttacagcccctggcctcttgtaagtatgaggatcatataaatcaggcatttaaatcaaagcactggaaataagcaactgctttttatgtgtattgtttttccagagaatattcaatacttagctaccccttcattgttcttattaaaaaaggtatttcaaggctgtgaaataaaaggaggaaaagaagacaaatgtgtatgttccaaacttctcctttcctctaatcatgtctcatgtcatcagaaggaatgcacttctgaaaaataaaatgctacagaaaaggctgctgagtaattataaaatgattacttttgtttttcctttattcatttatattttgcttatgaacaaatgtatatatggtctttgcttttagttaatgctctgtaaaatagaataacgtggctatccttaaagatgtcacgttgcttttctgttgtacatccctgttaggttaaatctgagatgcacttatctatttatttttacaaaaacaatttgcaatgtgatttagaaatggaggagtaacataaaacaatttgactaaaaatgggtgtgattttcttatctgagactgccaaaaattcaccaaagaaaaatcattcaaatgtctttgtggttaggtttcttttataaattgaaagttgtgttctatttcatcatgagagatgctgtgagctctaactgatgagcatttataaaatatttccacgttgagatgaaatgacaaaaaggcaagatgaattaatgaacattgtatattcttattcctttattcccattctactccatgcctgaatggcaacgtgaagatatgtaagcataggtaagccaggtttcattgattagttcaacagcatttatttcctgtgcattcacagtgttgagagataaataaattaaacagccctggcttccaggagctcgtagtagagaagcattctggatttccattttgtttgacaataaaacttaatatttattttcttaagcctgaatactgtgcaatttcctagaacttattttgttttgctatataagaaactagcatggttatgaaagttaagttggctgtgagttaatttctcacatagacctcattataaatttacccttcagaatttagagttgtctgagtgtggtataattaatcaggaatggactattatctgaccttactttattcactttataagaggacaacctcatgtaaaaccactgtcatttaagtaagataaaatgagtacctctatactgccagttgcattgtgaaaggattgggttttcatcttgtttgctgtttttgttttgtttttaattttggccacatattagaaagccattgtccttctttccatcatcatcaggtaaatggtgagaatattagagatacagtttgacataatgaaaagaatgtagattgttgagttagacctggattaaagtcctaattccattcgatatttggtaaaagatcttggcaagtagttttaccttattctatagcttccctcatctttaaaaccaagatagtaactgttatgagctgaattatgtcccctctacaaattcagatattaaagtcataaccctcagtatctcagaatgtgactgcatttgaagatagggttttctgaatgtggtgtaattcatcgggagtgggctatttctgaccttgctttatttttcagtttcagaggttattttggtgggccctcatccaataagactgatgctcttataagaaaaggaaattagggcatagattggtacaaagggaaaaccatgggaagatacagggagaagatgattgtctacaagccaatagagaagctgtagaaaaagccagcactgctaacactttgatcttgaaattctagcctccagaattgcaagacaatgaatttctgttgttaaagttacccagcctgtggtacattttacacagccctagcaaactaacacagcaaaaaatatttcaagtgaaaaatatagagttttgaaatattatactgtatactaagatatataataaataatatatacacatagctggtattagtattaatattgatattaacattagtctagagttagtattgccaaacagtaccaaagagtttgtgaaagaaataattgtcccaaaggaaaaacaatgagcttatgaaaattcctttaagcaagagggaatttgagtgtgtccgtggaagctttatttttaggtcaattttagcgtctacagcattgcgtattctaccactaatcatctttttccttagcggaagtatcctgaaatttgatgagtaaaaatgactttcttttatatttttgtgatataacagcttctaaagtaatgtgtttctgaaaatgtcattacccctaagacttacttacaaagggtcatgatgtgtttgtcaaaactcatcagtgtgtccagaaactatgtgcgtgtgtattttagtcaaactttctgggagttaaagtatatataaggtaacacagcaatggaacatcgcaatagttggcatcagatttgcaaatggcacaattatttgtttcctcttcactggtccttgaaaaatacataatgttcccatcaaaagttccagccaagcatatttgtaagaacagggtttgaacataacctattatatcatgaagaatggctctcttccatggtatttaccaccagaattaagtagtggtagacttttttttattcatggaaaacatttagtgaatgggtagaatgttatttgttttatatttttctctcatcagctcctttggagactttggcatcgggcagaaaaagggtctcactctgcacaccaatttgagttcccatgttatcaaacagatttaatgctaaactaaactggtgtttgttctgcttataagtctttgagttgaagccttgtttctggaatattgggacatgctctgaaatgttgcctctgtagatcctagaaagtaatgatgttttctgctttcatgcgatttagttttaattattcttccttcaacagagagaaatagattgccccacagggagggaaccctcaccttgcttgagcattgtctaagaaatggctttttctcatgatgtacttaactgttaggcaatgttgtcagtttctcagcttactgagcagcaaatctgctcatttctttgccaaggaaaaagaatgttcttaaaaatagatgaactttctctcttaatgttcagtgcattcaatgttgctttatttaaggctgctttatcatcagttctggtgtttatttcaaaaaattcaaagtagataaaacagatcattcactaaattccatctattcaataaataatttgcagagctgtttttaaaatgtgtatcatttaccctgtactccctagtggctccctctgtaatgcagaggccttgtttgcagtttttccatctgttattcacctttctcccctccttttggagctcttgatctctagggatgtttttagggagtctttatcccattagtcattgggacagctttggagaagagggcatagttaagaaagggaggatctgattctattctcaactccactacttagcaacagatcaagttgtttaatctccttgagcatcaattttcttttttattaaaatagtaaccaaaatatttgccattaatatttcagtgagtgttgagggaagaggcatcagatgagacactccaaaagaaagcaatttgaaaatcatttaattctatggcaatataaggcccagctgttataaaatagtgaacattattcactcctaaaacagccagagagatgagcggcagaggaaaaccatagaacaaactaagtaaaagaaattgagaaaatgtattctttggaaaatcagatattacgagatccttcagttaaatttatgtctctatttgctagaagagatatttatcagttccaaagcaacaagcctttcccttttggttttattagctacatggtaattgatatgaatttaaaagataggtttaatttgatagcaataactacatctactggcaggatatattttatgtcattgatagtccttttattttccaaaaggatttaccagtttatagtaaaaaaacacgaatgtggataagcttgtgaaagagtaataaaaaagaaataaagaataagaaacctgaaatgatagaggaagaccaacataccttaccattatgagattttatactaagtcctgaggcaatgatcaaagagaactagagcaggagactgacatcttgtttctcatcctagtttatctatcatgtactttgcacataattgttatacttattttattacttaatttattgttctacttgttataattgtccacaagtaaattatccagttctccttaaatttaactctcagaggccgggtgtggtggctcatgcctgtaatcccagcactttgggaggctgaggtgggtggatcacctgaggtcaggagttcgagaccagcctgaccaacatggtgaaaccccgtctctactaaaaatacaaaattagccaggtgtggtggtgcatgcctgtaatcccagctacttgggaggctgagagaggagaatcgcttgaacccaggaggcagagtttacagtgagccaagatcatgccattgcactccagcctgggtgacaagagcaaaactccatctcaaaaaaaataaataaataagtaaaataataaatttaactctcagatttcccctgggagatgcttccaaaacttgttccattttaacatcaatagaattatttgagggaaggctattttgatatatatatatacacacatatatgtatatatatatataaaaaaatacatgaatgagaaaaaattatattcctcattctcttaaagaaacgatagatcactcacttaattagctatatatatatatacacacacatacatatattcacatatatatatacacacacacacaaccaatattgtattattgtattttagtacttttattaagccattttacctgtaattatttgatggggtaaataataaatgaattctagtctattgtattttttaactgaaccttttttgtttttcacacacatgcatgcacacacacatagacaaatatatatatgcttatgtatatgtatatgtgcatacacaatgaatgtatatgtatatgtacatacacatatgtatgtatatgtatatgtacatacacatatgtatgtatatattatttgtatatctaaagtgaatcttaagacaagaattctatttctgttgatagtctcccagaaaaagtaatatgctatttggctataagactggaaatagaacccatgccataaaggcagggccagggggtttctaagtcaaaacaacaacaacaataaaataattacctaagtgatcctaaataaagaaaaagtaaattgccatcaacaattatattctaatacaataagcaataaaatgcacccaaaatttaagaaccttggagaaatatgtggatgagaaaaaattatattcctcattctcttgaagaaactataggtcacccacttaattagcttgttccgtaactttcacccaggactcctttatgatcgcatggaagactgtttgatccttttcttctgctggatcaccatcccaagcacacactcacagaacacataccaaaacactctgtcaatatcaccatcagctccatcacagtaagtagttagccaattatgaaaacaataagccaggcccattatttgcaggttgtgagttaaaaaaaaaagagtcatccttgttgactatttgaagatgagatgtatcctcttaatctttgttagtggtgactgtgtagagatttcattcctggaatactgtgttggttaaaactcagcaaagcaacctcagctgcttgcaaacttgcaaatcctgcagtgttaaatggccaaaatgctactatagcaattttttcttcagttgaattggtcagtttttgccaacaaggatgaaatttacatgattctgaatataaacataagtagtatgatcttgcatcagcatactgaacacggtgagaaaccagcaatcagaagtacgaggctcaggggagaaagcatgtaatgtggtatagcatgcctcagaaatgaaaatctttgatgaattaagaggaggttcttatagttcccaggattttcccaagaagttgatttgtaatccacattttaaagtaacacaattaacttttttatttgaatatgtaaaacaaaataattctatgtttcctgtaggactctaggcattttatattaaaattaacacgaagtatgtatttacctttaaaaaccatgcaagatggcaaagcatgaaatgtaaagagaaaaaacaataacaacatcagagtagaaagttataattgttaattaccttcctctaatgtcccacagtattggactatgggagcattcagggcctttattcactcttaccagcaaatactttaccaagaatagatattttcatatttttttcttcatagcaaagtaatcatatgccaggtactttgtatcttttatgctttcttcacctataaagttagaatcatctaacatagtgacatcataaattcagaataacaaaagcaatacaaataattttaaatcaaatttttagtctatcctatcaaatattgtcatagtgaagttttgttttttgtttatttaaagattaaagccactgtgactttctaaccatatataagaaattatatatttatgtattaaaatattcttctcctttgtattggagcactgagaattactggtaggattgtggatgaaaactacaagtaaaatgcttaaagttgttgatatggtgagatggccagacaagcttttgaaaacatgccaaatttgggggctgtgactttgttttcattctgctttagtctgataaaaagatgtgaaaagaactaagtacagacaactgtttgccccattggtgtagtttattgatacagtttattgtgtaattacattggtatgtggtgaaaaaaggctttcagaggtagaaggctcaggctggagacttgaaagtggtactatttaaatcagataattgagtctctgtttccaaatctgtaaaacagtgttaagatataaaatatcccatacaattgttgcaaagattcagcaaatgaatttgaaaatattttgcaaactgtaaagcagcatgtatatgctgctatcaattttttgacttgttatttttgtagtgacaaaattatttcctgatagagtatgaatttatctctgtagcagaatccactatatatttaggatagaaaagtaaaagatttttataaattgccatgaaatgtcacaggctgatttgcattttctggtgattctatacattaatcactgagtaaccttcagttttccaaataaagaataaagagagtggtgatgacatttgtaaccatctacagaggaattatttaaattcttcacagatggagcgatatcaagggtaaatcattatagccacatttctaattttaagaagctttgagggtgtttgtggatggtaggaagtaaacattgttttgcatatagaattaatcatagactttgcataccacaattccaaatcctccagatgagtgtagagggctttcgagacaccatcccctaaggatcgagaaattcataaaaggaaaataatgttatgctacatgtaatatacaaattgagcaaattggagcaactagaatagtgacctttcaaagaagacaaattagattctgtatgcctcagaatttaatgagtcttagtgctttaggaaggatgacatatgacacatattcttaattctagtctcacaagagttaactttattatttctcaacaagatgaataactcacttcttctttggtcaacataattctacctaatattctctgtaaactagctctggaaatacatgcggaccagtgcttgagatttttagtaaatgtaaaaggtatctgaatggttgtataatgctgctttaaaagagttttaagggttggaacatggtcactgagaaatacacaagaaaatctgttaccaaatgtgctctgaattttgagatgagtaacccgtggaagtattcgctatgggtaacaccacttgcctaaaaccacagaggcaacaaatggcatagcctttctggtcaccaaatctaaatgattttctccaactgaaattaaaaatgtgtttcttgaaatgtactttttataatttctgaattacaaatattttctttatttttattcccatttgctttgtaagtagttctaaattaatatattcttagtaactcctgagttcatatggataatagtaaaaacacaagtaaagagtaaacatactggtaaacccactaatcataattgacaactaccacttgtcatgttcaaatctcattatcctgtgatgttttttctgtttcttgtatcttcttcctaagatttagtttgaaaaaggaaaagaaaatgtatttaatgccagataaataccaccactagggaacaaaaaaaaggtccatttttaaaggactcctggaggccaggtacggtggctcacgcctgtaatctcagcactttgggtggccaaggcagtcagatcacaaggtcaggagattgagaccattctggctaacatggtgaaactccgtctctactaaaaatacaaaaaaattagccgggcgtggtggcacgtgcctgtagtcccagctactcgggaagctaaggcaggagaattgcttgaacccaggaggcaaagggtgcagtgagccgaggttgcgccactgcactccagcctgggcaacagagagagactccatctcagaaagaaaaaaaaactcctagaaatcatttttgttaccatgtttatagcaacacaatagtgaaataggcaaatgcatttagtcacataacttggttttcttgggccactgctttctttcctgtgggagtgggagaaggtacaagcaggagagacatgatgcctttggactgctctgttaccttcagttttgtaaggctcctggctccactgaccagattatgctgatagataagagataggggactagttttctaccttgtgcctgtcctggccaagatgcaaaattaagcctactgttgaggaagaccagaaagttgtttattgcaatgtacccaggctcccagacttaggatgttatttaccctccaccgttatgcagcgggaacttaagatgttaagaacgactcttaccaacatctgctttgttatgcattcattctgcctgcatctttaatttggggtgatagctgccttcagaagctttgggagccgttcctctcagtaaccaaatactgtcccatgggggacatttcctctctgcagctgttctgtgtagggtctcaacagtgtgctacagctggctgtatgcaatgtagtgccttgatgtctccctctctccttgcttttgcagctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagtgagtacagggccttggcctggattttcttatgttactggtggtctgagttagtgattcaggtagacgcagcagaacattctagatcaatatggcaaaggtgcacatgcttataaaaattgttttcagatgtgaaccatcatatttacagggttcctgggggaaaaaaacttaaaaactcttccttcttccccatgtatatagggaggaaaaagaaattcattctttgcaggctcccttcccaactgtgtggcttggcctgtggcagaatatttagcagacttctagggtatatttaagagatttacctggtgtggatcttacctggtgcaagcagcaaagccaagtggaatgttaacaatctcctaggctgggatttggcaaaccttctgtaaagagacgtatagtaaatattttggactttgcaggtcagatagtctctctcagagctactcagttctgcctttgtaatgtgaaggcagccacagacaatacatttttttgaaatgcatgagactgtattccaataaaaatgcatctataaaaacaagctgcaggccgtaatttagtgacccctgtcctaggcttcaagcatcactgtaagagatgtaataaatgtgtgataaaaactgagaccagagtgccagagtgggcggggcaaaagggaaacagaacagtgatcaagagttgagtaattcatgtgtattgcatactcaacattttgcttttggtcttgtacatatgcacttaatagcactgcacccttaatccctgtagatcataagaacacagcaaaggctaagaaattaaaaatgatttagaagaaaaaattcttttgttataaggatggaaaatatttttacagcaacaattaacccattttatcacctgtgcagtctgcagttaagaaagtaggctaaagagagatatgattctcatccataagtacccaaagtgcagtctccaagagcaaagagaggaattgttctcattagttagcaatgacaaggctagaaagaatggatttaatttggagcaataagaatttagtttaaatagcaggaggaaaaggcagttaagaaaaaagatcaactggggattactaccaacctccaaaaaggaggaaaaggaacattgattaggaatctctgaatcagagttttgctaatgtgcaggtgtatagagagaagcagaggatacaatttcattgctggtctctggagttggagatggctggccggaatcatgcatgacaagcccagctcccacagcagtgcgcatgtctgacacttgctcttccagcatgccttggaaatgagagcagcttaaagtcctaggcttgagctggaagtcggtctagccccagtataagccagatcagggcaagactctgcttaggagcttaaggaagaactggttagagatgatcaccttcaaaatgtggtggaggagtcttgaatagagttgtgaacttttcaattttttctcagatgcttcaggaaccatatggtgctatgagcctgagctaacacattttaaaaagctatgccaaggagcaaaaagaaaggcagccatacttactacactttatctttatttggcctctaagaaccaccataatttacaaaactctgtgagatttatgctacatataacttaatgactatttcatggcagctataactaggctgttattaccagctcacttgcatttccacagtgatttatcttctttttttgttcattgtgactgcctaagaaaaatatgatttggcacagacatgagcatctttttgagtcaaatagtgtactattgttttatccattcctgctcattcatgttttgtagaacatctccacttttaagagagaggttttcctattttctgatggtttacttgaaattagcagtgttttaataaaattgtcatgcagattgtggtaacttctaggaggaaccagaacattccagtatattttaatataccattataaagctctgtcatttctttggggtctttgaaaagtgaatactctaaacatactttgagattcaggtaacatccattgtgtgcatttattagtgtgtgtattctgtataagcatacccattagatttgacatagtataatattattttctttgtatgagcaaaattaccagacattttatatcaaaatgtaaagagccccctgggatactgtagacacttgggtgatacagccgattgcttaaacgttctgtgaaagcccagtagattttcctccaaatcttagattaggaaatgatgtcacctgaccctttcagaaaaaaggaaaaaaggatcctatgctgtggggaatctgtgtgattctagagtgaccctgacatgttcatggccctctcgagcaccaggccccttcatgggtctagtcatttgaagccatattttatttccttgcagattatctctttgtctactctgaagaaggcaggtttctcatcatacttgaaagtaaagaaatctaagtagaagactaaatggcttaattatgaaaccagctttttgttttggacatttaagtagatacatcagggaaacaaagccataaatacttattaagatacttttataacttttacaatctgtaaaaggtggttctgtttgttgaatggtttgttttcttgtactaaagaaaattactgaagagagaaagagctttggggccattaatgaaagtggaagggattgagcataaggcagaagatgctatttctccttacagtttgcctagaagagaaacctcctgggaaaaagaaaaagtgatagaagacacaagggggagatgaaggcaggtggttttctcagtttttttactgctataacagaatatttgagatttggtaatttataaggaacataaattaatttctcacagttctggaggctgggaagtctaagatcaaggtactggcaggtctggtgtcttgtgagggcccagtcttcacctctaaggcgagcactgcatcctcaggaggggaggaaccccatgttttcacatggcagaagggcagaaagagtgaacccactcttgcaagccctttttaggatagcattaggcagagccctcatgacctaagcgctttccaaaggtcatacctcccaacactgtggcatcggtgatcaagtttccagcacatggaattttgggagacatattcagagcatagcagcagaatatatttgcagcagaatatattccagggataagggaagaggacagggctctgcctaccgatgtgcttcaacaagggattacatgggggcaaagcttcattctttgaatatgagtgttctttataaaataacaacaacaataaaaacctaaagtactttggtgctacttgtgagtggtggtcaggctagtaaagttggtcaaaaacaaagtacaaactccaaaattagccagcggtgtatatgtgtgtgtgtgtgagagagagagagaaagagagagagagagtgtgtgtgtgtgtgtgtgagagagagagagagagagaaagagagagagagtgtgtgtgtgtgtgtgtgtgtgtgtgtgtgtgtgtgtgtgtgtgttggggagaaggagaagagacaaagaaagtttgtatttttttaactttcaaagaagacaattcctagaaattcctgaagtgttttgagcaacatcaacattgtcgttggaatatttcctttttacccccaagtggacttatttgaaggaagagaaaatgctcttccaagaacactagagagcctgaccctggggtaagcacccactctagaatagccccagggcaggagtggcaaataggcttcatcttgcctgaaaattctcagtgcctcactctctctcttcaagctttacaccaggaagatttatgagaacagcgggcaaatccacaggtaggagatctagcttccattagtcatgtctgccacatgtgccgatgtgaggttttgtgaacgtgcactacacattcatcacatctgctttaagctccacagtattcctccacacgtgctccaattttcccatttcttttcctttgttatcctgaaatccctatgtattaaaatttctttggaaaagcagtatcttaagctcatgttgcactgcaagtcctggaatgatttatcaattcatctgaagtagtcaatcttattgccatccttctcataccagcctaaagtcagctcctgtgacagaatttaagttttgataggagagttggacagaaaggaagaaaagtggccatggctagtttggggatgtgcaatgttgtgtgggatggtagaaatgagtgggaaaacttgggcaaaatgaaggcatttgtgtcctagattgagtaactggggcaaatgaagaaagggtcaccaagacagttgagtgctatgagcacttttcttcttttatgtatgtattttaagttcaggggtacaagtgcaggtttgtaggcttgttacataggtaaactcgtgtcatgggggtttgttgtacagattatttcatcgcccaggtattaagcttaatatccattagttatttttcttgatcctctccctcctcccaccctccaccctcccaaaggcccagtgtgtgttgttctcctctatgtgtccatgtgttctcatcatttagcttccacttataagggagaacatgcagtatttggttttctgttcctgtgttactttgctaaagatgatggcctccagctccatccatgtccctgcaaagaacatgatttcattcttttttatggctgaagagcacattttttctatttcatgatttgctcagattgtctttcattctggccaagggagcagaggctcttatttctcttgctactttcttttaaacctaaagtcttcccactcatctgggccttataaaagttaaataggttttgacaaaaagtgttgaacaacacaggcctttggtcattttaaaaaatcagagagggccaggagataaaaatgatttagaaattgcttgcttcaaattaactaacatttctttgtttttggttcacattccatgatgcaatattttctgaatgaattataaactgttatattaataaaattttgaattaagcatgtttgaaaaaggcaaagagatctttattgaagtatatgtgcatgaaatgagattctgtagagcgagggtgtcttagggtagaggaattttttaaaatctatttcaaatgttagtttccttccattgaaatcgattgttgaggaattaaagctcaattttggagaaaagctgctatcgcttgcgagtgacatctgcctattgaccccacatctaggctttaaggagcggtgtcatgttacactcaccttcatttatacaacagggaaaaaaaactgaataggactagagaagagattggcatgaagtgcttgttattactatcatgaaactcttgtcaacctctttcaccatctgcaaaatagaaggtcggggagaactgggcaataattagcttccctttatgtagttaatgctgagtgtaaaaaagacatcctattaatttctttctctctgtatgtaatttacagtaaatcctcttggattcattttttaattatgagcctttcaggaacagtgaaaatttatgtgttaagatatctgttttgtttgacaagaatctataaccttccccaactatttccttcctgacttaaaatgtagattgttacatacacgaggatgaggggcagacaaagaactgctgtccagactgacccccatttcacggtggcaaagtgttctccttccaaaaactggaactttgaaaacagattgataatattctatcagtgtcatatttggggaaactggatatttattaagtttcacttgtatattattgtttttacatagtttatagcacccaacgagagtcctgtagaataaatggaagtaaagctgaatgatgatgaatggtctgttcctcccatctattgcatttataaattgccagcctggatgcttcatttgggctgtctctatgtgggatatttacagtaaacgatcagcatctgctgggatagtccttagtaaggttaggtggctgttagcttagattcatctctgggtttggccagtgacagaattggatttgagtcaagaactgtatttggggaactttccagtggagtacagaagaatgttggtgtttttgagactggtaacgcaaataaaaaaggaacgaacaagaaaacaacagaggtatccaacagatgcaatttcgtttcccatggagtgctgtgcactgcaggttgactccgtatttccttccatcgctatttgttcttagtgaaaaagacctctttgggatttctgagcttaggagtttttccagatcattagccacttatacggagaggacctgctgggcattgtctctccagctttcagcttagccatgctatcccagcagagtcggagaagaaggtgggagaagggagtagaagtgatgattggatgaagtgactgcttatgtaacctggactagaggcagctctctgcaggggagctggtgtgtgttttctcagatctctattattcccatgatatttctatctaaatctgtttactttgattccacacatggttttgagaggcagcaagccatagtagaaagatgtgcttaatttgaaaccaaaaaaaagttggatttgagttccatttttcaatccatttctgtcagtgagctatgtgactttcagcaagtcattctactacttggagcttcagcttcctcttcttataaatgggcataaaatattatgttgcagggttttctcaaagatcaagtgaaataaaatatttagaagctgttcattatcagcaaaacactgcactaatggagaatggtggttttcctaataaaatgggtgctgtagaggtgatgactgcattagagaaacatatatagaaggaaagttttagtttaattgtttgtataagtctgcttggactttttaggcaaaattttttaatttctgtttcatctgatcaaatgtcaattttatgaattaaccagattcacaatgaagacttttggagcatctctttagcataaagtgaagaagcagttacctctgagggaatttaggtcatgaccttggttaggtcaataggataagtgaccctatagcctccttggtgtctcattatatagcgttgtgtctctatccctgttacaagatgataatgcattgcgcttctattctctttagtataagcttccaaagggctctagactcagcagtgaaattgtcgcctgccttgccctgaagtttattctttaattttatcgaccatgggaaatgggaatatgccactttgcatgaaaacagggaaagaagagaagaaggaagagagggaaagaggaggaggaaggaggaggagaataaggaaaataaaagagcaagaagaagatgacaatagccatgaccatcaccaccaccaatagaagtagtagcagtaggaaagcaaaacctttctagataggcctagtatcaaaatggttttagactctccttgggtaccagataaagtcacaaagagcttggtcgtatactcggggatagagcccccacaaaatgttgctagaaccaaagtcctaatggaggtacagccagactgtggggagctaagtaggtcttgccaccaagtacactggaaacctaaaaccagaaatataaacagaaatacttcatagatttggattccccaaaatatgaaggaaaagtgaattataaatttactatgcaaatgaaatgtacaataatgcaatcataaaaatcaagctgacaaagtgtgtggaaaataggttatggctgataggaaattatgagaaggaaaggccaaatggctatatctttctcatttatggttcatacaagagcccttagactgttagttaatgacagttatgtttcagaatcctcaatgcatacaaataagaattttgaaaaactaagatgaagagaatttagctcctgagcatcattcattttatatatatataaattgagtttttattatgtgtcaggaaaagtgctgtgtgttgagggtactgtgaccaaccttggcttgcatagcataaacaggcttgagaggccacgacaattacaaaaacaagaaattaggttttctactcattatgaggtgatgtatatacaactcttgcacaactcctggcatatagtgagctttcaatcatggatagattttgatattattggtactcaaagatttttcttcaactaactcattttaactcaaaaacttgttatattttattttcctaagcaatgaataaactttaatcaggcctctgaaatttgaaatgaagcaatataaaattctaaggagctgggatattactgatttaaagacagctgggtggcacatatactgggttattgcagttatcaagctagctgaataagttctgaatagcagaagctttttagatatatgaatctaaaatgcaacaagcaaggcaaactctaagtgccatcacgtgaatgctggggctcacaggacttaatggcaagcctcccttaacaccatcagttggatgaattatctcattgacccaccgcttacactgctccttgtcattactcctggggtattgttcagtgcaacagggcaagaaataactcattgactccctgaagctatagatgatggattttagatccctagctgtattcagaaggcataggagctcagtgtattgatgggggaattcattagccacccactccacagaatcagtttcttagatcctggtgctgtcactgctgctgttgcaacttgttagtgtttcagggacagacgtcagagggaactgtataactacattagcctcacagatagtaccgacagccagacctgtcatttcctggcctgcgatgacacctctggagcctagaatcacttaaagatatttagataggccctgttgatacgaccaagctaaccttcatcctgaaatcaattcatactcaggatgacaggaaatgagttgtcattaaggctcatattctatttttgagtccttagttaacctcttataattcagtttatttttcctcctccatttctgtaaaatggcaggtaatttaatgacatagattattacttcctacatttactcgggagcatgtgtttcagagaccatcttacattgataccattactatcactttccgctaatattgattgacaaaataccaggtaccagacactgtgcaagaactttgtttacactgtcttataatgagctcatgaccactcagtgaggtagtcactattaatatcctcattttataattggggcaactaaagtttgaagaagctaaagcattttcccaagatagcactactaataaacagctgaatgggctttcaaatgcaattctgacccttaattactattacacccctaatgaaagttttagagtagaaagcatagtggtaataattttaactcaattcatacttatgaaacagcaatttacttgggattgttggagatgtgaagaaagttaatatctagccggggggtagaggggaatgaaaatcatatgtacgaatctttttaaaaacagaatcagctatataccaaagaaggtaaaaatactgctggttgctgagatttttttttttaatgtacatagatgggatgggacagattttgactagtggaatctgaagaaagagcatacctgatgaagataccagcatgagtgtcatatcaaaggaaatacaggatgtgttctcaaattcatgaattcaattggaccgtaatgaatggcataagaaaagaggcaggtaatatggattagcacaaagaacatatgatttaggggcaattggtctctgattcaaggtctagttctgcctccaactagttctgtagcctcggatgaattatttgactactccgtaaaatgcagatggcaataatgccaatttgtagctctgtgaatatttataacctatggaaaaatgcccagtgaattatctggtacatagtggatgttccattaatgatagccatgttcttgtgttttcttcccaggtactttagggacatagtgtagaagatttgagttttataccaatgatcgattgtttctgaaagcaaaaggaagacatttaaagatttttttagaagaagatgaaatgcccagcacttaatttttagggagattattttggctctgttaaaagaatgttgttcagtgggttcaaggaaaacagcagggtcttgagtaagtgtttctagagaaacgtctttaaagacttattctatgatgatgcatataggaaggtaatgaggataaaaccaaagaacagttcagagattgaatcggcaggtgttgtcagcaggttggattaaaaaggagagaactgagaaatgtctagattgggaaggttgtgatttcattaccaaaaacaaaacaggggacagataagtaaaacagataagagtttgactttagtgatgcaaaacataaggcatccaagagccaggctattgaaatttccaattggaaatacatgatgaactcagaggagagataagggctagaggtgggggcctagagaattcacagcttggcagtgacagtggaaggtttaaggagtgctaatgtctcaagggagatgaataggaacttgggaaatatatacatatttttatatatttaaatatatattattttatatatttatacaaatatatataatgtatattaaatatatacatatacaagataaaggaggaaaggaagagaactaaaaaggaaaggctagagggtaggggataacctagatagtgaagttttacagaaatcaaaacaaatgagagacttccaaacacaagttgttccagagctgttttttctatacctgttaggcctctttcatctgaaatcagtttacagagatgtcttcttcatctttattggtatttattatggtgtaatctttgccacttcagtcctcttaccagtattctgcatttcttctctgtcacgggcatcattaactttgagccagaggacccagcatctactcctagagagctgccaccaattagcagttaccctatgtaaatggtagaggtgtagctactattctgccaccctcgtaatattgtgggaaaaatccaatgacagaatgcaagtgagcatgccgtgtcatcattgaaaagtcctacaaaataaataaagtcgtttttatatcaatattggtatacctaccactcagcacagctcttggtacctaaggagatggtgattggagacctggaaatgaagaccaaagagatgctgagatggttgtagtttccaataggaagattagcaaccaggcaagtggcagatcagagcccaaatgtgagtggctcaactgctggaccctgtaagctgttgtggttctcaaatgatgtccttatcttgttcatctctcagctcttggcacctcaccttttggagcttcagtttggaaagggcaattcggatttaaatcatactgcagtttcctaaatagaacaaatcccctgatcctagtgatcatgtgcaatgaggcatggaatctgattacccttatcattatcttagcttggatagctacaaacgttactaaatggttatgaaattatctagccctttattaagtgcaaaaggtagtacttaggttactaaacttttttgaaaataattccgctggctgacttttcatggctaaaaacccatattcttatctgtggagtgtatctttttgtaatcacatctgtgtttgctgtttttttaattgtccaggcagtatgttagccattttgtgtctatcagcccatttggtcctgacaacactgttaaactagtggcattacctctattttatgaagtaaaaaattaagcctaagaggattaagtaaccatttgttaaaggtgttaaggaaagaaaagaggacttagacttaatcattgatatgtttgttttcagtgtcatagatatagatatatactgcttttcataattttctattcaatataatataatatatatgtaatatatgttggatgtgttgaatttagcaggacctgtaatatttatttaaatccacagttaagaatgataaacaggactagagaatggaacacagaattttggctaaagcagcatacataacttaaaataagtcactttctttttggattcaaagaaactcattttacattacattttttgcttcccagtatttgtttttctcaatgacgttaaggcacctaattacccccaagccactttcttaaatactcctatgcaaaatgaaaagattggcctggagactaatctgaggttttgaatgcagtgcggtagaataagtgttttagaggtaactttagttcccaaatctcaataaaaacacttccaaatttagtgtatcaaagaaaagattattggataatgcattctcatctttcggtgtatgataaatgccatatcagaagtcctcaaatactcttgattaaaaacgctaaatgatctcaaataacacaaaaacccatttattcctactggagtcagtatttaattttctatatttgtaatttaaatccagatgtgggtgtcttcacagcgaccatggcctgtcatcccttggtctgttagcttctaatgtctagcagcagagtatagtaaatacttgaaaggtagaccttcacactgaaaatcacatttattgaagtgggagcagattccatttaaattgtcccttacctgatgcctaattcctaaggttaacaggttttcatgtttgctacttatatcagcagtactggagctggtttttttgcatggctaaacagcaaagcttaaattcaatactagagcgtgaaagaggaaaatgagttttggtgtgacgtgtgaatgacgtggttttcctaaataccatgaatgcacaatgaatgatccacaaagcacagccgcctcttaaaagaagacaaaaatctccctgaggtttagttgagaaaagatacaggagcatatagcaaaaactacaacatgatacacttacgtaagatgcaggtgggaagaatagaatttccaaattaaaattagccaggccagcagaaatgagtaacctaatgttatggcttggatccgtgtccccatccaaatgtcctgttcaattgtaatccccagtattggaggtgggccttggagggaggtggttggatcatgggagtggtttttaatggtttagcaccgtccccctagtgctgtccttgtgatagagttctcataagatctggttgtgtaaaagtgtgtagcaccttcccctctctcttcctcttgctccagacatgtaagatgtgctagcttcccctttgcctcctgccatgattgtaagtttcctgaggcctccccagccatgcttcctatataccctatggaaccatgagccaattaaaccccttttcttataaattacccactctcaggtatttctttatatcaatgccagaaaggactaatacacttactttcgtgaaaacaacttttctcttaaccacctcctactgtctgtcaagtgtagttctaagtgcttgggatccaagagtgaaaaggatagacaaactccctgtcctcatggtacttacattctagtgggggagtccttaatgggcacaagcaatcagaacttcaatttgcagaattttgtgaaaatgtgctatcatatatattttattaattaactagttaacaggcagggaggatctccttcaaacttttgttttcatctttgtatttttctttctttgccaaatttccactttaatctctttcattctaatatgctcacgagtcacttaatgaggaggatatgttctgggaaatgccctgccaggcaatcttattgttgtgtgaacatcatagagtgtacttacacaaacctagatgttatagcctactacactcctagctatatggtatagcctattgcatccaggctataaacctgcacagcgtgttcctgtgacgaatactgtaggcaattgtaatgcagtggtatgtgtgtagctaaacatgtctaaataaaaaagcacagtaaaaatgcagtattgtaattttatgggaatgtaacaacccagtgggttctgtttgtccactgcccagatggagccaatttatcaagacaggtgaattgcagtagagaaagagtttaatacatgtagagctggctaaatgggagaccaaagtttgattatcactcaaatcagtctccttgaaaatttggaggctagggtttttccaagacagctcggcaggtaggggtctgggggatgggtgctgctgattggttagggatgcaattatgggatctggaaaatggtccttatgcactgagtctgcttctgggtgggggccacaggactggttgagtcaagagttgtgggcccaggtgggggacatctgattgtcagaagtgcaaaagcctgaaatgacatctcaaaaaggccaatcttagctgctacaattagggatgttcattataggagtaagtgggaaagttgcaaatcttgtgacctccggaataatggttggtaattatttaactctgcctgcatcttagcataattcaggtgtctctcatcctcttaacctggtggctttcattagttttacaaagcagtttagtttttgtgaatggttattatcatttaaactctaaactaaatttctcccaaagttagcttggcccatgcccaggaatgaccaaggtcaaagaagtttggaggttagggcaagatggaattggttagatcaggtctctttcactgtcataattttctcactgttatatattttgcaacagcagtttcaggaccaccttcacatactcagtctatcattaaccaaaatgtcactgtgttgctcatgactgtaatcaaaaaagcacagagagctctctcgctatctggttctatttctaccaccctgacaaccactatagtttgttttcaacaccaaaagaaaataacaaaaaaatagcatcttcaccctcgattctagtttcttttttcttgaaatgactatggccatttctattatttcattttgaaattgtgcagaattccttctgaacatccatctacatttcacagacaacaaattgctaaaaacacctaaacaccactaacctgggggggagaaaaaaaaacaaccaaaaacaaccaaacaaaccaaagaaaacaaatcaaccaaatgaaaacccaccctctctggtggaaagactgcaccatttttggtaaagactttgcaatcctgcctagactggatgactgcctattgccctaacactttccttcctacccccagttatttacaagatcaccccttatggtaacagtattagtacaaatgaggtttttccctttacttaactgaatgctagaagaaacagaatggaaccacatgttccctttgattcacacccaaacactgcaaaacacagagtattcgcttcctttttcaagctgtgtgtgcacattaaacacatgcaaacattggactgaaacagacacagtaagtcagctctaggggaaaactatagaagtctttttattttgtttctctaaatctcaatcttttatttaagctaggtctttgcagagattcaaagaatgatattttgtaatggttctccaaagagcagttagatgtgtctcatccaaatttgtgtatttaccttatcatcacagatactgttctggaactgggaacttagcattagctctcttcttagaaatgactattaatttttgataaaaagaataaaaaacaccacattacataatggatataagagaacatagacggcatgataggaatattctgcctgtgtttccatgaattgcttctttgttaaaaagtgtttggtataaattaggccagtggtgtcccagcactttgggaggccaaggcaggaggattgcttgaggtgaggtgtttggtataaacagtatattaacaaagaattctcctatggtataaaccctaactctagcaggaagatcaaatttctctttgaggcatgcagtctgagctccagtgactctctgcaagagaaaagctgatattgtcacattgtgagtcatagtgactcccaaggatgtatttgtgtggatgtggttggtcagaaggctttgtgtgcactgtgacatctttatgctgcagatgccaagatcacagggtccacacagagcagttcatttcacacagtgggaaatgatgcgtgtgtgtgtgtgggtgggtgtgtgtgtgtgttttaaaaaacctaaacagagcaacactgttctgtgcactcaaactctacagctaaccgccaagggccatcttataaatttggacattgaattgctaaaatttgaaaacacagccactcctattcacactctaccatctggaaataaaccctaagtcactgtgggtgtccatatggaagtcactgttctgcttccttttatcttcatggtagttcaaggttcgatttcctcctagggagactttctgttgttcccattgagccagctctgctgtccccactggtcacgaaccggatcagtacatggagattcctgagcatatgcagggcagcggcatgagagcatctaaaatagagtcattcccattgccccagcacatccttccttcctacattcctgggagaaaagagcagaaacaaaggcttttctttcttctctcttttggatgtttggtgatttgcatacagaagttaactcacttcatctactggattccaatcattcccttcctggttcctgatcttagagtacagggtgcttcttgccttccccttgtcaatataagggctttagaaaacgtgcccagctggtattctttaaacctcctccaacgcacaaatatatttttaaatgcagatatttcatatacaagttgatatttctagtttctttttgaaaatcggaaggtttaactctactgggccagtgttattcatagcattggtcaactggagctgaggagccattgccatttttatggatattcttttaagccccccaatctccaccactccctgtcacctcactcagcttcatccatctgcctgacccctggagacatttgattttgtgcttcctctcacacagaacttgtgttcacaatttggggtcataccttcacatattatatgtaaacagcactctggaacgttttcaaagtcacagctattttaggtatttagtttagaagaggttagaagttgacttttacattagtatcttaaaggaatatatttgcctgctcagaaacatctggggcccacatattcagatctttcgtacatataatttgctatatagcataacacattgaatgattttgactcagtagctcgacttattttttgtgttcttttaaaatctttcatattaagcatagaattgtaatttattgatgaatattttattttctgagaaaagttggttattattcttaaaatacattacctataatgttcatgtttcctatgttttaatatataatattacaatattgatgtgtcgtgattttttttggttgttctctaattaggggtctttatatgaatctctgattacttagcagttctctgaagggggcagtctttcagagatgcatttaagagctctgaattctgttaagaatattaaggaacacaatttttaatctttactttttactccagggctttgggctgtctgtatcaaaatgcttcagatacttcctctagggattgctttgcctgttccatccttaagagagtaaagaatttcttctccccaccaccccccaactcctgacaatttcagctaaatttttttcttccattgctttaggccattgcttcaagttatatcaccttctgagactatgaataattctttcccttcaattatattgttaccttgaaggtatttataggctgtgatcaaggcccctggagtcactgctttggcagactttataaatttagctcttaccacttctcctcacattttttatcttccagcctttgtagcactccttttgtgtgtgtgcgtgcctatctgtgtagcttctctgatattttaatatccttcctaaactagggaggtcagaatagcacatcatattccaggtattactgtgagtatcagattttagagagtgaaatcaagggagaggattaccttgaaattgaacttaatctattttgtgactcagaaaaatagacaaaatggtagaaaaagctaacggggcactgtcaacatgttttcatatattttaacgtactgttagagcaatcctggaagcttaagggggaaatgatgatttttcttagagagaattctggcttccattagatgcttgaacgtgtcctttagagtaagattttctttacaaatccaggcttcaaatatggctatgtaataagatgggttttttccatagtacatgagctcttaaatctgtattattgttattattattattattaatattatcagacctgtctttgtggcttaaaattaagaaacatcattaaacatttaattttacaatgaagaaaacaaattgctacgtaaaccatcttgctactagctttaagctctagtccaggtcattctgcattttgtcaatatagtaaattgagtaacagcctctgagggccctgcaaagagccaaggcccaatttaactccctagtgccagggtctccaaatgtttttggttgtctatacatactagaaaaaaattaactctgcaccaattaaaaatatgtatatatgtatgtagaatacacacattgcttatattatcacacatacagaaacatcaggcattttaaaagataagattagatacatatatatcccagtattattccctgaagttcccatgaaccaaccttggcacccctgtggatgcccaccccaacttggagaccactgctgtggtgggaaaaccatggtgacaaacggagccaccaccctcagcagttcccaggaggaaccccagtatcaatggttatgtactgcagagcctataagcgaatatttagttcagacactcattttagatatgaagatatggaggtgcagtgacttacctacctatggttacagagttggatgatgagaaagctgggtgtaaaatgccagccttctaatttatcagatttcaacacatgcagaaaatacatagtgttctgttttagctggaatctcaggaaaatggggactgaggtcctgaatgaatgatgaagaaggagagggtgaatcaatttccaatcggtggtcttaaaggtgaaatattgttagcctaagtaatctctactcttttgtgtcccttctattaaactctctttacaggttctctctctctctctctctctctctctctctctctctctctctctctcccacacacacacaccccaagataaaatccaaagcttctgattcaatagccaacctcttcagcaagaagagcaaaggttctgcagccagattgcctgggttcaaatcctgatcctatcactgaatagcagactttaggcaaattatttatctatgactcagtttcctcatccgttgaaattggggataaaaaagttccataggggttgatgtgagcattaaatgacacctgtaaagcactcggctcactgcctgatcccacgctaatggccctttatatgttagctatttttattattttattctaattcttcctaaaagcttaaagcacagtccttcatatcactgcatcgcatttcattttgtaacatgttcttgtgctacatgtttcaccatgtgctacatggtgaaaggcattttcctacccgctttacaaaaacagacaccgaggcccatgtttagggccaaaatcagtgctgaatgccaggacagactcccaattcagtgtctcgtatcaaactgcatttcctttcaagatgaaaattgttactcaaaaccctatgcagctgggcgggaacacagattccatggtttcctttttcttcctgtttccccaaagcaaagcatctcctctctttgcatgggggatctatccctccagaagtctacccagcctgaggataatggcagctgcagggttacaggggtaactgtccatctgtctgaattctcagttgtgtgagagcctgtgttacaaccttagtagcttctgcacctcactagcttttcccactcccttggagtgcttccattttctccagctttcggtatcagggagtgttattaaatgataaggagctggctggctggttgtgtattgtgagaggctgagaaacaatgagtgttacaacacattagattgcatgttagctctgattttgggaactttgtatcacagagctcatcatgcaacaggactgcatctgggatactgcctcccttccccagagggttattaatgggccttcatacctgggaggacagattacaggagagatgtgataattagagatacttcactgatcataagcaggcccccgagcaccaagggctagcagctgtgttacacatatgaggcaagctccatgctccagagacaaaagtgaagtagaatttgctgcagtgaccttacctaaaagaggtcatctcaaaaatggtcacccatggacattgattggcaattggtttgaatagagaaagagtgttctgagctgaggatcagaagacctgagtttcatttctagttctgccatcatagagctatagggtcttgatgaagagtcacttaacttgtgacagtttttttatataagaaaaatgggagctacatatgtcttacttatcacaagagattgcaactcaaatacttcttcttccaaggtagtagggtggcaacaagagtgtgtgtgtgttctgacgataaaggaaatataagaatattttgaagcaaaagaaggagccagtacaaaggcagaaattgacaacgcatgggagcagaagtggataaaattaaccaagctggggcagaagaaggcagggaagggtgagagaaaaacagtagacggcttaatgtcatcaccaccacaacaaatgatggtgataacttgatgctggtgatgatttggagctcttcctatggagtaagaaagaatgcaagaattgggtcattgaccagaaactctgaggaggaaattaaagaaaattcatatctaggtgtcttaaacttctcagtaaagaaagttttaagctcatcaatcaacaggggcaggggtagatttagggacttgaagaaagtataagatttttagaatgatctctttgggggatcccaaaataagtcaacaaggcatcttttcaatgttgtcttgatctcggagtcagaacaacttgggtttcaacctagctctatcttttttcctcctagagcacccttaagcagatagatgcccataccttacccatcagtactttagggttataatctatatcttgcaggcatgttatgaaaattaaatatgatcacatatgcagtgtgcataacatcatgtttggcacatagtagcctgtcattattttggaaaagtgaccataatgaaagagaatgcatcaaatatataggattgttaaataacaatgtccaatttagaagctgagttgtgttggcctatctgcttgcaccaagattaaataatattctttacaggtgtctacacctttttctctccaaggcatgtcttcagcctcagtgctttcatggctcatattttctcctctcatgctttcctacctgctcatatgatgaaccacatagaggaggtgattctccgaggatttataatgtgtttcctgtgctcctgaattggtgccaatggcacaccaatccagtcgggtgggcctcaaggcacaccttgctcctgactgagaaggaaaaaatctttgtggagtttgcacaggtataccaagtaattgagcatttgcattagtatggaaccacctactacagacaccgggctcgtttcactcaaaggatagcctagaataagcatgaaggacctcctttcagaatcttgtttatgtaaagcccttcttggatttcctctttattatattttacataattgatcacaaatgtgaacatctatggaaatgagttggagtataggcgataattaacctggaagggaagaaaacccttcaccagaagcaaatagatacccctgcaaatatctggtaatttcggccgggcgtggtggctcacacctgtagtcccagcactttgggaggctgagatgggcggatcacgagctcaggagatcaagaccatcctggctaacacgttgaaactccacctctactaaaaatacaaaaaattagccgggcatggtggcaggcacctgtagtcccagctactcgggaggctgaggcaggagaatggcgtgaacctgggaggcagagcttgcagtgagccgagatcacgccactgcactccagcgtgggggacagagcaatactccatctcaaaaaaaaaaaaaaaaaaaaaatctggtaatttctctttcattagaaagctccaagtgaggtacaaactcaattcaaatattctatgagaataaaaacaggcttatacccaaagataggcaataacaaatgctggtgataacatggagaaaagggaaccactgaacactgttggttggaatgtaaattagtacaatcactatagagaacagtttggaggttcctcaaaaactaaaaaattgagctaccatatgatctatcaatcccactgctgggtaaatacccaaaagaaagaaaatcagtatatcaaagagatatctgcagtcctatgtttgttgcagcacttttcacaatagctaatgaatggaagcaacctaagtgtccattaacagatgaatggatagaaaaaatgtggtacatatacacaatggagtactattcagtcataaaaaaagaataagatccagtcatttgcaatcatatggctggaactagagaacattatgttaagtgaaataagccaagcacagagagacaaatatcatacgttcttacatatttgtgggatctgaaaatcaaaacaattgaactcatgggcatagagaatagaaggatggttaccagaggctgggaagggaagtgggggttgggggaggtgggggtggttaatgagtattaaaaaaaaaatagaaggaatgaataaaacttatctggtagcacaacagggtgactgtagtcgataataactcatctgtacattttaaagtaaagagtataattggattgtttgcaactcaatggataaatgtttgaggggatggatactgcattcttcatgatgtgattattgcacattgcatgcctgtatcaaaacatctcacatacttcataaatatatacacctactatgtacccacaaatttaaaaaaaatgaataaaaacatccttcaaacgaagtggctattttgttgcaaaaaataactattacttctcaagcactgactgagtgccagggtgtatatgtatgtgagtatgtgcgtgtgtgtgttttgttctgttttttctcttgtaaatccgtcaaagattgcaaaggtaggaactattatcctgatttttcaagtcagaatccaaaatttagtgaggttaagtgacttgccaccatgcttgctgctcacaagtagctgaggcaaaatttgaatccattttgcctggagcccaagcccaggttctttctcctaactgggatgtcctgatgcctacacaatctgctcagtgaattactcagcctccatgtttttctattctatggcacccctacgtcatactagccactagagtgaaaagtgataagatgaaaccaagagattgtcttatcagcttctccattcacatgtcttaaatgatttctacctttactaacaagagaaaaatccaggtacattctggggaaaccattagtgcttagttggtaaaatcttgagacttttatcttactagtagaccctcaacatttttccaaagaggcactaatgtaccctgtaaagaaatgacatttttcgtctcaaaaaaaagcaaaaacaaaaaagaaatggctacttttcaccctaaaataaaaaagtgtgtgtgtgtgtgtgagagaaagagagagagagagagagaatgaatctatctccaaatgccaatgagcatgatggactagtggcaagactttctacagaatatgtaatttggtttaggcagggcaatctcctttgtatgaagtaaatagtaaattcagttacagtatatataaacattaagaagaatcttcttctgtttaaatattgcttcttaaaatttgttttgctatttaaaaaattcattttgaagttacaagtgtctctcctaaggagacaattctctgacaaacataaccaactggcaattacaaatcataattgtgactcagaccaatattaagtgagcaccttcctgctttctcgtagatgaatgtctataagttgttagtgcacatactgaactagaaagcccacatcaggaaggtactgctctttttttgttactgttaaatttgcttggccaactcagaatgaatatccagatttctcaactcttgagttagtggatatataaactccaaaaaaattaattaaaattgaagtttaaattttaatactgagaaaaatagttgattagctagaaaaatcaccctaaacataattatatgtatcagtaagtcaaggaaaaaattaaatttgtcaataggtccctattctccagtgctgtcttttcaaagttactttgcaaggtattcagttttagtgctaacgtatcaatcttttttttttggtgggcgggggatgggggcagggtctcactctgttgcccaggctggagtgcagtggcgccatctcgccttaccacaacccctgtcacccaggttcaagtgattctcctgccttagcctcttgagtagctgggattacaggcacgtgctaccatgcccagctaacttttgtacctttagtaaagatgggttttcgccgtgttggccaggatggtctcgaactccagacctcaatgatccacctgccttgtcctcccaaagtgctgggattacaggggttagccaccatgcctggctaatgtatcattttctagaatacatttatcaatgaaattttcaaagaaccttattggtatggtgaattatgtaaagtctcagaagattacttttgactttccacggccagatactcttgactcacttctatcaatcatgcattggaaatactctgacatcgtcaattctaccgtgatctactcaagcatctcacctgtttccttccagaaagcatgttttaatgttggagattcattggctagtaaatgtatagtgtcttaaatgatgtcaaatgaagaaatgccaaaaacatgcccaacaggaacagcaaagtatttaccttcatgtgtaaaatgccagtgtgagatagcccaatgtgatattgaactggatcaatggtggggtgccagcacatgaggaatcgacattaattcaagttgggacacagaagttggcattgtgaagatttttaaattctaggactaaatggatgatccactgggaggcaatgtccagacagatcaataccacacaaaacgttaattgcttttcttggtgaatcctaagaaagtgctggggctttagggaaattgagagagatttcttttcttccccctccacaaaaggtaattaatgagtacaacagacaattcaaagcaagaaaatagaatctgaaagcttgaaagccatacattcagaatccatttagagatttacagaagggctttagcccagaacagtgcctacaggagctacagtggtgacagtgtctccttgatagatgcatcctggaatcttctactgggcaagcatccaaaaatatttgaacaaatgaggtatgccttccagcatagctgggtagttagaaaagagtcaaacatatagaaaaaaagcatagtgactgaagtcatcttaaagctagtttacaaatgtagtctgaaatacactctatcacgggatgaataggtatggattttattccaactatgatctactgtgctttctgggactgtaaaaagtgactacaccatccattaataatatataggaaggcagtttgggaatgtcaacccaaagcctcttcgtaccttgaaattcccatgcaatttggttacacagagtatatcattactcaggttaatattataagacaagtattagcattatgtttgaacaaaggttttcacaaggtctatattaactttacaaaggttctgctgtatactgaatgacaaaggctgtcacagtagcgaccaatttgttccaatttgcttacttctccagatctctctgtcagactttaagttccttgaatatagggtcctagtcttcttgcccatccttgtatacatggtaggtgttccatcaatgtttcttgaatgaatgtataaaaagtgtattttaattgaaatcttaacaagtatgcattaaatgtatagttggtgcttggtactaattctctcaccagtttattgaaatttgactatatttgagcttgaaatggtatacctacagatatagatcattaaaaccaaacaaaaccctttctttatgatatcaagagatttgcctcctaacataaaaatgaataatcactgtctaccctaatggattagactttcttcattagcctcctgtttcttctgagaaatggctacattttcagaaactctgactcctaaagggggtcagtaactctgggaagactatttctattacgtgaaaatttcaaataatctcctagaaacttgaaaactggttatacacagaaagcaaaagaggtgaaaagtgagttgcagtttcattaaacatggtcatcctccaacaccgtctttcttaccagccttgcatgaaacgtcattaagatgcatcttttatgcaagggaccaaaaagggtactacttttaaaatatagcaaaaacaggggttgcagttgcccttttattgagggtcagtttatatatgtagtctgatatatatttcatccagaaatatagttttttaaactttttatcgtgaaataattttagatttgcagaaaagttgtaaagattatatagtttctttaaacccttcactgagcttccactaacgttaaaatattatgtaaccgtgatacatggtttgaaactaagaaattaacatctgtacaatacaatttgctcagataatcccagtttttccactactgtcctttgtatgtgtcagaatccaatccaggataccacattttatgtagctgtcctgtctccttagtttcttctaatttgtgataatctacaaatactttttaattgaaagaattatctaaacgtatatttgtcagatcaataccgtcctttctatctttcctttctccactgaacttgggcgtcagtctctttcttggctactaactctaatttatgcattggatattttactactttgggctcattattttaaaaatctgcaagcagacacagtagtctaggactgttcctgaggctggagggccagggtatagcatgtgcgcaggccaccaaggccagccttgtcattgattctgctttgttaccaagcaactgagatcgctcccactaaagaaaaagaagcaccacttccacttcaaaggtaaatgtgttgaaaaaagaacagaattgacacagcttcctttatcccttaggtacaaggatgccatgcctagtcagagttctgaattcaggttctcaaagcaggaacagggagatgcagcagctgcagttgggaactcttctttctttctacattttttttttctttttgaaagtccacatctctatcaatccagaatcctaattacatatgatataaagggccctcaaaagacccattacccctgttaaagtatgtaaattcaggggcaaattatatgaataatggctaacatttattgagcgcttattacatgtcaggcactgttcttctaagcattttacatttaatccttacaacaaccctgtgatgtaggactgattattaatactattttacagataagaaaactgaaatacacaatagataggaaaattgctcaaagttgcacagctagtaattgaataatcttccaaaatcttttttatttaggtaatagtatttttgataaataatttatatattttatgaagacctttacaatgatggtgttattccatttccaccctagattaaattagcatcttgagaaaaagccataaacccagtgatcaaagtcgatggtatttattttatgtttaaaaggtgtcatctctatcgagtagtcaagtgctaaaaaaaaaaaacaaaaaacaaaaaaacaaaaaatccagtcaacagaaacttaaacacttgagggcaaacattgagcaatgttggggttttgttaccttgcactaattttgggtttaagaagggaaggaaatgatgttcgtaatccagtgttctggaaggaggagtgcttttggtagattaatttacaaagttttctgctgacaaaagaaagggaaaggaaaaaaatcagataataattccctttacaggcctaatttgaacttaattctctctctctctctctctctctcacacacacacacacacagacacacacacacacacacacgacaactgtgagctgtaaatccatggtcatctagttactagcgcagtaagagcagttgtctgatctgatcaaagagtgtcatgctccaaaaaatctgatctgtggtgaaaatagattccccctggatactatccagggattagatattttcagagaccaaaaatacagtgaagtgccctcagcaagatagaacacagtgtagtcattcttggtgaattggaaggattttgccgcagggctgtcattatgaacatcagtgatcattgtaagaatatggaaaagtgctagtgaataggagtcccaattacagaacactgggtgatacagcctttgctataattatagtgtgtttagattgatgggcctaatgagcagtgttccttaatctaaatgttgattttggagcgagttaaaattagaggtaaaactgtgatagtaagtttgtttactagattgactatgtggctccacgtagaattcagattagttcaactaacacttcctcagcaccaaacccttgtcaggccttgggctaggtcctggagacccaaaagcagatgaagtcctcagggagttacagcccagcatgggagagggcatttcaacggcattagtaatagcagtggatatgaattgagcctttgccagatgctaaacacttgttctaaaccctctgcgggtattaatccatttactcactccaccataaccccacaaagttgggactaggtgagaggggagccaacaggcctggaagactacagtaacttttccaagcttatatgtgtgataagtggcagagcagagcttaaacctggtccggaccttgggttcttaactctaaccttagtattccagagaagatttcaatatacagtagttcactgtcctgggaccaagaagaggtacaattaaccatgttgcctatgctgctggtgatgaagccagaacgtaaacagaatgatttatcctcactcctttgttcgtgaacaaaggaaccataatcccccatgaaccattctggcctctttactatcctccagacaggttgatcttgtttctacctcagagcctttgctcttgttgacctgagtgtcccatcccagataccgttgtatggcccttccactcaatcctttcccacctccctccaaatgttaccttattaatgaagacttccctagctcattctattttatctgcctttcttccttatcccacctccctgcagttccttctcccttaccctgccttactttttcccacagattttaccattagcaatactattaatttctttttacttgggtttttgttggtttgtgtgtctgcctccccacactagaacacaggctcccaggggttagtgactttttaaatattgtttgtcactgaatttccaatgcctaaaataggacctgaccacatctgagtttaatatatacttttagatttagtgaattaaaaagccagaatgaggctgggcacggtggctcacgcctgtaatcccagcactttgggaggccgaggtgggtggatcacgaggtcaggagctcgagaccagcctggccaacatagtgaaaccccgtctctactaaaatacaaaaattaactgggcatagtggtgcgcccctgtagtcccagctacttggaaggctgaggcaagagaatcacttgaacccaggatgcagaggttgtggtgagccgagatcatgccactgcactccagcctaggcaacagagcgagattctgtctcagaaaacaaacaaacaaacaaacaaaaaaaaccaggaagaacatattccaaagtgtttaaaatagttatatctgagcgtcggaattatactattttaaatacacttttaccaagtttcctataatgagcatgcgttctatgagaaaagggctaaaaatagatgaaagttaaacattagtcactaattcatctcataaacctacttactcctgggaactattaacttctgtgttattattgcacattgggtttttatacatggtagatgctattatcgaggatcccttggggaaggtttgtgtatgaaatgatcatttctttcctgcttactccagattgagattgccagccttgactcacctgagcgggagactcacatgtgagactgcccgtgtgaagagcttccactgtgatacccagtaggcatctgaaaagcatcaggtccaaaatggaattcttgatcccccaacctgctccttacagagtgatccttgtctcagtaattccaacatccatcagttgtgtgatccaaaaacttagaactcatacctccctttcctcatgcccacagtttgttcatacaaagttctatagaatctacctcccgaatacattcaaaattagaccacttctcactgcaactcaataccatgctcctcacttccatctctactactcgaagccactcgagtcatctcttacctgaattgctgcaagcactttccagctggtatgtttgtttccaatcttttatttcattattttttaagagacagggtcttgctctgtgtcccatgctggagtgcagtggcacaatcatagctcactacagcctcaaactcctagagtcaagtgatgctcctgtctcagcctcttgagtagttgggactacaggcacacaccattatgcccagttaacttttttctttctatagaaatggaggtctcactatgttgctcagggtggtcttgaattcctctttctagttttctctgacactctcactccctgccaatcttttctcctcaaagaagccagaatggtattttttaaaaaatataatcagcctttattaccaaccacccccaattaaaatcctcatgtagctttatattatattaccaatccaatctaagtgcattaccaaagctttgaagaccctgtttgatcctacctctcaataccctccagaacatcctcctcgtctaccactttcctccacatctaccacaccctgggctgtttgtcaaacatgcctggtttgttctagctttgagcttttctctgtctgggagacttcttccttcagcaccagagctgacttttccttgttttatacatagtgagatgtcagctcagatgttacctcctcaaaatgatctttttgatcatcataacttagtaagctctctccctccaccagtcacactgtcccacatctcttcattctgtccagtattagtctgtaattaccatgtgcttacatgtttaatatctgcctcacttttgaatgaaagtatcaaggggaaaaggaatgtgactgtttaaatcactgctataacttcagtatccaaaacagtgcctggctcatagtgaacccttcataaatagtcactgaatgaaggaataaaggattggagcaatgaatgtttttgtgacatctagatgaaaattagagatgataaccggtgcaattttgatcatctatctcccttcataccagccaccctaatctaggggactagaataccgaaagaaaatttgcttctacgaacaaggtaatgtcatgatatggactgactcatttatttgttcatttgttcattcattccttcatcattcttcactcatcagacatgtagtgaggactttctttatattaggccccctgtgtttggttttctgtcagttatcttagggtcgtgtgtgtgtgtgtgtgtgtgtgtgtgtgtgtgtgttaaaggacgaataaagtaaataaactaatgcaatgtaagaagtgttgtggttttttagtaaaggttataaatctagacttatgtgcgtattgttttgagaatacaaagaaaggtgcttctgtttctgtttatgggaagtcactttacagacatttatctttaagtcatgatagatgaatttctcatatgggcagttttcctaaatctgagttttagcataatgagatctggagaaaaagaaggcaaaaaaaaaaaaaaaaaaaacccataggaaatgatacagagactaatgatcatttacccaaataaaacagataccattcaaagttagacactgagcctctggtaatccctgttcttctccttcatcttgagcgagggatactgaaaaagactgggctggctactgtttaatcagggaatgatgaatacttttcattagcccaagaaaagttagtttctattccagaaatattttgtaaagaccagttaaaattattaactattatgcatcacttgtcaactataggaagcattactgcaacctctccatagatgattagaataattgctgtcctttcatctttcccatctaacaatactcacccagtacctcccactttcgtttgtgtcttagtatgctgcatgtatctgctttgctaagagaacatcaaggcttggcataattgggctatttccctgtcatactggtttgcttctaaatctgcctcctctgtgggttgcagtgaggtcaatcagatgcagtcaaatggcagagaagatattaaaagtacatatatcctagaactaaatatacaccatctgtgaacttcagttacaaagggaaacttctcttaatatgaccttaggtaaagccattggcagttttattgtatctgtcagcaatcaccaatagctttgattaacaacatgactaatacataagttatgttggtctctttttttcataaataataagagatagggtttctaccaacacaacatttctcatacttgcctgatcattagaccaactgtggcacctgagaaaaatatgccacagacctactaaatcaaaagttccaacaggcctagggatctgtatagttcataaaaactccaggggatttgattatcaggcgaagtttggggagctttgtatgaataatattcaatgaattgtttgtatgtctgtccgatgctttccagactgggttaatgcctgggtctctttctttaattaagctttgattaagatgctcccagcaaatcccacactgaacatttccattgccccctccctcccccgcttctactatgagagaccgagatccatgtgaggtattctgtgatgaagatcttgttctgtttttattattaagcgtacatcttccccttttctgatattaccactatgcatcatcagttaagctgtcaccaacctgacctctgaggcattggaatcattcacttgatgaagcttactttggcataagctaagggttaggaaaaccaacagatttctaaaatattgtgcatggaagggccactggaagtcctccatcacagcctgatagctacaaaaatgagggaacaaaggcccttgagggacttgccaaagtcaaatagtcaattacagtgagagtttggactaaatctcctggttccaattattacattcttcctatgacaccattccctgattcctacaaccaaattagcctcctctttgagctttagttttccctctaggaaaaaaaaaaaaagcatgttagacgaggtcagggactctaaaactgagaccctaggttcagttaaaatgctgggaaggctactgtgataggggtggatgtcggagaggaaggacagaggtggggcttcccctagttatatttttatctgattgggatattgaaattatattaagaatttatttggaaaagccacttctgttactttttaaaaaaagatgtagaggcacaaggctagatgttgatccttgagtgcagatctgattcttacatttggagatccttagaaaagaagtctgtgaaggcaagcatttgtccttttttgtcataaaacctgattcttgggtattcagtgaatgacactcattgaccaactgcaggtctggcatgatcatcacaaagaattggcactttgaaagtgagagaacagtgggaagagaaattcttaggaagcaagctatcttttctaatcctctttaaaaggccaaaatgttcacaactttcccctaaaacagaaaggtgacattgctccttaagcagcagtatcatgcatgctgtcctctgccttcctaagaagtgcagacagagggcagaccctccgagtgaagtacctttttttcttatttgagcctgctctgcattgagggagagtttgacacacctctttagggttctgagaatagttaacagctctaagaaagagatttttgttcataagaaaaaacaagagaaactggaagcagttctcattcatattctctctctcgccacaccccccaccccacctcctcccgcctctccctctccctcttcctctctctccctctcttcagtatctaatgtaaacccaggctttctttatgttctgtgcagttggcctgagttctcttctgttttggtcaagattcaagtggaaaagacctgagcctgtgtctgcctcctttctcctaattttggtttctaatgttttacccaagaagggactagacctttgtttccctactcctttatcatagcatgctggttctcagaccttttctgcacactgctaacatccttctcacctttctttgcttggctttttttttcactgcaagctctcccatgttcatttctcatttgccatcagatttagagtaactggcttatggcatcaaagaatgaatcagatgggagcagctaagtaaactgaatgaagctgcttcctttctcttttcccatccacaaatgataaaatagcctgcccagccaagtgacgtggcattcaggggttatggtggcttggccatttgtttaagtttgcttatttgcagtcacagttctttagtatttcagtgatttggttatcactcaacagtgcacacatttcttctataaaatttgatagttacttatctatctctgatttttccctctgtgttttattatatctagtttaatttttcccctttgttgatttctgttttgtatatcttgttgcgggatatacatggaagggagacgagtttccaaagataatatagatcccagtttgcctgtaaattgataacaccatttggaaacaaatcttaaaacctcactgacacagcataaatagaatttacagatcttcttgaagcaaatccaaatctccagactctactttctccattctcccccactcatcctaaccttcacgtacagggaccgcgttaccaagtgagccaactagactctttcacacctctctgcctctgcacatgctgttccttggccagaaatgccttttttttctgctttacctgacacatttagattagtcttttaagacctaatagaaatgtcaagtgctctgatatgccttcccagatgcccatgagcaaagtcagatgttctgccttctgttcccctatggtactttactgatgtccctgtgacagcttcctgccactccagcccactcagttgggagaacttcaagaggtgaacaaagttttattcctttttggattcccagtgtctcatagaccttctgggacatatggcacattcagtctagctgaatgaggtgatgaatcaatccacttactctctccagtgcctgaaacttctcaaggagcttgtgctctcctttgctcctctcttttcaaccaatctgaaaatgcttttaaaagataatgtctgttttccagtgcagtcttctcacttggcatgtaatttctccatttttatttcctttgtgaatatcaaggtacaatttccatagctaccagtctaacctggaatcttttcatctcagttttggagttccacaacagtgtcctggtggatctatcttctatatattcctactataatgtacactcttaccaggtaccaatcagttgtttcaaaccacatttctactaaatgacctctctgaagtgattctgaactggcttccctattagatgaagaccaaacctctactctaagcacttaagacaaatggttgcattcatctcaatgctccttactcctcaatattatccattacatttttttgagacagattgttattctctgacagattgttattccttcatcgtccaaaaggagtcctcactttgcttagactggaacacaaaattttatctattttaatgttccgtcatataattataattatattctgttatctattccaaattttcagaattttatctattgcaaattttaagtattccaagttataaacttacgtcttccaaaaagactaccaggattaaaccaaccactgaatcatcatttcattacttcatattactacaagttagatttgggacactgtaatattttagccctgattttgccctttttatagtgtccatagataatttaacttctttgtataaacttccattataaaatgaagttttttatatatatatatgtatatatatatatatatataaaacattacacatttaggacatttcatgatgaaataaaagtgtttcaaatagaaaatgatggtttatttgggtttataaatcaagaattctcaagagggtatgaaacccacttctcccttatcaactctagggattttctgtagttttgaaatttgaaaagcataaagtaaaattattatcattttgatttgcttgtagtcataatatttaattcacttagaaatatcaaataacattaaaagaaaggtgtgaaaatggctgcgctcagtggctcacacttgtaatcccagcactttgggaggcccaggtgggcagatcacctgaggtcaggagtttgagaccagcctgaacaacatggcgaaagcccatctctactaaaaatacaaaaattagccaggtgtggtggtgcatgcctgtaatcccagctactggggaggccgaggcaggagaatcgcttgaacttaggaggtgaaggttgcagtgagccaagatcatgccgttgctctccagcctgggcaacaagagtgaaactccatctcaaaaaaaaaaaaaaaaggtgtgaaaaatagggtagaccacgtgtgctgttacagtagaccccaaacataaaagatgtttatctcactcatatacacagtccaatatggttccagttggtgagggttagggttgtcattctgggagttggccagtagagatgctaccatcttcagcatgtcttccaaaagcttcctggtatcaaaatccaattgttgaaagcagagagaacatgaataagttcatatggaaggattttatggactaagactaaaagtagtccacattaattcagttcacattccactaaccacatggacacccctaacttcattggtgactaagaaatgtagtctagactattcccaggaataagaggaaatggttatactggagaactagatgtctaatatatattaccttacatagttatcaaagtcatttttagtttggacatggtctttactaatgggttgcaaatgctctttatgcagatgttttatgttttatattactttcctatgcccaacagcataaaatatagaagtctggatggattaggcacttgatgtgtgtattagcttttgattgctatgtaacaaatgaccacaatgttagtggcataaaacaacatatgtttattgtgtcacagtttctgtgggtcaggagtctaggcacagtgtgactaggtccccagcaaggctgtaatccagtcgttgatcaagactgtatttctcatctaaagactcaacaggggaagggtctgcttccaagctagctcaggttgttgtcagattttactttcttgtggcagcatgattctttgaagaatcaagaattcatggttgcttgcttcttcaaagccagcaacagagactaaatcaaatctagccagatggtcttatataatgtaagataactacaggagtgacatcccaacacctttgtaatattggttaagcaaattacaggtctcatatacattcaaggggaggggattttacaaaagaatgactaccaagaagcaggatcactggagcctgtccaccacagtaaatgactgaaaaaatctgggtattccagagaactaccactttacctgaacatagctctttacacaaaactacacagaattatgaaagatctcaagagaaaagtgttccttattgccaagagctggttattatgctagtaaaatcagcagtgctcaggaacaatatttgctaagtttcacagttatcaaccttaacccacacaatcatctttagaattggatccagaacaagatgggaccatcttaaacctggtacattctcataaggttcattctcataagaccctaaagccttcattatatggcatttttgaaactcctttgtcattttaaatttttgtctttcctagctcccttttcctctactattctatctaacttaggcagcattgaatttcatttttttttctccttagtctttctgtttgacattttcccttctagcttcatttgtcctttaagacaaccccataacctttcatctaggggaaagaaatctaaaagaaagctctagaatgagattttagttgacatattcaatttgctttagaggggcatcacccatacctcttcttccactagtgagatctcctgagaggtgaaaatatgagagaatcagagctgcttatttatatatcaactatggaaagatctttcctgcctaatctgacctcttctttgaaactccaaaagtgactttttgtggttaattcttccaggatatctatgatgcagtcccacagatattaaaggttcagggcatcaaactgaaagatataacagctctaatagacagagtcacatttctaaaaaggaaaaccaaattctgaagatattttctggctctgtgaacagctaaaaatacaaggataatcgttcctatagtcctggacttttaacacggaagctaacttggaaggaaaaatgacactgagctataggaagagaagaatagaacagacttcagtgaaatcggccgcttttcttttcaaggcacttattcctagattagctcatctatctttaagtttcatatgatttttactatttggcatgacttaaaactaccaagttggtgaaaggtacataggaactctctgtactattttgcaacttctatgtgtctaaaattattttaaaataaaaggtagcaaacatacaaacaaaacaaattattgagctgggaagtgttccccttgcaaaagtctagcaactggggtaaaattgtttctttgaatacaaatgcctagtctctgattaataaaataccaggaagaggaaaagaaggagctgaagaaagagagaaagaaatagagaaatggggatttccagttgctgtagatcttgagtaggcaggaccttagcacatggtatctaggtgcatattgcctgtcacttttcaattatctttgctggccctgcctcaatcaaagcccaaaccataccccaagggcactctgcatcgttgaatttatagatgagatctttcttttgggataaagagctattctcaacttgactattataccttggccttcattccctaaagaaaatgggcagggaggcttgcagacagaagtatatagtgtggaaaatgaaccacctcttttgactctttgcaagatttgtgatgtcctactgggatgcctgggcccaggcacattcaccttgattctacatcagagacttctgtgtcttctttctcatagtatgggttattgggttgagcaaatactttgtcatcagtgtgtcttatggagtaattgagagccttggatttgaactcatatctatttgggctctattttgggctgtgtcacttatgaactgcatgaccttgagcaaatcactgaaactctctacagtccagattcgtaatctattaaatggggctaataatacctcatgcatatggctgccaacgggagttagtgaaataatgtacatgaaatatttaacactaaacttggtgcctaatgtatcttcagtaaatgataactattgtcatagtcatcattgcttttatacttttcggcttccagtgatttccagtgactacagccctaaggccattgggggatatcttttttataactgaattttctttataaaacaataactgattttttttttttttttaagacagagtctcgctcttcttgcccaggttggagtgcagtggcacgatcttggctcactgcaaccttcatctcccgggtacaagtgattctcctgcctcagcctcccaagtaactgggattacaggtgcctgctaccacgcccggctagtttttttgtatttttagtagagatggggtttcaccatgttggccaggctggtcttgaactcctgacctcaggtgatccgcccgcctcggccttccaaagtgctgggattacaggtgtgagccaccgcgcctggcctaaaacaataactgattttttaaagaaacatactcatgactatttgtcattttagtcaaagaggatggagaaaaacagggttcagttttattttcagttcaatgtttcgaccatgacatccagtgctggcttgattacattttaggaaactgaattccttctctaaagaaatagtccaaaattaaacacatatggttactgtaatcaataataatgctaaccaagcatgctggctcatgcctataatcacagcactttgggaggcagaggcgggtggatcatttgaggatcacaggagtttgagatcagcctggccaacatggtgaaaccccgtctctactaaaaatacaaaaattagccggttctggtggcacggacctgtaatctcagctagtcagatggctgaggcacaagacttgcttgaacctgggaggcggagttggagtgagccaaaatcgtgccactgcactcaagtctgggtgacagagcaagactctgtctcaaaaataataataataataataatgctttgtgcatttcaaaattactaaaagagtgtaatcccaggacttttggaggccaaagcgagcagatcacttgagatcaggagtttgagaccagcttgccaatatggtgaaaccatgtctctactaaaaatacacacacgcaaaaatattagccaggcatcatggcgtgtgcctgtagtcccagctacttgggaggctgaggcaggagaatggcttgaactcaggaggcggaggctgcagtgagccaagatcccaccactgctctacagcctggccaatagaggaaggctctgtctcaaaaaaatatatatatattatatatatgtgtgtgtgtgtgtgcatgtatgtatatatatatgtgtgtatatatgtatatatgtgtatatatgtatatatgaaaagagcagaatttaaatgtttttaccactaaaaaagatatgtgaagtgatagatgtattaattagcttgatttaatcatttcacaatgtcaacatatataaaaaatcacatcatactccgtaaatatataaaattgtaagtcaactaaaaataaaattttaaaaagggaaacataataacttttattattttgtatttttaaaaatcaaagttaggacacatattgagtttctctgctactcaatgaactgaaggttttggaaaacaagaccaaaaaacaacaacctccaaaaaagaaataaaagaagatcatagttaaggcctttcatgcagtcagctcagggatcaagggtagatctcaacccgcctgtcactgagtatgcagtgctcacagatgtggggaatacctatgtacatcacagtcctcagggaactgtaaaaccagttgcattgaccaaaccaaaacacgtgccattagaaagcatataattgtaaaccaagagcttcttttccgtttacctaagataattgcagaggctttagtctaagagaatcaaagttaagtgatagcactgtcaaaaaggtttcttaaggaagaagatctaggggttctcgggattcgttgaatttgatgccatggctgaaaaattaagtggagatacactgtatgccattggagtcaggcactcatgtgaaagatcagcactcacatttaggaattggatacagctaacagcaggggaattgataggctcatgaaaagagcatgggtagaggatgacatagaaaattaagcacagttagggaagacttaccagccaggttacaagaagcaaacacctatcccaccgattcagaataccttgcctcactcctgcatgacaggacatgtgtgttctttacgttaactgagaaactgaggccagataggaagacagatgtggccagaagaagttgacattagtaatgagagaaataaacgaagtgattttggggctggcgttaactatctagaactacccaggagggtagatttagagacacttccatctttgaaatacccagaagtctgtttctccaatgccttgactctgcctaaagcagtctaccattaatctctgaggaatctcttcaaacagctttctgccaatgtatcactgaagccttttgagaaataagtgctgttccagcttagtcatatctcaaggcagcgtggcatgggaggtggagactacgagtaattaaaaataactcccagctcaagcagggagagggctgtccctgcctcatctgtattcccatcacaggctccccagtgagaccccagctgttgagcaagagactctgtagtgtctgatgcactcaatcttgagttgatcacaaaagaatgttaacaacgttaagggcatggagttctaggttttggaagaattcttaatgattctgttaaagaggaagaaataggaaaaagaccaaaaagacagggacaaacaggaaaaacggacccagctctactgcagtaatagccattgatcactttacctcccttggcagtctgatcagtttcactggaaagatagcaagtggaaaaagtgtgcagagatatgatgtgaaaattatattcaagctttagctccccagcacgtctctaaggaaagcactataggaacagctgctggagatataaacaaaggcccaggaacatctctgccattcatgtcaggatctgagagagccaagggaaggacaagaggggaattagctcccagacatgcttgagtctctaagctgttactccgtgatccccatgttctaggtgcagaagcattgcgtctctaagcaattcccttaccaccagctatctaatgctgtcagaggaccaactatttgctgttaacagtaatgctcatttgaagctattcagcctagattttctttgtattaggtaactgtttaataaattaattccaaacagtacctcccatctctctcagtctgaccattgagcgctcttagtcaatctttgcaaacttgtccccatttagttgttaaacctgctccatcaacccaataatgaatcaacctatatttgaggactatggtttgtgcctgctccaaatcctatgttttctctgatttcagaccccttgcctcaactggatgaacttttcaagctcagaacaaataagtgttaaaaaacattattaaacaaacatattcacctttctacaagtttggaaaataacagctaaggaaaaagcttgtaatcaatattttttgttgttgttcttgttgttgtttgagacagttttgctcttgttgcccaggctggagtgcaatggtgcgatctcagctcactgcaacctctgcctcccgggttcaagtgattctcctgtctcagcctcccaagtagctgggattacaggtgtgtgccaccatgcccggctaattttgtatttttagtagagatggggtttcaccatgttggtcaggctgatcttgaactcctgacctcaggtgatctgcctgactcggcctcccaaagggctgaaattacaggcgagagccactgtgcccggccttataataaatagatgtatcaattgtagcttaccagcaccaaaaacaatagttagtaagagtgtggagtctagaatttgactgtttagagaaattatgcctcatcttggggaaaatttcctaatgtgtccaatctcctgtttccttatccataaaatggagataattgtaggacctcctccagatgactattaggaagagatgatacatataaaactcacagcactgtgtcaggcataaaataagtaatctataaacaatgttatttaacacttttatgataaaaatatagaaatagaaaataatagtttcagtgacagatcaatgttgaagcctcaattcaaaacataataaaattgctctttatggttcttacgatgtacatttatttcaaatagtaacaatgctgttcatggtgaaacgtattgattttaagattgagaaattggacaaacaaggctagtccacaatagtgggattgcagtagaccctagaatatgtataccactttggaaggtataattaatatgtttatatgtgtcgtccccaatctttccattctttattaccaccattatacctccatttactccacagtccgtctcttctagaatgaaagctcccacaaatcagcaattgcatctgtataacctattctgtatggcataacacctatatacttttccaaaaagaggtggagagaatatttattgacttaggtatgtctgtgatgatctaatgaaatgtcatggaacaacttaaagtcatagccaaaggaagaggaatgttaatatgtaagaatttgcagatagattattaacatggaatgatgccaaaatagcacagtagaaaaactaaaataaattaaataggcctggatttgctgggtaacctggggtataaccccataaggatggtgtatgtagaagaaaagtcagtgaatcattagtaattcataaactgtgttttttctcaggtgttcaaacattggaaagctatcttttgcaacctgatgctttccctggaatatgcagtgtttcttgactcgtgcagtaatggctgatggagtaggtgttcagacattttatttgttggttttatgtatccaggtagagaactcctgtctaaaattatcaagagttggtggtgcattcaggacaggaatttagattttctgactccaaggacatttcaccacccactaaaccaccctttgccatgagctcccaggaagagcaattgttcagtctggtacagtgagggaataatctgtccctagcacaggaggctgaacacagcagtgaataaaagaagacaaaaccagttctacaatataaatgacacattccattaatacaagtggatccaaatgaactaatttcattcaatagtactttcacattctgtagctatatgggcttggatacaaattgtaatgtcagtctgtcaggagagtggatggcagtgcataattacaagttcttgttcagcacttcaggagctaatcagagcaaggatgtgaatctgtaatttgcaaatgtgcaaagacagaggttactatggcactaacgactctgctgataacattcttgccaccacatcataggactgtgagcacaaattctacaaaatcatttgacctcctgtttagtcgtttgcaagaaacagcctgctggcagtacctagggacatttataagtttaatgttgttcaaaaatctaaaatgtcactatacaataaattaatacttacattctaagggactatacacaatcgtaaagcaatatatagagcaaattaatacataaaatacagagaaatatagaaaattaatatactacatcatgcaacctgcttctaaacaagtgtttctttcataggactgaatcaggaaagattaaataaggagttgagtagaaacatatatagatatgtagagatagagatataggcaatgttttctttttttttatttttatccaccaccccctccccccgctccccaccatagcatttctgctttaaacacttattctctttctctaacaattttattcattttcgttcttggggcagtagaaaaacaaagcagcattttagagttcagtactggcctaaaattcaagcctctctctaaaagattatagaatttcgctgtcctctcagttcacagcagcaagcagaataatttctgcttgccattttcctcaacttagtcctgcaaaagtaacatcattggtctctgcttctttcctcccattattacctgatcctgctctacagcagatgcttcctcagagaaagaaatacctcgaacatctccatcaacttcttcatggtagtaacccttaaccctaaacttttcttgtgtagagatgggtgcatcatgttgaggattcattgaccattctgttaatatatgaatttaatcaattttaattttaaagaatcaggagtgattacgtgcatcacaactttcaggttaaataattttatcatgggtgctaagctagaaccatggctcacctggtcagatggctataggagagtcagcacaatagaagcttcaggcaatgtgaatcctgctgctccctaccagggatcaaaactgaggtcactgtgtggtatgtggaagtcaaatgactgcttctctttaaaaagtgttggaatgatgcgttttctctcaccgattctgtctagggggtaatgtgctagggtgcagtaagttaagtgttagtcacatatttgcagggttaaatcttagttccacagctgactcactgcacactctaggcagaattatttaactccttcagtctttgtttcctcattcaaaaaagaaagagagatactatctgtggcagagcctcagaggattgagggagttaaatgtaaaaatgacacactggtgcctgttacagggagggctccctgagaagcagacctgtgggctaagtttagcatgcaggatgtttattaaggtgtgcctttgagatcaatacctgtgaaaagtagggaaagaaagcagatgaggcatagggaaaaggtggactgccacaggcaacccagcgaacctcaccagcagctctggagctaaaatagctcttcagaattgtccagagttgggctgaggaggccagaattttatttgtgttcccacgatgatgactcagtggatggggtcatttcaggaagagagcagggcatcaaccttgagcaagaaaggtcactgcagcttagtctaaccctgaagaggctggcagctcagggcatctgttgacagtattccaaggaggcagggcgactagaactttagcaaaggaagatggcacatcacagtgatcatcacagtccccagtcataaagagtagtttcttacatgtgcataccccttagccttgttttcatttctcctcctcccgccttcctgtcttcctcttcctctcccttccttttcttctttttcttcttattttgattttgttttactttatggaattaaacctccataattctgtagtgtgccaagtatgagggggaaaaagtctctttcccccattaatagataatgacaccttgacagataagtgagcaattctgcattgattcattggggaaaactatggcaggaagtgggtagcagtgtttagcgtggcataaaatacatatgctatctaaagaggtggcttctttcccttctgggggatttatgtgcttaaatcagggcccacaaactcaaagcacgcatttgggctaaaggaagcttggctaagagtaaaaggagagccaacagggaaagggccttgtaggctgtgacctttcaagctaaactgcccctagagaaagagagacttatttgaatttacagatgccttaggactccagtgagccacagctctggctcttttcctctggggcactacaaagcttaggtctttgcagatcaattaaagtcattagcgctccatctaatgaatgttgatttccatgaggaggctgagccagctggcctgccctaaacagcgcaaaggcaagcagggtaccagagttagagcaaatggcaataagccacttgaattagaaggcccccagcttgcagcagagttaatgctgcctgttttccaggtgacctcaatcactgcctggggcagacactggactcagatgctctccagtcacaagagagtttgtaaatatgatttaaaaattgtcactggctgctcaactagcaggagtgttcagaaagctgcaaggtatgagacactggatgcacagatgtgttttcatctggggaatgttgcatttttacaattttctctcctggctattatgatgggagatttctagtttttaaattcagtgtgctttttaaatttttgaatagataataagatgattgcaaaaaaaattaatgctgcctctcatttctgttcttcatctactcaagaaaccagttattctttttgtgtgattctagagttttctgatatatgtacaagcaaaggaaagtgtatagtctcatattctcatagtcccacctactaaacaaataacaacatactgtatatataattctgcatctcgcttttcttctcttttaatatatcacagctgccttaccgtatcagaacaaagagaaattctttttttttacagctctgtcatatttcattgaatgaacatgccttatttacttaactgttcctttactgtttgcagttacaaataatactgcaggtaacctcaaatatgtttcattttttacgcatgtttgagagtatgtgttgaatacaatctcagaagtagaatgacttctaggaggtatatgcatttgtaatttcaatagatagaaggattgccaaattgtccttgagaagtattacacaaatgtacagccccccccccctcaacgaatgggagcgcttccccacacctcaccaatagagactgtggtcacacttttagaaatttgtccatctggtatgtgaaaatggaatttcagtgtagttttattttctttttcttatgatgagtgagattgtacatctgtttatatgtttaggaactttttagaaatcgtttgtatgaactttctattgatattttttgaccacttttgtagtagtttgctgcttttgtttttaattgatttctactagagagactaatctccatgatatgggatgcaaatatccttttcctcccctagttttttgtttgccttttgattttccttacagcttttgcccctgagcttttagattttataatgttgaagttatcagacttttcttttatggcatccttatttcgacacttaattagaagggaggacttcatattctagagtggtaaagtaattcttcatggttttctcttagcactaccatgttttgctttatattattcattttcataatttttaatgtattcctgtagaggacgtgaggtattgatacaaatttaatattttttttcaggtggctacccaattatttcaataactatgtttctataagtcatcatttcccatttaagcctctgttatgatattttaaattcatttctgcacttttattctgctgtattggtctgtcagtgcacatttttcaattctgaaacctgtacaatagatttcagaatctaaaagggctaattctcccttattactttttctttcagagttttcctgactttcctttttttttttttttttttttttttttgagacagtgtctcagtttgtcatccaggctggagtacagtggtgcgatctcggttcactgcaacctccacctcctgggttcaagcaattttcctgcctcagcctgctgagtagctgggattacaggcaagcgccaccacacctggctaatttttgcattttagcagagacagggtttcatcatgttggtcaggcaggtctcaaactcctgacctcatgtgatccacccgcttcagcctcccaaagtgttgggattacaggcgtgagccacggcacccagcccacttttcttttatatttttttatagaagcattagagtatataagcagtttcttttaataatttgtatatgttagcatatgtatatataaattagataatgttaatttacaaattaaggagagctataacttctatgacctatatgtgtctttctatttagtgacatgatctgtctctccttttgcttaaattttattttatataatttcatatgtctcatattttgttaggtttatctctaaaagttttttcttctctgtacctaattatgaatggttcttttctgttattacttctactaatgagctgtgtgtgtatatatacatgaagatcatgaattaaggcatactaattctgcatcctgcttccttacagaatcttcttgttaatagtaatcattttcagttgtttcttctgagaactccaggtgctcagtcatatcatctaaacataattttatcactctctttccagttttatatctccaatttctcttgtttaattgcattagataataatcctatctaataatatagtaatgatattgtggatactttagcctcgttactgactttagtaagagtgattctgatgtttccacaatcattatgagcctggcttttgcaaacatatacatccctatggtttcttaacactgaatggtctggtccttacattctcaagttaaatcccgttagcattgagtattctttataatatagaactagatccttgtaaacaatttaattattttctttttctatgccacagaacaattaacttggcattaaaattctctactctttaaaagcttggaatgatttatctgtgaccttttctgggcctcgtgctttctttttctaagggtggctcaggtgacagacaacttcctccatttcatcaatggaaatgaataggttttgaatatgtatcccctttagaattatttttaggcaattacacttttctaggatattctctatctcccaagttttcatatatatttgcacagagttagccaagactatttttgtcatttttctgtgcttattttccacttactatttttaaattttatgtatctgcaattttcttcctctttttcatgatgagataatctaatgtttaccctttttaatttttttgtaacagaaactttaaatatattaattttaccacttttgcatttcctagaatattaaattctccttttccctatatgaattggccctttatgtttttcttaaacatattttatgtttgtttaaaaattttgtattaaaaatattgaattgattttgttattttctcctgtcaatataaatatgtaagaccaaagatttcctctaagcatggcttttcctgtttcccatagattatagaatatgagtgcttttacatttttattgttctaggaaacctgcaaaatgggctgtattacattcgacccaagaattaagagagagttttaaaatttctgattggaatgggattctgtttccgatcttgttgttaacatctagttattacactgtgatcagaaaatgtgtacaatagtatttcttttttttttttttttttgaaaaagttgcagttttctttttggactgcatacagttacatttgtgattatcatgtggattcttaaaaagatttttttaattttcaatgcataagtctttaagtgtactgtttgatataccttataaattatgctatttaggtcaattatagtcttacttttgactacttcatctatcattgaataagcaagatgatttaaagtgtcttatttctgttttttggctgaatgtttcttcagataactcttaagttttctgttttttgaatgttatttttatttcatttggttcataactagttataattctgacaccttcattgcgaatttcatcttttaacattttaaacaaaaaggtcttttctcaattatttaaaacctgaataccactttctctgattttaagatccctatcgctgatttatttttgtttgcattcttccggcatgccttggttgaacctcttattttcaacgtgattaacaaatttaattgttttatttatttacttatttattttaattatactttaagttctgggatacttgtgcagaacatacaggtttgttacataggtatacacctgccatggtggtttgctgcacccatcaacctgtcatctacattaggtatttcacctaatgctgtccctcccctagccctctaccctctgacagtccccagtgtatgatgttcccctccctgttccatgtgttctcattgttcaactcccacttatgagaacatgcagtgtttagtttctgttcctgtgttagtttgctgagaatgatggtttccagcttcatccatgtccctgcaaaggacatgaactcatccttttttatgcctgcatagtattccatgttgtatatgtgccacattttctttatcactggtcattagagaaatgcaaatcaaaaccacaatgagataccatctcatgcaagttagaatgacagtcatcgaaaagtcaggaaacagcagatgctggagaggatgtggagaagtaggaatgcttttacactttggtgggagtgtaaattagttcaaccattgtggaaaacagtgtggcgattcctcaaggatctagaacaagaaataccatttgacccagcaatgccattactgggtatatacccaaaggattataaattattctactataaagacacatgcacatgtatgtttattgcagcactgtttacaatagcaaagacttggaaccaacccaaatgcccatcaatgatagactggataatgagttgttttttaaagcaagtctcttgttcatagcacaaagttggttctgctttgtgatctattgtaaaagttgaaagtctttgtcttttaataggtatattaagccagtttatatctaattatgtgatagatatatttgttcctggtcctctcctgttactttatcatatagtttctctttttcttattttgtttgtttgcttgtttgtaatgtgttctatgcatgtctatatgtatgttttgctatttaagagtttgcattttctcccttgtcatttttacagttataatgtattatatttttagtgctcaatatatttaaaccagagcttctcatccaatataccacactcagggcttttggatagaccctctggccatgaacaatcttgtcttctcctctcagtctcgacaaatatattatttgctttttgacctatcatttgaaaaatattgggaaatgtcactttaaggaatatgcactagctctttactatgagcagtgaatcatctttcttaatatttaatacagaaaaaaacatgcatgtattaaaattaattgagttgatactttatatattatcctttgactcctagcaatcagataatttacttcctactttctgtcctcttctaactatttttagttgtattacttctgtattgtcagggtttattccattttcattctggtcttcagcatattattcccattaggttagacatagttcttctttaaaaactatactctgtgcttaccttcaatttcattgtcatagttattctaattatgttttggttgatcaaagtcatttcctagtagtttcctcaatattcccagtgttcctgaaggtaaataccatttgtaaactatcattgagtatagtttggctggatataaaatgttgggtcatattttgctttttgttgggaggatgtttctataaacttattaatacagtcctggtgagtcagagaagcctttcttgaagaggcattgtctatgtttaatctctaatggatgatcgtcacagaaacatagacagaggaaatggttccaggcagaatcaatggaattgaaaaaaatcatggtacttctgtggaacaggtagttggatgactgtaatgcacaggggaaaaggtagacacaagttgacactggagaagtaggaggggatagagcaagaagaacttgacagaccgaggagtctggattgcttccaggacaataatctaaactgcagagtggtatgaagcaagaaagggatatccggttgtaactgttcatattaagaggggtgcacaggggtatatgagctttctcttccaaggagcctttgagtcctcatctctgctgttacagtacagacccagaatttcttatgtaggagagtaaatacatttatgaaataataatggaattcattttatgctagggccatatttctaactaccttccaatgtagcaggagatagcaagacttaaggatatcttagtctgactcttttaaaaaagaaaaaataaagaattacagttcttgggtatatagtcttgtacctctgtaatctgtgaactgtctttcttccaaggatcccatggaaacctttacaaatctagctgatattcactatagttctaaaacatttccttccttagctgttccatggggagttttctgtgatctcgcagtttcaagctactttttggggaccttccatacttcattcaggtgggagctgccatagttaactagtttcggagcacaactctttatcaaacactatatatgtaaaaaactgccatgttaaataccacttgttgctctttcatcttcagtcagctatatgcaaaataggtctttacaggcaaatttacattctatcacagaaacagtgactatcagataaccaactcccttctcaattcttttttttggcttgttttcttgcttacttgcttggttgctttctctctttcctagctgaatagcattacaggccacttctaaaataaactgggttgtggaatttccactgaaggctggagatgaaaaacatactcatttacactgtgtgcgaacttggtggactaacattggttaaactttgaaattaagagatttttttttcctgatttttggccatctctttaatgcaatttcaggtagccacatggttcttaaaaccccaaatgcagctatcttcagtaagtacaaaatgaaaatatgttgcatcctaacagataagaatttcttctttctcatgatgagagctgttacctaaaggagcaaagctttaatggggtctcagcttgattttgccatgtttatatacaaaagagatgaggcaagctttgttttgaagatgttaattgattctgtccaccatgctgtctaacagccaattccctgaaaatgtagtgatggaaaaaaaatctgttccaattactgtataagtaaaatgcttcccttccacctccactaaagaaaaaaatggcactcactgctcaggatctgagatcgacagctgattctgcacatgcaaagccctgctgccatttgtcatttcaggaactgctttatttttgtcaaaatggaaggaaaaaaaaggagagagacattatacagacatcagaattcaaatcatttgcaacctgatttgggtaatgaaggctcaaggcggagttgagatttagggactaaggtggttgtataagtatgtaacttcacaagaatctgttttagacccagagcagattaatagccagattacaatggcatttcctgggcttaggaatctcattatcctcttctttcatatttctttaaagtggaagacccttccactacggtggtgtcatttgaactcaagtgtcaggttcacatccttgtgccctgaagtttcaaagtgtccagttgctgtaggagctttttctattctgatattactgatactgagactggataggaagcataccctgtttagctgcacatctaaataatcggtaatgagaacatccttgacaaaactatcttgcggaggagaggtcaggtcttacctgcatgcctgcgaccttcagcaaacaaaggcagagatctaaggagaaaacaggatgtgggatgtttccagtggaccttggcagtggacttgctttgtgtttgcaatggaagaaggaactagaggggggataacctcatggttgtcttttcttctaaatttctaagacaaccagtgaagcttgaggccttttctccagaactatacaatctttgcctccagcaagctctgtttttactaataaccagattgtcaggtggaaaactttttctaagtggaccttacttctctaagtaaaaaaacaaatcccctgaggcatgaagacctccattttacacttttgttatatacttcacaggtacctgaaatggttctggacaaaggatatgatgatcgacaataaagaaatcaaagatcatattcataattataaccaacaaaaaataattctggggataatattgtcaaaatggattccactgcaaacaggcagtaggatttactttgacaatattctccccagaattattctggatatcactgtagggaccaaaggagagtttttcccttggccttccaaagattctctgaaaaatcaacttgcaaaatgcaaattgatcagagaaaaagtgtacacatttatttaatgtgtatacacaggagccttcaaaatgaagacccaaagatacaggagaaattgttcatttttatgcttaggttcaaccaagtgtggacatctgtgtagaaatatgattggacaaaaagggtatgatctaatggtaatggactgaggcagaaaacccagcgaggcctggccgtgtagactcttcttggcctctctgagcccacattcctttttttctgggtagggggcaaaactttttctgaaatgggggtcttatgacctataatcaaacaaggtagtcaggcagtttctgcgtggtcagtttttacacagaaaggcagagggaaattggagtaatatttttaggtcttatgactagctttgaggaagagggatcctagtttctatggctagcattggggaagaatgggactgagaaacaggagggcaggggaaggtcagaaaaacttttgcttctgaggccttcattttggggtattgtttactgagccccaacaccacctcgagggtttccaggtatattttttaaagaccttctaacaaatgttccttttatttatacatccatttaattattggtgctagttccaatgcaagacttaaaaaattccacttctaattccccacctgcatggagggcacaaatctccaactcatgatcagaatttcctgcaatccgtatgtcatttaatgaattccactctattcttctggaaatcgaacactctagaaacatagttttccttttagctgcaaacctattaatgctggcagccataaaataaatgcagtcacaactattccccacaaatgaatcagtcagctcagattaaaatatactctttgcatatcactgaagggctcttcctggtcagcttgtaagtgttctgttttcattgcgtggtattcattttccttttagcattgcacttgatttgtgaagtagtgttgactgctagattcccatcattaacattaagttttattgccttaaatctctgtcttatgttcactataaatgttttaagtcaacataatgctagcaagaggtgctgggttaacagactacagttggcatatgattctcatttggggcagggaattgtgcagggttattaggagctttctacctttttatttatttatttagggacagggtctcactctgttgctcaggctggagtgcagtggcacaatcatagctcactgcagcttctgacccctgggctcaagggatcctctcaactccgcctccagagtagttaggaccacaggcacatgccaccatacccacctaattttttttctttttttgagacggagttttgcttttgttgcccaggctggagtgcaatggcgtgatctcggctcactgcaacctccacctcctgggttcaagcaattctcctgcctcagcctcccgagtagctgggattacaggcatgtgccaccacgcccagctaattttgtatttttagtagagacggggtttcttcatgttggtcaggctggtctcaacctcgcaacctcaggtgatctgcctgccttggcctcccaaagtgctgcgattacaagtgtgagctgccacctggccccatatccacctaatttaaaaaaatttttttgcagagatgtgatcttgatatattgcccagcctggtctcaagctcctggcctcaagtgattctcctgtgtaggtttcccaaagcatgtggctaacattttttaatcctatacaatgttagcactggcctcatctagtcctaagaagtttgctcctaatcatgtattcattagaattgaggaggagaatatttcccatggtgaatttatatgttccgccaattcaaccaacatcaaatatttattagctgcataccgtgtgccagatacagagccagacactcaattttgcagacacagtatacctgctgtcctagagtttagactctaatgagggagagagataataaacaaggaaataagtgtatgtaacaatgtacagctagaaacgctgggaaagaaacgaacgtgagagacacttattggaatttaaatgcaagccactccactatatctactaggtgtgtgtgttacaaaatacaaaaaaagaaaagcctcctgggagggtagcaggagttaaattactcaaaattaagccacagtttaagacagcaaaacataacagaacccagagatgccccaaggcaatacaaagttaattatctaagtagtagtaacaagaataactgctggccaggcacagtggctcacgcctgtaatcccagcagtttgggaggctgaggcaggtggatcaccctgtcaaaactctcaggagttcgagaccagcctggcaaacatggtgaaaccccgtctctactaaaaatacaaaaattagccgggcatggtggcagaagcctgtaatcctagctactcgggaggctgaggcaggagaatcatttgaaccggggtggcagaggttgcagtgagctgagatggagccactgcactccagcctgggcgacagagtgagactctgtctcaaaaaaaaaaaaaaaaaaaaaaagactgctttaggatttaaggaagagtagtgtggcgggttagagatggtggttagaagaggctttctagaggatcccaaaatgatgaggagattgtggatggaaagtggtctcttaagcagaagaaaaagcatggaagaaatactagggtcagggaagataaaaaatattacgctgttatgaacaatcaattatatagggaaagtaaataatgttagaaaggtagtttaaaattttccttttttgcttatcatgttagaaagaatttaaaatagtggccaggcatggtggctcatgcctgtaatcccagcactttggggggccaaggtgggaggatcacttgagttcaggagttcaagcccagcctggccaacatggtgaaaccccgtctctactaaaaatacaaaaattagctgggcgtggtggtgcacctgtagtcccagctacttgggaggttgaggcaggagaatcgcttcaacccgggaggcagaggttgcagtgagccgagtttgtgccactgtactccagcctgggcgacagaatgagactccttcgccaaaaaaaaaaaaaaaaaaagaaagaaaaaagtaatggcagtagtagcaggagtagtagtagtaacagataaaacctatcattggcagcaacccaggcaagcatttatttctatatcttgctgatggggttgatggggttagcaattgctatagtctccctagtaggggatttaggagacagatgaaaaactgttagactatttacgtatttaaccaaaaggttccattttggggtattcatcctatggaaatagtcatgaaagtaggtaaagatttagttccagagatgtttattatagtttcttgtgaacattcttatttgaaaagaagataagtgcccaataatatcagattgattacagtacactcaagcggttagcacagatattcatcatagctgtacttgataacagttgttactattatcatgttcttgtgtgagaggtaaagggagataagattaaactttttgatgttataaacaccatcacatacttcaatctaatattttagaagaatatttaatactattttaggtttactgttgaattacatcaacagatgtttgtaaaacacagagcaaaaagtagagtaagttatacaagatcaatttagtcacatctctatgtgagtatgtttgcatcaaataaatactggaatgatatatgtgtgtgtatatatatgtatatacagtatattcaaatgtgaacagtgagtagtgagattacaggtaattttgattctttttgtttgtttgtttaacattatgttctaaaatgtgtatggtaaaaaaaaaaagtagtttttttttatttctaagactagaaaattatttagcaaacaagtggaccaaagatattacagatagcatttcctaaacatgatgtgccttttgtcatggaaaaaatggatgattttgttttcttcttcagcttaatatgcgatataataagctcagtcatcgaagagtgaagtgcagcatactgaaaaagtatgatttggtttcacacagatcttggtttaaatcccagcttcatctctcattaatgatcacatcctgaacaagttaatatgtatgtctcggtcttctctttagaaagctgacaatggggacatgtatgttaagtgactagcacagcgcttaccagaggaccattctcccgctgtagcaggacgagccgcagacgaaacctctcagacaccaaattgtaaaaggaagggctttattcagctgggagtatgggccagctactctctcaaaatccgagctctctgagtgcacaatttctgtcccttttaatggctcacaacactaaagatttcacgtgaaagggtggtgattgatttgagcaagcaggcggtacgtgacaggggctgcatgcaccggtggtcagagagaaacagaacagggcagggagtttcaaaatgttcttctatacaatgtctggaatctatgagtaacatcggtttctaagttatgagttgatttttagctactgggtttaggccaggcaggcccaggcctggtttcgggcctggcgccgggctgcctgtctttgattttacttccttgttgttttttcttaaaacaggtactgagtataaaacaatataaaacaatatgagagggtctctctcttccctcaccacatatgtgagaaaagagaaaatatggctaagtcatgtacttaactgagtattaaaacacatgtcttaccagaaatagcaatttttcaagtgtgtgaaacacattaaaaataaactttgaaactccaaaaatctttaaaatatgtaaattcatttagactttactagaaaaataaagttatctctctgaaattttgttgttaaatatttgtagaaaaggatgtaaagtggaatgaggtctagagagagaattttgatggatgtgtgtatttgagtcagttttcatcccactgaatctttagtcaaatcaaataaaaatgaaggtaatttgtcagcttgcagaatcatgccaagcaaagtcgaaaactgccagcctatgttcattctcatggtttgaacaaaccgaactccaagtaattcattgtttggttttgaattacttatattcactctgttgatcccattttgctttgaaattgtactttcatgtttattttctgtagtccagaatggaggtaggaggaggaaatatctggaaatacctaaaaacatcttgaacataccttaaaagtaacatgtttaggaggtccctgagttagttttattagcacctctgagtgttacagaaatgattgcaaatctccaaactcacagacatttgcccagagtccccacctataatcatgtgctgggagagctttagtataattattaggccagtgtaggacaagcagcagcgtgcacatagtcacatttaaagtgaggatttaaatgacaacaaaaagcaaagcaaaatgacactctatataacttgggattgtttttatttaaatcaaaatttaaaaaattttaattatacatatgtcctggggtatgagtggaggggtggctatggggatgggtacacaggcatgaatgaacacaggagactatgaaagatgcttcagatgccccccggacaaagatggagaaggaaatgttttctgtaccatctctatatgggcagttcagctttctctctgtgcttgttttctctgctctctctgtttggatttgaagaaaaagaggttttttgttttttttttttcctttttcttttgtctctatcttatttattttttaagtagactgtcaaaattttagctgtgattgaagaaaagaaataagacaaataaaattagtgggaaaccaaggagggggaaatgggattgccacttcctcttgtacagagtcagcagttttaatacctgtaaacaaaaagttctttgctggaactctttttagaatggaaaatgggatgaataggtacagcattatcaaaccatttgttgtgctccctttttcttgaattgatggaaaatatagaaataacacaaaccaaagttgacactcttgaaatgacttgtccttagaatttattgtttatctcacggaaacatgaagaaatgtcttcattaatgtttttgatctcagagccccatttccttttatctcccagcagaagtgttgcagtgtcctcacatttggattgagaatttagatagataagaattcaaccctctagtcccatttactgcaattgtatttaaataccagcttaattagctgtactcatcctccttcccaatcctctttgaagtaggaaagtcccattgcttccgtttagctaatgctatgctcataccctagtttttaagctttgtagaaagtacagatatgactgccccatgtgatctctaagaagtctagatatttgatccacagaagcattttgttccatggaggacgtggagtttgttgctttggatttgagcttcatttaaagcatttgcttatttttcatcttgcaaaattaatctaaatcaacttaatgaagggtagaacattgagatatatacctgttaatagtagaataatatgacatggcacagtatccaggtatggaaaaggtgaatagggatagtgttatgagatttttagagtacgttaattttataaagcatgcttatgggaaaagccaaacattgatgacatttcgcagaaaatgttatgttcaggtttggcaaataccaataaggtcagagaaaaagcaatatgaatcagtattaagaaaattataagatagtgtatgtctaggtcatgatctttagtatcatcaataaaaccactaaggatgcctcactatagctgtgagatgggttcggaccatgatatccagtttaatactatttgggagcagaagtaactagatatatttatcctatgatattttacacttattggacacctgttgaatctctgttggcttgagatttaatttgctaagagaaaagcaactgaagttactaaggtaatagacataacatatgatctaaaaattgagagtacgttaatcaaggggagtgagcagaaattattctcgtcaatcatccatgtgtccctctatatccttcacctttattgctgttagatttggaggaaattctgagcaatgttccgtgatcaggggtgaaaagtgtcatttctgggctgaggcagtttatagtcatttgcaccttttctataccactctctttccctgccttctcttctcaatgttctgaaaatcttgtgttctaaagggacttgaataagatggagatagagtgccaacccacattagcatttatagcatatatggagcaagaaatgaacacgtgtgtatgtctttatgtaagttacagatacttatctatgatacctatcctgactattgcaacatgttaagctttccactgataattaaatttcatatataaatagataattaattttgatatttaaaaaatgtaagttacaaaagcactatgctactctgagaggaaattgagaaatactaaagttttctttcatggagccccatagttggaccttcacaaaggcttcaaaagctagtttcctaaccagtaaaagtcagcatgagacacagtgggctgagataacaggcccctcagcctaggggtggtttgctgaagtaggaggccagagcctctggatgagtcatcttcagttgttacgacggcttactctgtggaccatgcaaataatatcattttcgatgtgttccatgatgcgaaaaagttagagaagtaccataggtctttgtatcaggcaccaatataaccacccctacactccagatcttctttccccatactcatttctccactctcctccaagtcctgcctcaaacgagttattattttcacataaaactgagaaggaactgttgaaatgactgacatcttcagcaaataaaatagttgtcaaattaataaataaatgtcacttgaggcacttctgagcttctcaatatgtcttcttttggaggactatttgttggcataggagaagatttcctagcaaccctcaaaatctttccaattaggaacctaaattctattcccaaaggttatgatataaagaggaaacttgaaaatttgtaactgaactctattgaagtatggggtatttcaattgagtaagcccaatatttacctgcatcacaaaaaaactagattttaataatttcttatcaagtgtttatgccatgtaccatatttaacatatatttactcattagtttttcaaaattcttatgaaatgatattgtttttatacccattttacagatgagaaaactgagagagaccttaaggagctttctcatgatgcatggctagttaatggcagaactcatgttaaagcaagcagtccaaccctgcctgggctcttaaacagtggagtctgctgtctccttttaataggatgaaggtgaagttctcagcttgatatttttgtttcattcagtgcaaagtgtcatcttctaccccagtgccaaaaattacttcaaagaaaacagctttttgactaccgacagttatgtacaagaggtgtgatttggggttttaagagcttactttgacacagctcagatcccttttttggtagtgaaaattatgctgttatctcctaaaaaacatcatctgctctgtccccacctctttaatttgacaggtgattccatatccatgtaagagcattttggtgtctgaaaaacaataaaaatcgtcccagtaaacccatgttctattcaaaaaattttggcatattgattgtctggggtaaggttcaaaattgcataaacttccttgccccacaaatcactttgttgcatcgacaataataatcacaattattgatagtaaaataatttggccattctatgaatagtaaggactgcacatgttaaaaagaggcaaaagaatggatagatgatcagaatccattctcagtaaccagagctaaggaaacagctcaagtaaaaacgctcagcttacttaatgctctatagtaattaatagtaattgataacaacttgtagcaattaagatctaatgcacttaatttgcaaatgtactccttaactttgaatacacttttttctctaaggcgaaagtctagaattggagactcttggattcttcttcccattcttttccttcttccttggaaaaaatcagaaacaatctcgaaatgtggcctgttggagctggaaaagagcttagagattgttctagtacagttgtgtcaaactacaggtgaaaactttgaatcttggagaagaccactggtttattccacctctctagccatcggcatgaatgtctattggtatacttggtttagctgcccaatttatggccaagactgggacatgatatggtacaaaatatggtgtttttgtataaagagctatctcttgttccttcgttgtaaggggactgagggcacaagagttctaagactgataatcccatcaacttaatatattaaaagaggttttatatctaaagcatccaacacagtgtctggcctagaggaggcactatatctatagaacaaataaacgaatgttcgaacatagcctctctaaattctatttgaatgacttaacacaaagatcagaaatttgcatagctgtttgtgttagccctttaaaacaaaactctcctaggggaacatatgtgaattctattcagagtttaaaaacagattcatgggagagccccaaaccaatcaaaaacatggcaaggtttaaaaaacaaaaaagacaaaaaacaaaccagaaaaaaaaaattatgaaaagaccctgcctgccaagagtgacttgtttgcaattgaaaacctggagatatgagtacataatagaaacgtggcaatgatcatctgggcaaaaacacaatttgtatgacaatgaatcaggaaatgtcctggaacaccagaagatgaaaaacctgggattttataaggcacattcaagttgctgcgcatgcgtcacaccatgaattttcctgtggtctgacatcctgttaaaagcattggtctctttctaaacattggtagtagaagtgtaccacaacaggcaaccttacatttaaagaaagaatgtaatagatacctgtggaaactgtcaaaagtgtcttctagagctatttttgaggtctcttttattccttcattcctgatctgaaattcattaaggctaagagtgccccttaaattacgttctgctgtatcctggaggaacacctgaagaagttaataataaaccctagagattaggcaagtggaaagaattatgaaataaaacaaagcaaagaaattgtgtaaacaaattaattaattgtctgaaagtgaaagcatgtttgtaattttgcccttgtcaaagaaaaattggagttcattatgctcgctgactgatttaaaagcttcttcccgcgtagcatcaccgggagaatgagtgtgttgtgagtgcaaagcatggatcggttgcagcatcaattaaaatagaaattcattattgaaacctccagagtaaaaggtttgtgctttctgctttgaggatgggaggaagcttttcttttcttatttttaagttttgtttattttttttctctcctctctccaattggtataggaacatttattttggatttccagtagcaggcattctacctttttgtaataaattatattaatacctgttatacattgagcacatgctatataccaggcattctatatactttatcatctttaaccctcagagcaatcatgtggtgaaaggtatccatcagtatcacttgaggaaactgaagctcacggaggtaaaattgaacagctactaagtgatgatgccaaggatttaacacaccctaggtttgtctgactaggaacttctggtctctccaggacacaacagagccttctaaggcaggtttactgtgttgagttgggtttgcccctataacaaggctatcaaagatatatgtgtgtatccaggataggcattctgtattcagttacgtgttggagtgctatcgagagcccagtgggattataggtggaataagataccttcaacacagccatctgctgcatatggtgacccttgtgctctccaaatgagcagaagctcaaccagctttgctgaaatgtgtttgatgagaggatggtgtgttttacttttgtgacatctttccccagaggtggttgcctgaagagttgaactttagagaacaaaaagaaagaaatgtaggatccatttatggtctctcctagaatcatgccatatgttggactctatatggaaagggaggaggaataaaatgaagaaagaggagtacacagagcatggaaaaccataagtacgtgtgatccatgattacatcattgcaccttgcaaaaacttgttgattttagctctggggaggatgagtgaaaatcatggagtcagagcagaatcatgaaaagagattggttttggagccaagggaactcagatttacatctggtcacaacattttttttttaatattccctttttttattaattattttttttttaatttaagttccaggatacatgtgcaggatgtgaaggtttatttcgtaggtaaatgcattccatggtggtttgcagtacctatcaacccatcacctaagtattaagccctgcatgcattaactatttatcctgatgctctctctccttctactccccagcaggccccagtgagttttgttcccctctctgtgtccatgtgttctcattgttcagctcccacttataagtgagaatatgcagtgtttggttttctattcctgcattagtttgctgaggataatggcttccagctccctccatgtccctgaaaaggacatgatcttattgcttttaatggctgcatagtattccatggtatctatataccacattgtctttgtccagtctatcattgatgggcatttaggttgattctgtgtctttgctgttgtgaatagtgctccaatgaacatatgtgtgcatgtatccttataacagaatgatttatgttcctttgggtatacatcttgtaataggattgctgggtctaatggtatttctggttctagatctttgaggaattgccacactgttttccataatgtttgaactaatttacattcccaccaacagtgtaaaagcattcctacttctccacagcctcactagcatctgttgtttcttgactttttaataatcaccattctgactgtcatgagatggagtctcattgtggttttgattttcatttctctaatgatcagtgatgttgttgagctttttttcatgtttgtcggctgcataaatgttttcttttgagaagtgtctgttcgtgtcctttgcccacttttttttttattatactttaagctttagggtacatgtgcccaacgtgcaggttagttacatatgtatacatgtgccatgttggtgtgctgcacccattaacttgtcatttaacattaggtatatctcctaatgctatccctccccctccctgcaccccacaacaggccccggtgtgtgatgttccccttcctgtgcccatgtgttctcattgttcaattcccacctatgagtgacaacatgcagtgtttggtttttttgtccttgcaatagtttgctgagaatgatggtttccagcttcatccatgtccctacaaaggacatgaactcatcattttctatggctgcatagtattccatggtgtatatgtgccacattttcttaatccagtctatcattgttggacatttgggttggttccaagtctttgctattgtgaatagtgccgcaataaacatatgtgtgcatgtgtctttatagcaccatgatttataatcctttgggtatatacccactaatgggattgctgggtcaaatggtatttctagttcaagatccctgaggaatcgccacactgacttccacaatggttgaactagtttacagtcccaccaacagtgtcaaagtgttcctatttctccacatcctctccagcacctgttgtttcctaactttttaatgattaccattctaactggtatgagatggtgtctcattgtggttttgatttgcatttctctgatggccggtgatgatgagcattttttcatgtgtctttcagctgcataaatgtcttcttttgagaagtgtctgttcatatcctttgcccactttttgatggggttgtttgtttttttcttgtaaatttgtttgagttcattgtagattctggatattagccctttgtcagatgagtagattacagaaattttctcccattttgtaggttgcttgttcactctgatggtagtttcttttgctgtgcagaagctctttagtttaattagatcccatttgttagttttggcttttgttgccattgctttttgtgttttagacatgaagtccttgcccatgcctatgtcctgaatggtattgcctaggttttcttctagggtttttatggtttcaggtctaacatttaagtctttaatccatcttgaatatcttgaattaatttttgtataaggtgtaaggaagggatccagtttcagctttctacatatggctagccagttttcccagcaccatttattaaatagggaatcgtttccccacttcttaatggggtggtttgtttttttcttgtgaatttgtttacgttccttgtagattctggatattagacctctgtcagatggatagtttgcaacatttttctcccattctctaggttgcctgttcactgtgatgatagtttagtttgccaatcgcagccacttttaacactgttactctgggtaggttatttggtctgagtgtcagtccctccttctgtaaaatggggggaattcctgaaggacagtgttaggatgaaatcacattacttataatgtcgaattcctctgtcaatgcttatatgcttctcattcattatttctaagtcaagcatttttaaagcatttaacatgcaattattcatttttgtttataaagtgaccctgtgaacttatccctattttacagttgatgaatctgagacactgagagattaaataacctacctaagatcatccagctataaagtgatcgagacaggttttgtttgttggttggttggttttgagatggagtcttgctctgtcacccagcctggagtgcagtggcacgatcttggctcactgcaacctccacctcccagtaatggtgcaattacaggcatgcaccaccacacctggctaattttttttttgtatttttagcagagactgggtttcaccacgttggccaggttggtcttgaactcctgacctcaaatcatccacccacctgggcctcccaaagtgctgggactacaggtgccccgctcaagacagattttaaacctagcattcttgctccagaattcatgctgttaatcactgctattctgcctctctgttgactctcagaacctctcttggtcaaagcaagaaggtatcgaacagacttcctgtgctgttttataagctgcctcaaatccttccaggacagggcaatgtctatataaatagatgttataaaaagtataatctaggccctatttatttttctctcagattcatgtctaattcataccagttgagccttgctatttgagtttcacttaaaagcattctgacatagctcacctcccctctttctcttatattgctacccataaggactagagaaaagatggataacataatcctgagtctatgagttgctagaaattcctcattataattgtgtgtcttctggcaaaaataaataaataactttctcttttaaagccacttataggagacaatgcacattctgtgttttttctctgtggctgtgcatggacacagactcttctgcccttctcttgcctgttccttgattcctcatgtttctgtctggtgcctacctgagatccaggtattcctctttacctcgtcgtcttgctattttttctagggacttttcttctcccaaagttatgttgaaacaggcaaaacacctagaaatgggtcatgtgggtgagtagaggggagtgagaaggagagggaaaaaattcccaaagctcatattaggcaattacagttctaatgaatagaagcagtctattcaggcttctggcaatattttatgctcacctagtgtagtctgtattcccttaaatgggtaaaagatgccttaaaaagattgctttgaaggatgaagagacttgaaacaactctctgaacaaaagaacttgtttattcattcatttattcagcttgcatttattatgtgctgggtattatgcatataaatattttcttaagttttgtttttaattaacacataatagtatatatttatggggcacagtgagatgtttgatacatgtagacattatgtaaaaatcaaaccagtgtgtttagcgtattcatcacctcatatatttacctttttcttctggtgagagcattcaaaatcttctcttctagctattttgaaatacaacaatacaatatttttatccctagtcaccctgctgtgcagtagaacaccggagcttattccctccatttaactgtaactttgtacctgttgaccaatcatggtccctattctaaaagtgtcacagcctaggtaggttgacaaacaggtaaatcaggattacaatacaaaagtaaaatagcctggatcaaggaaagcacaggttgttatggaaacacaagagaggacatgtaaataagattgagggaggttcaagaaggcttttcaggagagatgacttttgaactgagttttaaagaccactgggtagacaataggagaaaaaaacatttctggctaagaggttagtgtggatgagcaagtggctctgtatagctggaggagtgtctgaattttccaacatgaaaaggaccacaaacttggtggaatcaaacaaagattttttttttcttttgtcacagttctggaggttggaagtccaaaatcaaggtgtcagcaaggctggttccttctggaggttctgaaaatgaatcccttccatgcctctctcccagcttctggtgctggtggatgcatcactctgatctctggctgtctttacattgccttctctgtgtttctccttttctgcctgtatcttctcttcttctaaagacacttgccaggccaggagcggtggctcaaacctgtaatcccagcactttgggaggccaaggcaggcagaccacctgagtttgagaccagcctggccactgtggtgaaaccctgtctctactaaaaatacaaaaattagccgggtgtggtggcgcatgcctgtaatcccaacgattcaggaggccatggcaaaagaatcgcttgaaacccaggaggcggaggttgcagtgagccaagattgtgccattgcactccagcctgggcaacaagagcgaaactcatctcaaaaaaaaagatacttgccattggattcagagcccacctagataatccaggatgatctcatctagacagcctttactaattccatcttgcaaagactcttttttcaaataatgacacattcatacattccatatcttttggggagacactatttaacccactacaaggtataaagatgagctataggcctgatgaggtaggaaagaggcagggcaaggtctcccagacactcatgtacctgacaaggtgagtctcaagagacacaagaaaaccttggaactgtaattgtgaaattgacatctatctctggaaaatgactattactcctaatgcctctagccaaagactatcagaaacccacctgtagctgatggagttgcatttgttactcattgtttcgatgaggacacacatcatgaggaaccatcatgtctcagctagagggtgttggagaaaacctattgtaggaatttgactttggttgggtaatatgaggaagcgtccaagaaagcctagttcactttagattagatgctgtcagaaagcagaggcaattctaaaaatgtgtatcttgattaaatcttctctgtatggaacaagagtgaggataaagttgtaaatgataaagaagtagcaatcactagccaagagaggggactgtttgctattttgtgggtgaagcagtgactttgtttttctgtgcattgattaaattaagatgtagctttgttttgactcagtttatcatggtctcagagtgacttcttctgagattggtattctgtgacattgctcatgtgcaatagaagaataacaagatctagccatgagtgccaggttacgttccagatgtcacaggctgctcttttgttttgtttttctttttcaataccaagtgataagaatgagcatgcctaaaattccagcagttgtaataaaatacatcaaccaaaaggttcagactgtcctgtaagacccataataagagtctcaatgtgttcttaaaagaacattctttcttagcctacgtgaacatccttctctagacttaaattacttctgacccacatgttgggccgtatctattttaaagacaagaggagctaactgcaaagttccttgtctggtaagctgtttcatctgatagttgtaatagcattttctcccgtctcactgtagggcctaaccccacaagcatccttgtgaagaaagaccccacagtcctctttttaagctttctccctccctttcctggggtgccttatctatttaaatattagaggtgagtcaaatgtaattctctttaatgaaaaacaaacaagtgatagaaccctaaacgctcttttggcaaagatcccttcagaacaaacaatcttcttttaaaagaagtcagagctaggaaagggccacaggagagcagggatagccaactaaactatgcagcaggcttctctgaaaaaaagtgagtgacttttttggtgtggcaagaaaaaaaaaaagtaaagtttgatataactagtagtccttggaatgacaagtgacaagagaggtctcttccctccctatagtcccaaggagaaaagggctctgtaaaattaaaggcacaggtattcagttgaaaggacatatttttctcctctaacttataattagcctgcgatactggcttctgtaggctcttatgaaggcaaattgctcaggacagtgactctggcgatgtcagtcatacaggcaagcactgggatatctatcacaaacacatgccagttgtcatcttccaaggcatcacctgattgccaactcaggtcaggaagaaatcattcctctttcttcttctgtgatgttacttatctgttgcaacagaggagagggttagcacctttcatgacatattccagcatcctgttaaattgatcagaagaccaattgcacacagtgtcttctaccattgagattggaaacacagccaagggtggagatggtcagtgaggcttcccagtgtcttgcaagttccaggtcagttgtttatgcttagagtcccctgacagagagatggatgtgttagcaggttctagggcctgtggtttcccttgtggaaatgccagtggaccatgtgtgctccttgggtatcagggtgattgggcttgggttggttgtggccacagcatgaactggagagtcggctgtatttggcatgacaaggttggcacaggccagctgagaccttgaaaaatttggagctgatgcagaggtgaataaacacattgaaaacagaagctgcaacctcaaatttctacagggaccagacaggtaatatgcctgagtgaagcaggccaggtggcaaattgtacagtgcaggccccaatcaaagtgcacagtggccactcagctgccactggattataattgtgtagagatgtgagtttagagttgtcagcttttcaagagaagccaacagtctggtgtgtatgttaaatcccctgattctggcatctaattaatgcccttagcagtccaaaccaaacaatgtgtgagctgccatttttgcaaccttgagctaatggtgttaacgtccagtttctttgtttcataacatctatggaatggctttgtgaatgcaaatgttgaaacattgtgagtctcatccccaacagtgaaaataaatacaaaatttaggcaaaaaataaaaataaaaataaaaatacttcttaaatgtcacagcgcccccatggggctggctggggcaacaaattaagggacacagctgagctttcgattctgtcagtaactaagtagtaatggtgcctcagggggtctgagtcattgaacaagcgctacaggatagcacaatactaggtacacaaagtaggcgagcacaggctccctacctttgaaaagtttataagttcattaacagtattatgtttccatgcactggagcattagaggaaaaatgccacgataacatctaaacaagagtgcagtgggccctgagaagtatgatgattctgtttccttctttaaagcatctcttcttaataatgtgcagtagtagagagaatagaaaagcagcatgatggccatgtgacttgctggatggatgccatttctgttggatgagattggacatcaataggtaaaaccaataagaggttgtgtgcattttcagattctggaattctggaatctatgacatttttggaaaaatagctctcctaagacactggttctaaatatagcagtgggtttcaatagttctatgaattgaaatcaatagtactaaggagcgaagagcctagatcactctcccaagaatcattgcttagatgagtggttctcaaagtgtagtctctggccaccagcatcacctggcaacttgttacaaacgcatattgttgattctcattccacaactattgaatcagaaattctgggactgagtcctagcaatctgtgttttaaacaagccctccaagtgatttaatgcatgccaaatactaagaatcactgttatccttggaagaggggaaagctcagataacccacaattgaggtctagagatgttcatagtctcttctacaagtaagtcttaccagtgagctatagtagagataaccaagatagcatgtagctggaggagctgttgcttatttgactggattttttggtcattttttctttctcacttatgtgtttgttctccacttgttttcaagccccattgatttctgtattagctttctattgctgctatgataaattaccacacattttcatggcttaaagcaacacaaatttatgagagttctgaaggttagaagtccaatacaggtatctctggataaaatcaaggtgtcagaattagagcaaatcccttcttggggcctctcgggaacaatctacttccttgctttttccagcttctaaaggccacctgctttctttggctcatgggcccttttcttataaatgcagatgttgtttttaaaaatgaacaatgttaggctgccttcctcgaggggctgtctctcttgttctcactcttctgcctccccttccacctttaagtatcctgtgattacattgggtgcacctggatgataggcaagctccctattttaagatcaactgattagcaaatttattcccctgtgctatagaaggtaccatattcacatgcttcaagaattagaatatattgtatctttcatgggggaggtacattattctgcctaccataagagattgtattcggagggcttgtttttttttttgttgttgttgttttttcaccaggaaatggagcctggtgaaaaatgtaatatatagcctcttcctccacactactaaactacctttctgtgtcctacagagactgtgtaatattcactggtgaagacataagctttgtagtcacaaacctgagttgacgttcctactctggcacttactagattgatatggtttggctgtgtccccacccaaatctcatcttgaattcccatgtgttgtgggagggacccggtgggaggtaattgaatcatgggggtaggtatttcccagggtgttctcctgatagtgagtaagtctcatgaggtctgatggttattataagggggagcttctctgcacaagctctctttgcctgctgccatttcacgtaaggtgtgacttgctcctccttgccttctgccatgattgtgaggcctccccagccacatggaactgtaagtccaattaaacctctttcttttgtaaattgcccagtcttggatatgtctttatcagcaccatgaaaatggactaatatatagatgtaataactttttgcaagttatgcaattttgggccatagattcctttattctgaagtggagaaaatactttccttatacaattgttatgtttacataaaataaggtgccagatacatagtagaaataaaataaatgatgttactacttcctaaaatcctaaaagtttcatttcagattgctgagtaaacccagttaaagaaaccagcctctgtgttttggtgttgtcattaatgctaagttacatttccttagggtatctgcattaagcaaatgtaagatgtttgagtttcaaagatgaacaagtgacttgtaagtgtaaagtggtatggctgtttttaataaataggtaataccacccttttggcgggtagtagagaaaagaagatgagtttttagaaaaagactcagagttactcagaattaagaaaatgaatccttactgtcaatatgagtctcccaactgctagcgcaagtggtggatagattttcttttccactagatttacttcctgatatacacatttatcactcaagcatggactgttcatcaagtcattttccatctataaccccagctgaagcctgacaggttgtgtgtttattatgtactcttaaaaaactggagctcatttgcccctgctgcggggagagcagactcagacagatagagggataaggtcattcagtggaatgcccattcactgcagtcaagcctaaataatagagaggtgtaaaacaaccaggaaaagctctgattattgccagaaatcaaatattgatcagatagtcccctaacttaccaacttccctcttaatgatctgattcccatgtattcattcatcagttagttgagcccctcctatagaccaagccctgtgcatggctataaaaaacagtatgtccatgcccacttccccctctacactcaatctggagccatgagaaattaaataacctttaatttctgaagatcgggtgctcttataaaacatcagtacttataattgtatcctgcagtggaaaattgtgcaataatctttttctgaaggcatggccatgaattgtactatattactccatctatcttcttttaacactaaacaaaatgaagagaatacattgtgcatggcccctagaaatttaccttcaaatagaaacaaagctgctaactccacacacacatgatatgctgaaaactgaataaatattgaagaatctaaattcaattaattagcaagccaaatcttgcctcaaattatgttgacattatttattcctttgttgattaaatgagttgcctcttaagccaaaagagaagatcttaagctcttgtttcttcattccaggtctcttctctccaaggaatttgggaaggagcaagcacagcagaggccagttttactgcatgctggtgctcagagggaatagggttcatagagtagaagacagtgaggagagaaccagtaaggaggttggggagctggatagcatttacagcatgggttcattgattcattgggaggcttataaatttcctatgcatagaagcacctgtttttaaacagagacatgtattcaacacatgccttcgagaactaattggaaagagtctttgatggcctatcgttttgaatttgcatgaccagaactccactatccatgcaaacacagtggacttgctgcaattgtcctttgacttaggcaactttaacaatgcaggggaggaggggtgagaagaggctaggagaggaagtgtcagtgggagaagccaagaataattgaagtagtgtgttatttcttttttttttaactattaattttttttattattatactttaagttctgggatacatgtgcagaaggtgcaggtttgttacataggtatacatatgccatggtggtttgctgcactcatcaacccatcatctacattaggtatttctcctaatactatccctcccctagccctccacccacctgacaggtctcagtgtgtgatgttcccctccttgtgtccacgtattctcgttgttcaactcccacttatgagtgagaacatgcagtgtttggttttctgttcctgtgttagtttgctgagaatgatggtttccagcttcaccagtgtccctgcaaaggacatgaagtcattcttttttatggctgcataatattccatggtgtatatgtgccacattttctttatccagtctatcattgatagacatttgggtttgttccaagtctttgctattgtgaacagtgctacaataaacatacatgtgcatgtgtctttatagtagaatgatttataatcctttgggtatataccctgcaatcccattactaggtagtatggcatttctaaccaccctttccttccatgagcttaggcctgggagttgcagtgagtgggagccttaaatctaccaagccgcaaatttctgtgttcctgaggcctctcaaggcatcaacatcttgaatagaaaataagtctatccttaaagatacagtacatttaaagattaaaaaaaaaaaaaacaaaaaaaatcatgttccctaaacacaaataacttcatctgctgcccaagcaaagaaacaaagagatgtctactaaaggcaaaaatgccaatgtcgtgcttcctgagcacagacattgcactgcacagaatggaccattttggagactttcaaagacagttttgactcagtaatctcctatgctgactttattacctaactgtgtcctgtggaggattaggtgatagtggcaggttaggtccatgggagattggattccactgtgatcagcaaacagaataaccagcatgtgtgaagtgacttttgtcagaggagtgatgaggagtgctctctgaattcagtgttttccctctttaatttttgctaatcatgggtcatttatctgtgagctactgcattgtttccactgcctgctttccaaccagggataggttttatctcaaaaaacagaagacaaaacctcttaacctaaaactaagactccctctgggagattccaaagagagacggctttgatgtaatgggaagggagctgatttagggtctaataaagtcttctaccagctgtgtgatctttggcagtttctagttccctaggtactatttgcctatctatagaaatggggttaacagcacctactgctgaagttggtatggacataatgagataccatacatgtaaggaaatgaaaagtattccacaaatactccttccctgagcttgttccttcctttcaccaaaacacacatattccatctttcaactctcctgctctacacgtgtatgcttgagtttagggccctggaataagcaatcctgggtcaacatctgctctgcaaacatcaaaaagtgtgagcaggggcagcctagccttggtattgatgtgtttcccatccacagccacattcaccattagacccagtattagtcactgggtccccggggccagcatttactgttgccttcaaaaatgcagactcattactaacaaaagtggtatgtccattattatgacctatttagtggcccagcaaatccccaaattctattgagccacatctgtctaccgaggggctctgcggttgattgtctgagacggatctgcttgcaaagaggctgatttgggaaagttcaacagccccacttagttgctctgtgacatcctgacttcctacaggttacttctcatattgttgggtgtttgtttgtttgttagtttgtttgtttgacagaggtctcactctgtcaccaggctggagtgcagtggcatgatctcggctcactgcaacctcctcctcccaggttcaagggattctcctgcctcagcctcccgaatagctgggactacatgcacaccccaccacaccaagctaatttttttattttttagtagagacgaggtttcaccatattggccaggatggtcttgatctcttgacctcatgatccacccgcctcagccttccaaagtgctgggattacaggcatgagccaccatgcctggcctcaatgttgtgttttaaagttcagctggaagatacccttattcctaagaaatccactaaagaaaactgttcttccaggagttccatttcattctctgggaagggtccatcccttgttcctgttccctttcctctgaattctataggacatatcacagcaccttcttgctgcctccttgtttgtgtctttcattaaactgtaagctccacacatgcagggactgtatttattttttcagagatgtgtcttcaacactgaatgcaacagtgacacttgacaaatatttttcaaacacattgaaatgagtttgatcaccacctgggcattcacagtagtccagaggtcccctgcactgtgagtgtgactaaagctcaggaaagtcagaaaggccagccaaggaaggaagatgctggcaagactcggaaagtgcaggagtgtatgagattgaatcacctggacaggggcacccaaacaaaggcgtctgctggctacgtgactttggttaagttgctgaacttctttgtccacagtttcctcaacactaaaacaaggagtaatcattatatctactttatagggctgttctggggattaaattagttaatatttataaagcatttaaaattatacatggtatgaaatgagcacaaataagtgggatgagggagacataaacaaaagttcctaaagtggaggttaattcagagccaaagacattgcctgggcattagaagtagtcagacatgaatttgagtcccagctaaggcatttatcaactgggtcggccttgaagaagccgcttgcattctgagtcttgctttccatagctatgaaatgttctcaatcacagttatctcccaggattgttaagagaagtttcctttaaatgttcagaatagtgaatggcatttcttatgtgcctaataaatattaactcatctactgccatcccttcctttctttccctctcattctttctcttttcctggcccataactttctgctcagaactggaaacatctttgaaggagggagaaggagcatgagagtcaggggcttgtttacaaaacaaaacatggaaatagtaaaaacaacaaatctaatagtctctgaaatgattttgtctcccactaggaccagaaaaagcagcagaattttatgttaatggattcggtggaaaatacggctttaatgaaacattgactatgattactctgttgtcatttctctgaatttctggtcctctttccatctctcttttaagaagatctgaatggttatttctcaacacaccaggattatgttttcttcgtcaagagtttgaggaacctagggtgcagcttgagctgctgagctgtctgtctttattctgacaggcgtggactccagtgtttagctcaagccccagggactggcttttgaacagcagctgttctcagtgaaactgaaatgcgcagaggggaggggaatagtacaccctgggaagtacagggagcaggtaagttgttttgctaatacatccctggggaagtttctagtgtttctgggcatggctgagcgcacagctcataaaaaatgcaccagatcattgttggcatttgatgtcagaagaagctacagtaccaagagacatggactgtctggtttcctgtgacatccaggtgacacaccaggtttccactgcttttcgtcattagcccagatgttcccagttacttggacagagagccttgtagatccctgtatatggagtcttccttcccgtggttcattagaaatggcaaagccaaactggcagtattcttcaatttgttgataagagtgcttcagtgcatgtatttacaaatacacattgttgttttcaatttgtttattcagtgaatcaaaatagcaaaacacattaactataagacaagagaaggataaggaagtaacatctattgggtacctgctatgttccaggcaatgacagagctgcttgacagaaaatgtttaatgtcttcctcattgtagctacatgtggtgtttcaggtatgattactgcatgttacagtgggaagtagcccagcattcttgaaagagtatagggtcctcactatctgtgtgaatttgagtagttacttaaaccctctgagctttattttatttctgtaaaggaatttaacaaagtggctaatagggtgtgtagggatgaagggacttttaagtttgctgaaataaactggaaatagattagcaggagagaaggcgtacaaatttattaacatgcagatgtgcacaggatccacacaaaatgggaagactcaaagaaaggccagatagttgaaggttaaatacccttttcataggggagagggaaatgggggacattgccaattttagagaaagagtaaataatttttagaggagatgagtggcctggaagaacagatgatagcctgggacaaagttcctctgcactatggggcaggtgatgacaagctataggaaagtgagggacagaactgcgcttcaaacaaaggttgttttattatacagataaagtctctaaggtaatggcccttagaagaataatgggaagaacaggtgaaaactctgtctgggtgtgttgtgggtgccctggaggtagagacttcttcttatctctcctgcatcagagttaatcttctctggttagtgtagatttcagggagcggtcaaagaccattgcattccttctggataaactttcttctggtgagagaacttcagagagagcccctccctacacttaggaaaggaatgtggggggtggggaaagctgtgcaggagaaagtcagagaaagaccttggttctgaggcctttcaaccttctttgttcaaagcaatcagtatgccaaagtaccatattttggggtatcattttctgagcctcaacaattgtcatgaagattgagtatgattgtaatataaagggctaacatttttacttgacctacatgagctgatcagtactgagagctcctcttacaagaaatggaccagagagggagggaaggggaaggggaggaaagggaagggaagggacaaaaagaaagaaaataaagaattgaggttcaggaaggttgaataatttaattcgcccaaaggcttacagctgctaggacgttcagccaaaaattacacccaggtctgatttcaaagacactaaaaccactgtttacttatagctacttagtgcaccccatctcatcccacccaatgccacctaactcccacctctattgtgagataactacatgcacgcactcatttggtaagtgggatcctggtgcctatttgactgacatttgagagttagcacatacaggtggcacaggtggtatctgcacagaaggaggaaggtggtgctgacacctctggatcttacacttgggtttagaacatagctggtcactaaagccacagggtagtggcagaacatttggatacatctttaaagactcaattagtatcccctcactgagtccccatcttattcattggttagccccctagactgaactgtcaaaaatgttctaagtctccttgtgttctctttatctttgtttttacaatcacaacacaataacaggagatactttttaatgaatgggcaggaactctccactgagatgtaaacatgttatactgggaattctgctgcagggttaatttatgatgatggagtcatctatatcatagctgaaagcaaggctttggggaagtgaaacccaggaaaggtcagttgtaatgcgcattgtctatattttaatgtaaaataccaattttgttgggaaaagggtggtcgggaaagaggtttgatccaaaaggttggaagttggggaaataattcaaaaagaaaactccaaataaacaacagagttggctggtcagttagccaaaggacaccggaggattcctgaaggtctgcatgtggtgagcacaaacttggtagggaaaaggcaggaatctgggtggggagaaggtactagaattcacaaggaagactcgtaaaatggaaactacggttgctgaaacacgttgtctactctattaattttctgccaaacatttcatgtgcttttagttcttcattgagcatgacatacttcaaatactcaaacctatttccttcttgtaggaatagctaggcatttcctcccacggtccaaggtgagactgaagataagtagaatctccacacttatttgtttactttggtccagactatagagtcaggttaaaagccatctggggaaatagccagtagccaatgcttattagcgtactacttgggtaggtgggaggatgcaagagctgtcaaacagcagccatcctgatgagaaagtgaagaaagccagaagcagcgtctcttctgtggcagtcacacagggtcccttgatactcagcccccaacatgagattgcctcttaggagaattctagaggttaggctaggcttgagacattatagagaacaggttacagcaccccatttttactttattggtaactgagaaagtaagatatattcctagcctcccagtcttagtagtaagaggtacttttaaactgttaatttttatgagcaacacagtggtatggccggcccttcctcctccttcagggagttcatttgatgtagtttggttgattcccatgcatgtggaatagctatgacatcatcaaattaagtgtacactatgtgctaacaattatcggggtgtcaagagtgaaacattcaggtcctattggcagttctaataggtgaatctcatctcactgttttatgtgttcagtgaagtaaatcttcagtaagtctggagtagctggggaagccttcgccaagaggtgaggtctgagctgggccttgagcattgctgagatctgaatgggtggaaaacagaagagaggtcattccagtcaaaagcaagatgtactcaaaaaatagcaaggaaaaacagatcacctggatgagatagcatttggggaagggtaagactatagtatggttggatttattgaacaggcacagtgtcaggaatccaactggctactttatatacactacttggtgttttatcctgcaaagtaaccctaataaccagtagcatttgctgagagtgtatgtgggtagcaggcaatgtatgagatgccgggaatacagagaaggatgattcgatgtttgccctcaagacctcagaatgtaagtctaggatatagtaacaaaataagtttattctagtataataggaatatatacactttaccaaggaagcatagagagcagaaccatttgctttgcctgctagatttcaaaatgacttctcagagatggtgagttctgagctgggtggtgaaggatgtgtaggagtttgtcagataaggagatgaaacaggcattccaggaaaagggaatagcaagttcagagacttggtatagtcctaaattatgtttgtcttcatttcagctagtgctatttcattgttgctggagataacacacacttggattccgttacgtattttcaccttgccaacttgctttgtttgcagaccataatttctgagtttatctctacagcaggttttcagccaaattgctctactaaaataaccctaaaaatctatcacctctgttttctgctgctgtcactggctgtttgtgtccttacttttcagtcaacctcaatggagactggaaagagaaatacaaattgccccagaaagagaacacaggcccctctcttcagcaacagggtgtgagtggatggggaccattatcacattatctacacagacaccgttttaatccacattgccaaggaggagaggaaaatgcatggccttcacagaacatcattaggagggtgggccattgtgcagcatctattgttaatgtcaatacctacaaacatgtccagactcttccattctttagcatactcattctctgagtggtattttatgtgtattattctctgagaggtaagcacggacaagtataattccatttttatgtaagggaaagctgagtaaagaagatgcttaaagaataggtggatagaaaaatgaaatgacttcagctcataagcattttgagtacctattatgttttagtcattatggtagaaacatggcaaatggatataaacaaaaaacatataattccatgcctctgttcagattgttgtctgcccctgagattcctctttttcccactccccttgactaactcaactagccctgctttttgtttgcctgtttgttctatttattttttggaggacagggtctcactctgtcacccaggctagagtgtagtgatgcaatcacaacccactgcagcctcaccctcctgggttcaagtgatcctcctgcctcagcctcccaagtagctgggactacaggcatgcaccatcacacctggataaaaattattttttgtgtaaagatgaggtctcactatgttgcccaggttggtctcaaacttctgggctcaagcagtcctcctggcttggcctcctaaagttctgggattataggcaccagccactgcacccagtcaactagccatgtcttttggtccaacccaatgttgcacctttgcataacaaaggcaattaaagaccacttcttccctcctgccccctgcaaaaacctaatagttctcaaacacattggttcatggaactcattatatatgaaaacccatcaacatccacacaattagcaaacttaaccctctgcagggttgacattgagttggaccttaagatatattcaaggctagttggctgggcttggcttgactcccccttagctctctctataaaagcaatgattactgtattatattggttttcaaagaattctgtcccacattctgttctacttattaccttctttgcttgactgtgatagattgaggccatctttctgtctgtccctgtattaatacattcaggctgctgtagcacaataccttagcgtgagcaaaggaagttaaagaccacctcctccccctgccccctgcaaaaacctagtagttctcagactcattggttcatagaactcattatatatgaaaacccatcaacatccatgtaattagcaaacttaacacacttgaaaatgctacctttcaagtcagtattcatattaggcagactttggagatgttgtggattctgcttcataccaccacaataacgtgattattgccataaagtgagtcacacaaattttttcgtttcccagtgcatataaaatttacgttgacattctactgtagtctattaaatgtgcaatagcattatatgtaaaagtaatgtacaaaccttaattataaatatttattgctaaaataatgctaaaaaattatcagagccttcagagagtcataaccttttggctgatggagggtcttgtcttgatgttgatagctactgacagggtggcagttgctggaggttggggtggctgtggaaatttcataaaataagacaataataaagtttggtgcatcaactgactcttcctttcatgaaagttttctctgtagcatgtaatgctgtttgatagcattttctaaatttatttcaaaattggagtccatcctctcaaacccagctgctcccttatcaactaagtttatgaaatattctacatcctttgttgtcatttcaacagtgttcacgacatgtttaccaaaagtagattccattttaagaaaccacttttcctcatccataagcagaaactcctcatccattcaaggtttctcatgagattgcagcaattccatcatatcttcaggctctacttctagttaccttgttctttccatcacatctgcaattccttcccccactgaagccttgaacccctgaaactcatccgtgagggttggaatcaacttttttcaaagtcttagtaatgttgatattttgacctcccatgaatcattgatgttcttcatggcatctagaatggtgaatcctttctagaagaatatttcaatgtacttcgtccagatccattagaagaatcagtgtctatggcacctatagccttatgaaaatatttcttgcatgataagacatgaaagtcaaaattattccttgatccatgaactgcagaatggatgctatgttatcagatatgaaagcaatcataatcttcctgtatatctctttcagagctcttgggtgattaggtacattgtcaatgatcagtaaaattttgataggatgttcttttctctctctctttttttttttttttctgagcagtagctctcaacagtaggcttaaataaaccatgatgtaaacagatgtgttgtcatccagactttattgttcctttgatagaacacaggcagagtaaatttatcacaattcttaagggagccctaggattttgggaatggcaaatgagcattgacttcaacttaatcaccaactgcagtagcctaaaacaagagagtcagcccaagactacaccttcgtccagcagaagactgttttgtctgcattgaaaatctagtgcagccatctttatcaatgatcttagctagaacttctgaatagcttgctgcagcttctccattagcatgtgctacttcaccttgcacttttatgtatggaggtgacttctttccttaaacctcatgaacaaacttctgctaagcttcctacttttttttcctacagcttcctcactcttcttagccttcatagacttgaagagagctagggccttgttctgggttaggctttggcttaaggaaagattgaggctggttggatattctgtccagacaactaaaactttctcatgtcagcaatcaggctgttttgctttcttatcatttgagtcttcactagagtaggactttcacttttctttaagaactttttctttgcatccactacttggctcagtgcttggcttagcttttagtctatcctggcttttgatatgtcttcctcaccaagcttactcacttctagctttttgtttaaagtgagagacatgagactcttcctttccctgaatacttacaggccattgtagggtcattattgacctacattcaatattgttgtgtctcagagaatagggagacccaaggaaaggggaagagattagcgagtggctggtcagtggagcagtcagaaaacacacatttatcaatccagtttgggcaaggtgtgtggcaccccaaaacagttacaatagtaacctcaaagatcactgatcacaggtcaccataacagatataataataatgaaaacatttgaaatattgtgagaattaccaagatgtgacacagagatgtgaagtgagcccatgctgttgaaaaaaaatagtgtggatagatttagatttgcctaacttaaggttgctacaaactttcaatttgtaaaaagcataatatctacaaagtgcaataaagaaaagtgcaataaaatgatgtttgcttgtagttttaaagttttgtatgaaaacagtagttggataaattgtttgcctaagcctcttttgtagtcagagggctattgtatgtacttggaaaaagtgtacatgctagggacttccagggcagcttgcatccctgaggacgggactaaaaataacagagtcccctgctttgtgggacctaaagcttgtacaatttgtgtgtgtgtgtgtgtaacgtcttgagtaaaaagaattcaaaatataaaaatgatttcatttaaaatgaaaaaagataatgaaaaattacagattttaagaagttggtaaatatcaccgaaatggataaattaatttactatttgcaactaactgcttgacattcttctataacacttttttctataaaattaataatgttcgctatgaatgccttttcatgtgaaaattctgtaatattcctttctacagataggatagaaaggtaattcagtctttcctctggcctggttcgtcaaactttctaaaaaattatggatagtttttagagtttatattggtaaatttaagtgaatttttaaaaaatgttataacttctggcaaacctctatcaaagtacaaattctggtcctgggtgaccagagaggacccctaggtaagacagcactgggggtgggaggagcatttctggaagccattttgacacctggacagtagcaataacttaattctacaaggacaagattgtaagcttttttttttttttttttttttttgagatggagtctctctctgttgcccaggctggagtgcaatggcacaatctcggctcactgcaacctccgcctcttgggttgaagccattcccctccctcagcctcccaaatagctagtactacaggcatgcacctccacgcctgggattacaagcatgtgccaccaggcctggctaatttttttgtatttttagtagagacagggtttcaccatgttggccaggctggtcttgaacccctgacctcaagtgatctgcctgccttgccctcccaaagtgctgggattacaggcataagccatcacacctggccgattgtgagctacttaaagataccccaccaaagaacttaaagtgttccatctcagcaccctggccctgtgttgtcaagctgctcccccttccatcatactgtgcactgtatggtgcctctttatgaaccagacgctgcttgtgcaacagaggctgatcccactgcagagactgtatttgtcttctctttattttactggaagtctttgccaccatccggctggtaattgctccacaccacttctgaatcgattgcttttagagttgttgagcttttattactactactcattggggagagaagagagaaagaagcaggttggcctgggctctgcaagagacggatgttgtcaaattgtctttctccagctgttgaatacaactcataatgctattcaataaaaccagaaagaaaatgagagtacaagggaaagaagagatgtcagaaagagagaacaagagaacatacgagtctgccttctcttggaatagacagcaaagccatattgtgatgttgactatatcatgcagtaatggtgaacaaatgtagcaagaagtaaaagacagagctatttaaatatatctgtgggcaattgcacaaatctgccacttttgtaggtatactgatgtttcctcattcctggagctgagaaaaagggtctatgttttgctttattttatttctttcatttagtttggtaggctatgtaatttgattcaagtatgatagaatttctccttagttatacacattactgttattttgctagtaagtggctttgtatccacaatcaggacactcttatgaactgtttacatctgctattgactgatctcgttgcgtttcctcatgctttcatcaaaaggtagcagttggcagggccattcactggagaatgaggaacacgcataattagatttagtgaagaacaccctcattccaattggaatctgtctttaagaaaagaaaagaaaaaaagctccaggttaaggagcttcgaaagactgaatactgatgtaacttttgttcatgctaattactcacaacccagataatacttcgtttaatgattttatcccatttgttatcccctataacattcatctgcataaattagtttcttgtcaacctttcagaaagggtttaatgacagttcatggtgtttacttattttctaaaagtagtctaagtgagtcattataaattgaacattcaagttaaatttgtctgaaacatatataagtatcatataaatttcagattttacacagggttctcctctactaagcaggtggaatataccccccatttcagaatgccagtttaaattacttgcctggggtaaaataccaaatcagagttggacataaaacccaggtatccttattctcattctactattctaataaccagatccaatgctataatgctgcaaattataggccctatttttcgagtaggatgcatgtgaatgtcatttgtctcttaaatgcatgaatagtgtcttcccttgtggtcgctctactgcttccagcctgtcatgtcaagcagcattgcctttattattgaaatgaagacgatacttagatcattgatctcaatggcatttggcaccataagaactaccagtctgttgtatcatataaaatgatactgcctggtatgcaaatcagccagtgtgtcaacaaaaatgctggcatcagatagaatgtccaaattgctatcactctgccagttttacacctacatccctattagttcctgtctaattaccaatgataaaagtactttgaagtcccactgatttccatgtaaatatcatacaaatttggatttgctttaacattataattccatcagcttagaagttaaaatttagaaaagctgtagttcattagtttaagtcacttcaaaacttaccttgcttagttttcagatagactcccatcctatacttctaggactgtacaaataaaaaaatgaattaaaagacatttcttgatgggtttaatgttttctactaattattttgacagacagtcataatctgttctgagttcttcttttctccttccatttcaattcttcataaaacatggaaaaaactttggagactgaataagatctatggtaatccacaatagatgaggccctgaacacaacatagggaaaacatataacccacccccaataagctcaacttactgtaaactcttgaggagtaattagggacttcagcagtctctctgaaaaagccaacgcattgtaaaacccttttagtttttacatgaatattaattctttgaaagtagatgaaagactttctttaatgctaaattcttatccatagagaataatattagagcgaggatctagtgtattattcccatttcatgaataggaaacggagaagtagagaattttagggaccataaaagtgacccaagtgccatgtgtcaaagctaatatacttaactcaagcctattccagtgggttctcacccttcacttgtgccctaaggcctggcagcttatttcaggagggacacccgttgttggtgtaaagagcaagatcttttatgggtatcagttttaaggggcttatgggaataatcaatatgctatggaagtaatgaagatatttaacgtcctgaaaattctagtctaagctttgagaatgtgaccataaaattgacagggattaactttaatatttgactagttaacggtaggattttttccgttacagtgcactgtgtcaaaatttggtctcgttaaataaattcctattctatcagggatgagcttcccacaaataatgttaaaaaaaaaaaaaaaaggagaaagcatgataaaccttttttcctgtttctcttcttctaaccacagggtgcactatggcagttgcagggcttggtaattgaattcagttctgcaacctgaatacatttctactgtaagtggatctccctcctctaccagagaaagaaaatggcctcaaatgattctgactggaacacagcagccacctctcttgtaaatagctgggtcttattgacttatcttggtagggagccaaaattgctgcccagatgagtccaagcagtagccagaagagaaccagctacttatggggtctctgtctttgtgaaataagtattaagagggtccatcttaaagaaggaagagaagtatggtcaggtgagtcaggcaatgatgcttagtgaagtacaacctcagagttacggtttttaataatacgcaaaattacatgtgtaagtgtattgatatgttttataatacagcatgcccagaatctcaaaaagattaaaaaaaaaaaaagatgttcctaggttctaagtatttttctttgcatagtggtttgagggcgagtcaagtttataggtgtgctgacctttaagagagttaggaataaaagagggcattgagagaaagtggtttgggtcgcagacaccatccctcaaatagctgacaatgaaggtctataataataattggcattatctcaatttgccaggtatctttagtagaatgtgctttatctaatacccaaggtagggtttcaacaatgttgagaatctatttatgaaaaggccaagatgataatgttagctaagtgctaaatataataaaaagtagtcatgaccaccattctagacaagcttcattgtcccgcacactttatctggacctgtggtttctggatggttaagcggcttgtactcacaaagacaaattgtgcattcttggaatacattcttggaggtctgagagttttctgtgagtggtgctgaaagtgtatatttcatctcaatgacaatctcaaaaaattataatgcaagcatattctgaatgatcttgttgaccacctaataaccaggtatttttatagaattttaatgcttgtgttgagttgtgttcatggggaacaaacctgtcataccttatttggtaaggactattgagaaaagagcagagccaggttgagaacataaggaatgcatttatgtcaaggaaaaaataaaatgatgccagagtctgattttaaaaacaaagctatctcacgatttcaaatggagaaaacagggagggagaataaaatcacagcaagcttaattaggtgtgagcatcatgacctcaggagaacctgggccagagaagtcaggagtattaatgtttaccatggaactggtaatttcatttaaaccaagcagcatcagctgtcacattaaattaatattattgaaattttatagcatttatatttatttgtatttaatttataaatgggtgttggttgtgtaagtgctataagtataaatggattgtagctagttttatgtttgtgtatatatatgtgtgtgtatatatacatatatgtgtgtgtatatatacatatacacatgtgtgtgtgtatacatatacgcacacatgtgtatatacatatacacacacatgtgtgtgtatatatatatacatatgtgtgcgtatatgtatacacacacacatatgtatatatatgtaatgctaacaaaaaataatttgaatgattgccaggggtccccaagaatgagctttttcttttaaaattggcctgtactttctttgagaagccttgccacgggtagaggagctattcagtgcctattgagtcaaaatttggccttaatataaatggggaggttttcccttgccatgtttggtgcctgctaggtatagtcacttgctctaatttcagtagggtggtggaaattaccaataggcagaaaaagacagctttgctgacacctatttggttgaattttacaaaatggaaggatgaataatacctcaaaggcaatctggtagattctttgagggaaagagatgtgtctatttacagggaataaagctaagcacattgactgttcttaggttaatggaaaagaataaggctagtgtaggagccagcaaattatgtttcctccataattagagtcttataaaaatatcagcgtgaattacttgctaaatacaaattacaattgttaatgtttgttaagaaaaataattcaatttagagcaagaatgaaagaaatacaggcacccaagaacaggcacagaatacaatcactttaaccaaagcttagcatggattattttcccccacttcagcttcaagtttattctaatctttttctggggggcaggagacagtcggaggggaatgcatctgtatgtcccagctgtgtggcttctgagcctgacacccctgtgctctaacaagacccagggaagaaatccttagcaggctcttacccttatcagaacaaagctatttagttgccaccttaactccagtaattaactcagtggagcaaatttccttatttcatgtaagatgtgagccaaaactctccttgctgcacttcttctatctctgggataaagccaaacagagaagaaactcaaggaccatagaatctttccttgcttttagttttcctttgaggccctacctcccaactccctcctcacctctctccttgaccactgagtagtaccactactcagttaatactgaattttcttcttttccaagccctgcagtttactctagaatttctactgacaaagccaaatcttgctgtgatttttgcccccatggagaagcatgtattataggaacaactaaccctttataacttaggaggccctggggcttcattgcattacagagtcatacaaccataaatgcccagacatacatcaccagggttaaatcattttcagtatgaaatgatgtaatccaatttgaacactgcctcaaacccagtgcccttcatgtggtaagtattcaatacatacctaatattttaactttatttatttttacctcctccgatacaaaaaaatgtaaataaccctcaatgatctgtaaaaaatcacttagttggaacactttgttcatcctctagcaatgtctgataagttagttatcattacatcatgaatcatgatactcctcatcaggcagtaaaaatacagtaatttcgtttaattgaagggaaatacatgtttaccttggtaaaacttatatattatctttaaataaataaagggttatcttgttcaaatagcttaaacccataatcaaatgttgcttatagaggtcctgctttaaggatctcataatgatttgcatatcattagcttgtcagaataccatcctaaaccttgctgatatctgctctctttgcagttcattctttgttgcatccaagtattacagtaagttgttctctggcaatttgtttatactaatgatttgacagttattttttgacccttgaatgacataattatgttaaatacagtttaggctagcttgtgttcaaattgacatgaatttttaaattagtaatgttggtatctagtatatgacagaaatgaaaaataacgtattttgtatttatgcaagaaattatctgtaccgatcaaaactgacctccggacacaagaccagactggacttgcatatgttaatgggaaacaaaatggggaaggggctcctaattacttaagtttattaagaatcccaggatacctcttagaatggtagaggtgatgttagcccttatgtcctggacatgatccagtttaggtaattgctaattacaatctgtctacttaattcccacggcccttgcttctgaatgttattttcttcacttagcaatatttaactattatttgctcttggtgtgtgactgttggaacatctgctgattcctccttctacgttcggcatgatttgcttttcatttggttatttgataattattattttcatattatttttgttctaaatatgtctatagatagaaaacagaagccctgtaaaagttttagatattttttaactgcgtgggctggactatgctttgtcaatcgagcatacagactttctggatgtaagtttgggaacagtgggcataccactggcccatgaaacactcactataagatagtgtcaactcagaggtgaatcacagatagaccagggttttcagtgtcttcaaaactagggctgaaatcacagcacttaggggcttataagtagatccctctaaggatctatcctattctggagccattccaaaacaagagtacctctgttttgggtgctagagcatgctttatttcaatcacaattcaatggaactgaagaacagaattagaaagtgatgagtcaaaaattcttattcaccgcaaatacagggctagataaactccaggtattccacacagtttccatccctctgaaggaagcgagattactcttgtgtccgctcagctatgagcaccttgatttgggatatattgcttggagttcagatggagaagacatccaggttttatctataaactaccctccatatctctaaaagttacttagaggaaatcactgagttgaaacttcattcattccctagcattgtcagatgaactgaagcatctttttcaatagtcaatatatcctgagccttcttagtgaacacagtgcttagaactttcaatgaattcacctctctaagattatggactacatattccaaatgtgtagattttgacctaaattttacccattctacagaaaaccaacaaactccacctcagagagatgttctcactatatctacccaccagggtaccagtctaaaaggccccaatattttctcctgtgttttctgaataattgtgtttgagctagagccgggagactcctcctgtggcttttattaatggaccaaagtttggttcctgtgaggactgcaatgtgtgattcaaatgcccagtccatgattcagctagtgaggggagtaacccattttatcagttgtgctgtcttccactgctgttctctatattccatcagaggaaacaaatggcttctattgtgcataagaatgccatttagtcccaagcaccatttgaaatggaaatgaggagtaacagtaacagaagaacattggctaataattgtgctctgaatagccatttggccatgtgggcagggtaaaggtaattgtgtcctagagtaatacatcttctgagcattccctgagactataattgctatgttgatgggatgcatttttaaacatgtgattgcggctcttagacttaaaaaaaaatggctattttcagaatgatctgactttaagatgtcaggcaagattttgaagtcagaataacaacacacaaacacagatctaagatgtattattgtgtagctacttgtctaactgcatttttttttcttaagtctcaccctgtcttggtgatacacagattaatactaacctcctaccaaacaatccctgttgccactctactgaaaatacattcttgccttccacaagcagaaggctgagtgtctttgtggcttaggagagaacaaaaacacatctatgtattcattgccttgttcacttgcacaaacggagaaaactctttgaaaacatcttcctttctcctgagtgaaagaatgagcaggcgctgcctcccctgatttactgcacccatcctaatcagggtagatgattctgatcttgcattaaacaattactatgcaggctctgggcttaagttttgacttaagtttagaaattgagtagttcccacaatgccctccatttctaaatgtatgagaagaggatcaacaaagaaaaaaattaatgggcttttgaatgagcaacgtgtgtgtgtgtgtgtgtgtgtgtgtgtgagagagagagagagagagacagagagacagagagaggcatgatcttggctccctgcaacctccgtctcccgggttcaagtgattctcatgcctcagcctcctgagtagctgggattacaggtgcccgccaccacacctggctaatttttgtattttttgtagagaccgggttttgccatgttggccaggatggtcttgaactcttgagctcaagtgatccgcccacctcagcatcccaaagtgttgggcttacaggcgtgagccactgtgcctggccaacagaacatattttaatgtctgaaaaaaaagaagaatctactttaaacatcaccagaagggatacacccttcggtgtccccaggccttgctggcttgctgtgggtataaagcattaattcttgtcatttgctggttatagtcctccaccaaaactcttcagttcttggcctctaattcaagctttcttccaagtttctctccactctcactgtgtcatttctaggaggcctcagagttttccacgctagaacacagtcggtactctcatgtgtgttttcattttagcctctttgttgatgtctgctgcctgtcaatccacctgggtttgtaaagtccctgaagcaattcctgccatgagaatgttccttcatccagaatgctgccttctatgctccccaaactcaaagaccttcagggaccagtaaactcaactgcccaaagccaagcacagctgtccacagaattggggcagagattcttctccataggactctggcctggtgcataggtttggctgaggaaaagacatgcttttctccttccccttttcacttctatcccttttcaccaggactcttgaagaatattctcacaggcctcgtttcccctcaggtcagaaaatatgtgcggaacagaccctgagatgctgactgtgcaaggctgttcagacccagtcaggtcaggccctgaatccttgtgatatggaatgagatatgataaattggaaattgtctttaataaattgccattcgtgataattctagtgataattaatctgctgaggctgctataaaatatcatagactgagaggcttaaccaatgtatttccacatagttttggaggctggaagtccaggatcaagaacaaggtgctagccaattggctttctgtgagggatcacttcctggcttgcagtcagctgccttcttgctgtattctcatatcacctttcctaggcagatgcatgcagagagggcaagtgagctgagcaagctcactggagtcttttcttgtaagaacactaatcctattggatcagggccttcacttttgtgacctcatttatcctcaattccttagaggccccatctccaaattcagccatattaggggttagggcttcaacagatgatttttggggcaagtattcagtctatgacaatcctcatttaaactcatcagggaccattgataaaatgctattcattcttccctatgctggtgtggaaatttgccacccaatggatgcctgcaatatatgccagagactttaggtacgctgtggcatggcttagtgactatgagaagactgacatattagcttggactagcttttgttaagcaaatggactattttacaatccaagaaaatgaacaaaattccgttttacttactcaagataaaaatgcattgatactgcaagacatatcctcactgaaagatagggtcacttaaaatatcccatttaaatgcaaaggacactagaaagtatagcaagacaaggtaaagaaaataacaaccttgctaacatatgactaaaataggaactggcagctgggggtgatgagagaaatgaaggcagtcagctacacactgactgccggggagcatcctgcacctcagataagggagcttccgcaatgaatgcctgggcctttggctttgtttcaagtcttttgatctagcggagtccataggatcatttttcccgtgggccagacctctggagaagcaattggcattgttagtttgcactgttagttctgaagctagtttggtaacaaaaagttattgtagtaagtgcacttgtgtgtgtatgtgaggggtgtggatagatgatcatgttcaagtctgtagtagaaaatttctaattattgagtctagagaactaagaatacttataggaggtaattaatccttacccgacatgtggaaaatgtcttataacccttctgtttaatttaacaaaaatatagtctactgttcagatggttaccactcggagcaactcaaactatttccctacagattttcctgtagagaatgaatgagaaatttttttgtttgtttaaggcctgaaattttactaccaaagtcaaattttgagtattgattgttgagtcctgaggatggttatattatcatgacaaatcttgcttattgtttttaattagacaaaattttcaaataactgtgagttattacatatctcttttattatagtgttctatagattgtattttgtttcattacccacactacacacacaaaccacatatacacatgcacaacacacacacattctttctatacttcatgtgaatgctttgagacaatcctatttaacattgacaatgaacaggacagctggtctctcaataaaatctaagataccacagtagtatctgcaaataatatataaattagaaatatttggaatgtttagtttatttgctaaagctcttcagaactataaattacaatattaatgaacttatttttaattcccatcactttcatttttatagaatccagaaataatgcatgtaacttgccattcctccccattagtacacttgagtccaaaggagaggttcacagcatcgtgctcttttgtgatgtggtttagaagaaaaccagctcaggacaagtggactctgaaaatagcagactttcctttactcatcttttgagttttcagagaagagtagagattcagttcattggatattttctttgtactaggctccatgctagaaattggagaaaataataaatgagaacctatctttaattaccattctagaaagaagacatgtacattaaggataatatgtaatggatgtcataatataaatatgtacaaagacaaggtgtagcatagaaggcagatgaattgttatgttgattggagtgtggtttctgttaagggatgacattaatgaggtatcgcctttgcaacttcaagaatgaatagaagttaatcagacaagaaaagaaccatttcacaaggaacaatatgtacacataattcaagacagccagaatgtgaagtaagaggagactcaagttttgtcagcatattatataagtaagggtgagttttggctttgagagttgctttgttgtgtttttccagatagatgtttttcagatatcttctcccctgtgagaaatttctgcaggtttgattgatcctttcagatgctttttaaatatatattagtttcatcactttaccacattgagagtccatgtatctttgactcaaatgcctaggaacagaagatgtgaggaaagggagagagagagattctgtcatttaacaattattattcaagtacctaaaccaaatcgaaatgcctaaaggaatgcagtgggtgatgtaaaagaaggtgtagggcaggtgtaacaacacagaatggtagagaggtgggaggtggggggacgggagagtacgcagctcttctaaggtgggcagctgccttatagcttcagccagttgtcacacagcactggttttgtcagttttcagttctttgaaaaaattggaaatgtgaaattttatatggaactgtcaatttgtggaagttagaaaccactcgcaggccagcactgggaaggccatatccagcctgacttgctctgttttatacaccatgcactctcagtggttgcctcaagggctttagaaagaaggtcaaccctttgccttgtggcttttgtgcattgctttcttaagaggaacataaggaaactctactgttctcagctgctgttgtggttacttggccatttgtaagacttatatataataatgaagttgtcttggagggctgccatgtccgtgatgtagttgcttatctaattttgtaatcttttatcaattccctctacagcttgaaggccaggctgagggtatggtacagaatactaagtggtttcaaatcaagtccaatctctgttgcaatttttattgtgataacaagatatattattaataacaataaaagacaataataatgtattattatattgtaagcttaccatgaagtgtatgggcaacccaaaaagatattcagccatcattaaaatcttttctaatcacagccacacatttcatattatattaaggaaaaacataaaagcaatcttgatgttaagtagaattagtaaagacctaaaggagtataaccgaataaacacaaagtagaataagtaggccagaatatgattgtattctatcaacaatgttatatttgcttagaaatctcttatatttcttcctccaaatatgcgtgcatgcacccacacacacacacacacacatacatatatacatatatgtatatctgcaattgtctaaaggtagatggtatagcataaaggttaagagtgtaaatttggggttcatactactagagtttcacaactgcctatgtagccttccaaaaatatttagcatcctgagctgcagttttctcatctataaacaaggattaataatagtatttatctttgtactattagatatgattgaataagatatttcatgtaaatcatctagcgtactgccagatatattttatagtcattattaatgcaaatcattattgtatcattattattactggagttttaactctctggctgttggcaggaggcctcagttcttctacccatgggcctctccacagagctgcttgagtatcctcagacgtggtggctggctttacccagggtgagtggactggggggtttggggaacaaactaggtagaagaacacctctaccatgtctattctttagaagcgagtcacgatgtttggcccacaataaagaagaatggaaatatttgctaaagattttgcagatgtattttaaagccacaacaaggcaaagggttattattcttaatttgcagaagtaattgagactcaatgagattagataacatacccaagaaaacacagtaaattgcataacttatttactggagctcctccccaaacccctaaactatgtgacattcttgctttaaaaaaaaatggattatacagcacgtgtcaccactgcattctcttttttatgttgttcatgtgtgtctgtgaaatgtgccttctaataaaaatttgaggatcttatacttttccagaatcattttgttgaagtcatgttttggagtacatttgtatgcaatccgtctgataagggaagtatatttctcactggaattagtataggcggaaaacaccatcaatcatagtcatcacaaagcaattaagtacctaattgttcatggctctgagtttgctactgaaacagaaaacttcttaggcttgctaagaaaacttcttaggcttctaagccctcctggggcttggaatccaagaattcagtagaagacggaagcgtggtaaggagaacaagaactgaagacataaacaaatttatttgaaatatggttgcagtggagcagggagagtgaattcaggggaaagaaaaataaaatgaaataagatgctgaggttcaagaaaggataaaaggtaaagtggctgaatttaaatgacctgggtttcagtttttaacaaaacataaaaataactgaagaaaggctctatattttatttaacaataacaacaacaaaaatcaaagtgcttgtttatcattgggactcaacttttgcagagtttttgccttaatttttttctctctaaagcagaatttcccatcactttagattcctttccgtgtcaatgatggcttttaatcccaatttccatcattacccctcagtgaaatgattgcttccatgtttgagtatatatacatatgtctgagacttaggtcaattattttcatgcagaaatcggggagggtgctcctgtttttcatatgcatttgtaaatattttcaatcaatcatgcatttataatccaattgggaagatatgattcagacacaatagcccgtctgctgcaagagtctgttataaaattgatcagttggccaagttatgctatttttttaagttactttgctttctttcagggaagaagaaagacaaaaaagtccagaaaccagcagcagcaggtgctgccaaaatggtattcttcttatctgtgctgatttcaaggggtgtgcaaaagaatgtgtagttgcttttctctctggctgttgggatggcgtctgtctctctggcattatccacttatttgatctagctaagtataggagcagaaataaattaaaaatgctttttcccagaagccccaaggatgttattcacacattctcccttctactgatctctgccagtggtgtgtaaatatatatttagggggaagtggctgaagtcaaaagctctgttggatattctttccctttcagttacttaccttcttatgcacaaatagaaagagagaaatcagaatagcagagaaattaacagacatgacagcacaacaccttctttcccatgtgctgatttgaagaggctcatgtatttatgtcacaaatgtcaaaattcaagtttctaagcaaaagaaaaaaggaaaaactgctaaatgttaagtgatttgcttatttgaagagttgtattacaaagcaatggaatgggagagctctcccagcccaggaaagacaaatgggaagacgggtctattttcattttggcattggacagaaggcagccttctggcctgctgtcacttcctatctgttcagtcttcgttttgcttccccgctgaccatggatcggattctgactcatatcagagactccctcttctgatcctatttatttatctgaggattttttcttttctttttccatagactcctagaatccagaggaaactcagtggcatctctcatattatcctaagctttctcagaaatgtgacatcaatattttaaaattttcagtagttatcaatatttcttaaatctagcagtaaggatggtctttgaaatatcttttctaaattccttctgttataataaaagtcagtgctcttttatatggtttggctgtatccccacccaaatcttgccttgaattgtaatgactcccacgtcaagatggggccaggtggaggtaataggatcatgggggcagtttcccccatactgttctcatggtagtgaataagtctcatgagatctgatggttttataaatgggggttcccctgcacgagctatcttgcctgctgccatgactttgctcctcattcaccttccatcatgatagtgaggcctcccaagccttgtggaactgtgagtccattaaacctgtttttctttatcaattacccggtctcagatatgtctttattagcaccatgagaacagacaaatacactgtttatcatattcttgacagcaataaaacaattgcttactgtcagctcttaacaatctttagtataattaagatagtctatttggattctttttcagagccttctatttttcagtcttttgaatgtactcttattgctaaatttggaatatttttagttttgctgcatcattttttgaatttacctttctcccctcttttgcctattcattattcaaaaccagatcaaacactctttctgtgaagtcagtaacttactccttcagaaatgtaggtacattgaaattggtaaacattatcacactttgtacatacttttacagtgactatgtatatgtgtgtgtttgcaaaactttctgcctcattggacaataaactcctcaagtgcagagatcttgtgttatttatctatgtgtcttcagatactaaatgtggcacatagtagagctccatacatgtgtattgagtaataaattaatgaataaatatgatgctggtggcaggtaaattcttggtgtttactttgaggtccggatcaatacaggatcaggatagtgcttctcttacatctgtttgcacagcagaactgtactgcactgaccagatgtctcaaagtaatgtccatcttgcctggaagtgtctttccttacttggggtcttttaccttcagaaatccaggtgcattcacaatctgcactgttattataccaactctaggtgaaggatgcatgatccaaaggtccagagtttgaaagcttgcagtctgcaaaactgccctcacttctgatttgaattgcaagttcaggggtttctccaaatcactttcagatttgataatttgctcataggacttacaggactaactgaaagctgttggactcatcattgtgatttattgtaaggacaggatacagattaaactcatccaaggaaagggacacatggggcaaagtgagagagctccagatgtgtagcttccagttgccctctcccatggggtcaaataactcctccaggcaacagtgtgcgacaataggcacgatgttgctgacaacagagctctcctaagctttggtgtctgcggtttttggaggttgggtgggtgcttcagcacatacacatgattgcccatatatatatagctaatctcggtctccagcccctcaggagatagacctgagaccatgcgccccaagtcccacaacctaagccgcatcgttggtgtgactcacaacccccaccataagtcacattgtcagatattctggcatggcagcacccacactaaacaaagatgtggctcctactaggcatgctcctcctagggctaaaagatttcttcctagaagccaagagcaacagccagaccattccctgggcaagattaaattccttactgaaccacattttagttcttccacacaggtctcaccaaacctataatttccaagtgagagaacaggaagcctcatcttgctttcacagcttgagacaaggcaaaaggaaacgctgttttgaactttgtagtcagggtgggtgtgtttacaagggatacaatcccctcaagtcaatttaaatcaagaatctatatgtacagtggcatacccagggtatgtggctgtaagtaaatcgtgttttaactctctccctctactttcttcctctcaatgacaaaattattttcagtaataattatttaataatatagtaattctcaccatattttaaaattgctcttcagttttaaaacaatttacaagttagaagcatacatttcaattttacagctattattcaaattcagtagaaatatttcacatatgacctgaaatttgaacttaccaagcaaaagtattatataacacagacttctttttttctactttactgagtgagtggacacagatgaaaaattctaagttagaaattctaagtggtcctaaggaatgaccaaattgaataactcaagttttctttcttttgtcattacaatcagtgtgctatcactttttattttaaatgttggtttaagcaaatgtgtacgtatgtgtgagatatatatatatttcatatatatatatatatataatatatatataatttcagcattaaggagacattgtgcccacataaagtgataatgagactggaacattacaaacttactccttcaacgaatgcatgtagccaatctatgtgtgatgggactgataatataaccaggagctctccaaattatcattcatgtagaatacaatggtttttaaataatcggtaatagaagttattaatttgaggcttacatatgaatctgaaatgcaacaatgtctgtagaaattgtttagaattttgacaagatttgtttgtggatggagtttctttttaaaagattgatatataatattttacatatcagtggggtccatgtgatattttgttgcatgcataacgtgtaatgatgggtatttgggatatccatcaccttgagtatttatcacttctatgtgtaggtaacatttcaagttctctcttctagctactttgaaatatactttgttgctaactatagtcaccctactctgctatcaaacattagaacttaaaccttcttctaactgtatgtttgtaaccatttgccacatctctttatcccctcatcccacccacacacccattccagcctctggtatctatcattctactctctaccttcttcatgagataaacatttttagctctcatatgtgagtgagaacgtgtgaaatgtgtcatctgggtcttgcctatttcatttaacgtaatgacttctagtttcatccatgttgctgcaaacacatgattttatccttttttatggccaaatagtattcatatatatatcacatattttccttatccttgcatctattgatggacatttaggttggttctataactttgctgctgttgtgactagtgctgcagtaaacatgggagtccaaatgtccctttgatatattgatttcttttcctttggataaaaattcaatagtgggattgctggtggatggagtattttatcactgacattgtttagaattgtgaagggaaagcagaattaaattttctgtctctttaaactcagtcatcttttctctatagcacaaaagattatgttttttttttttttttcataactcagcatctttgtgagctatgaaacttgccctgatagccttttcttgcctagggtaggatatattctgaggaagggctgggactgcccatgcattcctgcagagcattcacgggtgctatttacagtcctaattaaatggaggattattagaaacgggaaggcagctataaatagcatggtccattttatctgtttctttggtgtgtaggaagagcattgctaagattctcccttgaagttcagttaactcagaatgtgttctgcttttgttattctgctttggcttaaaaaaaagtctcctgatgctgttcaaagtggggaaaagaaaacaaaaacaaacaggagtcactctcagtcattttagcatatggacagaaggaacacagaatgaaatagagttggggaggggtgtgcacggtataagaaaaaaaaatgtgggcctaatcctttccgataacttttttttctgaaaacaactattaataaatcttatttccaagtctgtagaatattggttctcttcatccaactgtaatgtgatcagtctgttcagggagcagaggagtgggtatgggagccttccctctccgtggtcctgttagggcaccttttccagggagtggggactctgctggcttctctttcagcacactggacggtgcagaaatcagctcaactctagaggcagtgctgggattggaatggaacttgacctggatcaaatcaccgagcctttgcaaattcctgattttccaagttaggacatatctttagacccagagcccttaatcttggctcttgggataagcttccttactgcttctctcaacactcatctccacctccagcctctgctctacaagctgccactcatctaccttacatctctgatccatccccagtattcaacagccttcagcatttcttggttacctgttttaaatttcccaagttcttaacctgtgtttataacaactcatgaacttccaaccaacacatcaactccagctccctccagtactccttctttcaaaagggttctagtcaaaggggtttgcaggcattgcttaagctcatggggtgttttcgtcaatgccccattggatttgttcatgtctttgtttctttgatatatcatccttcttctcctacttatcttaattgatctcaaagctcaagtcaaattatatttctcccagttggtaattattttccccttactttaaattctgaaaacgctaatgactgagcttttcatttagtactaactggatggttagttttctttgtgtatgtgatcgtttacgtggtcgttttgtttctcaccaacacattgtaaactcttttagaattgttatctaatagaaatataagtaacataaacctgtattatatttttggagcatctgaaagatttctctcaaatggtctcatctgatccccaaagcacccctctcaggaagtaatttttttatttttatttttggggaacagggttttactctgttactcaggctacaatgtggtggcacaatcacagctcaatcagccttggcctcccaggctcgtgattcacctgcctcagccttcccagtagctaggactataggcacctgccaccacgatgcccagctgtttttgtttgtttgtttgtttgttttttaagtagagacaaagtcttgctatgttgcacagactggtctcaaattcctgagttcaagcagtcctcccttgtcttggcctcccaaagtgctgggattacaggcatgagcaaccatgcccagctgaggaggtataatattatccatagtttcacatgtaaggtaataggagctcacaagggttaaataatttgcatcaaatcactcagctggtaacttttagatccagatttaaaaattctcaacttctgactatatcctatgttttttgtttggttttgtttatagcttgcagttgcttttataattattatttttttgagacggagtcttgctctgtcactaggctggaatgcagtggtgtgatctcagctcactgcaatctctgcctcctgggttgaagtgattctcctacctcagcctcccgagtagctgggactacaggcatgtgccaccacgcccagcaattttttttttttctagtagagatggggtttcaccatgttggccaggatggtcttgatctcttgatctcgtgatctgcccgcctcagcctcccaaagtgctgggattacatgcatgagtccccactggatttgatctttacaaattaatattagcacttgttaactaaaggaatgaagaaataagtgaaagaatgaaggaataaatacataacaacattatgtataacacagatgagtgtaatgattcagcaaaacttcattataatctcttcagggcacctcctggaaacctgagaaataaaactgttttattactggtacttgcctttctcgaaaactgatagtaaacgtcctgacaagttagtcttaggtatctttccttcagttcaatagcaaatgctgtttaaaagcaaatacacagcatttatagaatgtttttgcctcttcattatattttactacataaaaatctaaaacacacaaaaaagtaaaacacaaaaacagtctaaagtgtgacactgatttcagtacaatacatctagagggaataatttttctctaaattcccaggtggctaaaaagagggctctgtggatagatgtggaaagcgtgagacagatgcttctctgagcctcgggtttctcatcttaaaatagagataattacagtacctacctcacaaggttgtggggatttgttgggaggatctaagtaaagcccttaagacactgcctgggtataaagcagctatgtagcttctagtgtcttaacattgctaagaaaagaaacacacttgccccctttttgcagaagtaagctcctttagtgattttcatctcattttcttctatactttttttttatatttgttgtgagcacgatcttctcttttttaataaattcatatttttcaattatttttattattaaggtaagaagtgtgcttttgttggtggaggaagaaggaagcccctacatgcatagcaacgtccatgggaatgaatcactgttcccttcttttctatgaacttaagattatactcaagccactccagaaaatgaccatgcagtcactgtaagcaattcctctaaaattattaaaaactgtttatgtttggagaaaggcagcccctcttgcagtgataatgactgctatatgagaggattaagctgattacatctttggaatactgagattgtgcaaaatagagggaacgatgaactctccacataagctaaggaattcagcaaaaggatgaatcaacaggagagagagaatatgaagcctctatttggaaactgaacacgtagcctcccagataaaagtgagaaagattttgagtaatatctgaagtcatgtagctgagaagttccatctacacttgagaataaaaacaaacaaacatactctaggcgatgtctatgccagttccatgaagtcatcatagacttgcaatcaattgcttgggaaaatagattttaaagttgaatttctggctattactaggataattttttctcctggacattttatgtatttatgtatctactttggtcagggtgacaaatggtatgtggtatgcagagcttaactactactcctagcccccaggccccataatcttttagtggattcagccaagcagaaatgtatgttgaataaaaccatgtccagggggtgagcagaaagaaatgcatttgaggaaaggatattatgtcaatcccaaactcgatgaaatgttctaagagtatcccagagattggttctatgaatctagtgaaacacagaataccctactcttcacagatgggtgtttatttgcatgagtccataggcatgtgagcttttgttccttagctggaggattagagggaagaaatgacataggtgattagggatgggggagagctgggatgaatatggagaaaggttagagaatgcaggcggaagttgatggcagcaatttgacttagaaccttatgggacttgggacacacgcactgtaaccttgagacctagataacagtgttttatacagattcggagaatagattatttctcccacaacccagctactgctatgggtacagctttagtgctctgcgggctcagctgaccacctgaaggtgactggctggcttggagtgacaatagaagagcctatagcacttgtaagagcagggtcctcactgagattgtgcacagcagagggagccatgaactccctgcatgagctaaggaattcagcaaaagcatgaatcagcaggagagagagaatatgaagcctctattcgattaatgaacatgtggcctcccaaacaaaagtgggaaagattttgagtcatagctgaagtcatcatgtagctgggatattctataaacatttgagaataaaaacaagcacagcaaccaatgtcctttctgttctaattaggactaacttttgagtgctagagactagagggcaggcatagccctctatggagatgggccgttcaagttttaataaatgtgttgcatttgtcatcttagtatggcatgacaaatgatctattttatattaggagctgcccaaagatgttgggttaattttagtcaaagtgattttatgcccacaacatctggatgagtttggtcaaaggaaagaagtttagtagactcataaccagaaagatctttgtcttcacctggcctgccagacttctgagggagtaatcatgcccaatatagtaactggaaggacatgccacttgtttggaaggatagaggcatagcctgagaagataaaggtgaaatctctgaaaactttgataaagaggctgggcacggtggctcatacctgtaaacccagcactttgggaggccagggcaggcagatcactaggtcaagagattgagaccatcctggccaacatggtgaaaccccatctctactaaaaatacaaaaattagctgggtgtggtggtgtgtgcctgtagtcccagctactcaggacgctgaggcaggagaatcgcctgaacccgggaggcggaggttgcagtgagcggagattgtgccactgcactccagcctggcgacagagcgagactccatcttaaaaaaaaaacaaaaaaaaaaaaaaccaactttgataaataaaatataactctaactctagatagggaccgaatgggggtataatgtttgtttaagtttttgggagacacttgataacacaacctggatatggtggagagcattcacattccttttcagtagtagcctcttaacgatgaggtatggatgaacagcaaattgctgctgacttattaattaccatgcccacaccactgatttccctatgtcttacctgtgcacacacattggctttacagcatacgaacgccaagtttgtggcgtagcatatggtgctccctcaaataagcacaactgtctgcctctctgcttatctaatcatagcaacagaaaaattgacttttcagttttcttttccccaggccctgggagatgcatatgccaaatacttggcattctttgtaacagagtcaatcataattaggattccaaattaaagtacactgccagccagggcatgtggtattttatattatttgtttgaacaaatgtattataacttgaaaatggcaaagtaaaagaattaagtaaagctcacactttttatatgtaatcatcttgcggagttttattttatcagaatgttagatgaaatcagaaagcaaagaatgtaaaatagaaaaatgtatctgaaactttattcttttaagtaacaggtttggttttttgtttttgttttctttattttcattttgtttggtttttgaaatgctcattgtagaatgttgaatatggtcagatgttgggtgtgaagtttattagaaattaaccctgaaaaagtatggtatagtcattcagttgccttttccagtggagtctgatttggcctggcgggtgtagtgaaacattaactacacccgcctcagccacccaaagtgctgggatcacaggcgtgagccaccgcgccaggccctaaagcacatcttgattgtaggttgagggtgcagtgccaacaaattctactttcatggctcttgaaattctgtgaacatttaagagccactttgacacagccatttcttgttttttgagagagggtattattgaaattctttttaatccaagatttttgtgacaatttcattcattcctactttctttacaccagtagtagctattcatattcattcttctattttctttgcatgattaactggcatatactagttcttcacattattagcctaataatagtagttacaggctataataggctattaattcattatcatctcctgactcaagtgaatctgctggtaactgagagctcctactcttgtcaatggctttgatcccactgatgaccattttagtgctattcccttctcaccatggttgagccttttctacatattcctctcagaatggttgtgccagactttcacggggagccatttttaaagctatcctcactacagaatatggcagcatttcgttggcagtaaaatcagttaaactgcatatagaatgctttagtttcttctgaataaaatgtgttacacaaactgaagtcactgctctttttaaaaaccaaagcagaataaaccgttttgtaagataattttgccactataaatatagtttcctttggcttcttcttggaaagattttatttcagcttgcactgtgagatctttgtcgttttcaccacacatttccgtcaaggaagcccttggatgactgccatgatttgcctctgctggacgcttccttcaagggctgtcaacacctctcttaattgtctggcttaaacatcaggcgagcaatgtgttaaagttagatggcaaatatacttaagacaaatatgtaaatttttactctttcaaatatgcattcaactggtgtgtatagatttcagaacaaaagccagagagagagcaagaaagagggaggagagagaaatctatatgtataaatagaaaagccaaggtagaaatgctgtgtgtgtaaatacccaatttctggattaagacgtatcacaaatacatatgatcaatacttatgtacatgcaagtgtactgcctttccaaacaccagcaaatcttggtgagcagaaatcagtagactgtccatagtgggatctagaatttgaatggaaacggtcttcaattttaaatattcatctgttttcatttgtagatatgacactcactttaagaggtgatctgagttcaaattccctaaattatatttgcatttgacttattacacatattgttagttgtcccttgaattccagtttctctttgagtaagttcttagaagatatatgtagctaggtgacttatagtcacctcttagtcattctcaaatatgattataggctatttcagattcatttcaggaaaatgtcatgtgtcaaggtgtcaattctgagcaatttttacattttgccaattctattatagaagtggctctcacccataagtagcttgaaggagtcagtatgtaatgtgccagtctcattttcactttatgtgggcacaatgtctctctaatgctgaactgttatataacctgtggtctatctgactaccatagcttcgtagatcaaaatattgttatggtcatataaatgactataatgtgggtgttttagaattgcacttttgtttatgcataactggtcccaactcaaatctgcttcatcattttttagtcaaaggatagtttttcatgtcagtagtacctcaaactccgcttgtgaacttaacacccagctatatcctgttagtttttaatcaggagggaaaaaaaggctgctatttgaactaaactgacagcttttgttgatgagctgttaggcagattaaattctgtcttgctcttcaattgttcttgaggctctgtgggacttacagtaatagaattttatttgtgtcagtaaagttgacagccctgattcagaagaccacagggagctgagatgttgattaaggagcatcatattgaccatggcttaagtgggtaacaaatgaactgagagagaagactctggatctacttttgcctgtccatgaactcgtccaaagcaaatatgctttgagttttcatgtctgttttttaatttttgtggatacacagtaggtgtaaatatttgtggggtacatgagatgttttggtataggcaagcaatgcatactaatcacatcatggaagatagatagggtatccatcccctcaagcatttattctttgtgctaacaaacaatccaattatacccttttagttatttaaaaattctattgaggctggacacagtgacttatgcttgtaatctcagcactttgggagggcaaggcaggaggatcccttgagcccaggaattcgagactagcctgggcaacatggcgaaacccaatctctacaaaaaatataaaaattagccaggcatgctgacatgtgcctgcagtcctagctattcgggaggctgacgtaggaggattgcttgagcctgggaggttgaggctacagtgagctgtgatcatgcccctgcaccccagcctgggtgacagagcaaaactctgtctcgaaacaagcaaacaaaaaattgttaaatcattattgactagagccacccattgtgctatcagatactagcccttattcatttactctatttttttttgtactgagattttaatttctgtacttagtaatagctttcaaaattgtcatgttatcccaggaaattgttatttttatccaaggcttattccatttttttttccagttgtttggggcccacaatattgtttcttttagaaataaagttagaaatattcagaataatgaacacttaagagagaataaggagtagaatacctaaaaaaaaaaaaaaaaaaaggaatcaaataaggaagagatagatagtaaaagagaagtggatgtaagcaatttagaatatattttatcaaaaattgctttttaagtggcattttctcttgctgcagaagacattattgaacaaaaaaaaagcccaatgcaattcaatttaaatttatcactctattattttaatatatttactcagggttaacaactcattaaacaccaaattgctcactcttaatgagtctctgacgctaaaattgagctgacttaaattttactgtaaaatatcagcaccattgcataaaactgtaataaaaattaactaaaagctattgaatgactgtggagtggaaaacagatttgtgacacaaaacagaaaatgtagcacacgatatgtggctggcagaaacatgagtaatagcttttattcaccaaaacatgataagcccatttttcttttgctgtattggagtctgtgaaacatgaagtcatgttttctttttttcccccattactttgtacaacgagggccagtggtggaatgatacagtttggctgtgtccccactgaaatctcatcttgaattgtaactcccacaattcccacatgtcgtgggaggaacccagtgggaggtaattgaattatgtgggcaggtctttcccatgctgttctcataatattgaataagtctcagaaagtctgatggttttaaaaatgtgagtttccctgcacaagctctctctctttgcctgctgccatccatgtaaaatgtgctgctccaccttgccttccaccatgattgtgaggcctccccagcgatgtggaactgtaagtccattaaacctttctttcttttgttaaaaaaaaaaaaaaaaaaaaaagattatgatagtgctagtcaatactgagttgactgtcaaaaataagcacactttacattagccagttacttctgggacactgttgaagagtatgtcacatgtacccacaaattagtcaaacatctttaggcatcacatgatatctaaattagtctttttctccttctccatcccctggttgtccatgaaatattggcctcaaatcagcttgcctatggccaccatggaaaccatccatcatgaacagcacctatgcccctggtacaggagtgcatttctccccaagcctacagtcttctgtgtgtcacagcaatgctgagtttcccacagaggtggcgttgatggactctttctcaactctttgctatggagtatcacctgggctaagaagttctgcttttgcatcaaatttcaatttttttctttttattggatttgaattgttctggcacttttgccactatgctgtctctcaagccctaccatcccctccatctttctaaggtctctcagaaccttagctccaacaaaacccccttctttttctctcattataacacaaatttcctgtgaatatcaatgaagcaaacagatacagtgggagctcgtgaaagacaaaggacaccgagctagtattttcattaacaacatgggctcttgtactgtcaaccaacaagagctttgttataaatttattcacaatggcaatggctttgggcaacatttagatggaaagtatttatgaaaaatatactatttatgtttctggataggaaacatactattcatgtaacaaaatatgacatttaaaggaactcactttttcttttttgttgacagtcaccgtgtcatcaaggaaatcaacatttagaaattatgattgtcactagctcactctgagccatggctctacattttatccttgtcaataagcaatccagtgttaggattttaaaaattgtttaaaatatccgtacaaagagttattttctatcttggtccacaaatttgtcaatattttccacagcatcacaattgtcagaaaacacagtgaagcttaagttaaaacaaatctgcaaagaaaaagtcaaaaagaaaactcttccacagattttcagagagatgatttattagtccaaatttgagcattgaaactagcctatattctaagtttaagaaaactgtaattttcatgtttctttcagttcaatacaatttatatattgaatacaaaagagattttcacttattgatatggctttctaggtgtttaaattctaactcaatattttaaggattcagtaatagtagggtttccatttctacatggtaggcattctctagtttacttttcctcttctttctgtagaaattaactatttttgcttcacagtcatttcatgatagacccgatttcttacactgaaattcattttaatgtttggattgagcaatggtttgctttggtcttaacttttatttattgaggtataacttacatacaatgaaaatctcaaatcttacatctactgttcaatgagttttgacaaatgcataccattgtggactccatccacatccctataacaaagcagggaactttttcaccttttcagtaccctgtaaaagttacctcatgcccaattctccccttcctctaagcaaccactgatctgatttctatcaccatagtttactttttcatgttctagaattttataaaaatgaaatgatatattgtatccttttcttgtctggcttctttcactcagcatactgtttctgagactcagcggattgctttttaataatataattacaactgagtctcaaagatttgaaaaagtcagaatttcttataaaattggacattgtggtttgctacctgctgaatgatgaagacgaataatgtacttcagtgccctgagatagtttttgtctactgtaataaaatatttccagtcttctctgtttttgcattcttcaattattaccttgaagttttaatgttttttaaaataatgaattggcctaattgtagcctcagcacaactactaagttacacattcaataaaaagactttttctttgtaatgttatatgttaatggtcagcctcctagatactgatgaagcccatcaatttctactgatagttaagatcaattaaccaattagttacccattttcatttttcctgtatattctttgtagatcacttactaaaatgattttctaagaccttcactttcttaagtaaagaaaaacaatttgactgagacttggccatttagctaaaatctaaaagacctatttaatttaaagtataagtcaagcagagatcttatcttctgtccataaataataagaatgattgtttttcgctaagtggaaaaagtgagatgaggcaagaagttgaagaatgcctagccaggtagcatatgaagcctacaagtttccagctgtgggtctgatgaaaaataatgagacatctgatggaacttaggatcttatttgaaaaataagccatcaagtactttaactttctggtatttcaaaagtaaaaacatatactaatcacttgtttttatttcacttatttgacactacacatctgtcttagtacaaactcatgtttatgcaatgagatttattagactgatagttcatatcttagccccttttcatagagaatcattgaaaaaaaaactgttcactgtgagaaaactctctcccctcactactgatcgcttatagtaccaattcagtatatgagaagacactatttttacaattattcacatccttaagaaaataaaactctataatttaaacaatgggagtataaaggtattttagaacgtatttgtatatgttaaaacaacagcatattaaaaatttaccttgagaaggccgggtgtggtggctcacacctgtaatcccagcactttgggaggccgaggcgtgcggatcaccaggtcaggagatcgagaccatcctggctaacacggtgaagccctgtctctactaaaaatacaaaaaaattagccgggcgtggtggcgggcgcctgtagtcccaggtactcgggaggctgaggcgggagaatggcgtgaacccgggaggcagagcttgcagtgagccaagatggcgccactgcactccagcctgcactacggagcgagactccgtctcaaaaaaaaaaaaaaaaaaaaaattaccttgagaaaaacaagcaaacacatgaacctaaaaaggcaacagcagatatagtgttgattgatccactgccactccagaattatttatggtagcaaaaataataattttcaatttgatggattcttatttaagcagactcattatactttttggaaaataaaatattaacattcaatataatatgactacctcagtcactttagctccacaggtgattgggatagcgctgctggcctgaataataaaatggtaataacctcagttagaacaaataattgttttactagttcagatacacttaacattataatagatgccctcataaggtgctatgtataaatcctttttttgaaaaaaagcttgaatcatcatgtaaatgttttagggcaactcattgcttagagaaatcctttgaagttttcttttataatgcaaaaactcctactgccttatctgttttgtaaattaggttgtattcgtaccagttttgttgaaaagtgaaacatccttctaagcatgaaagttttagaaataatgtctaagtatatctaaagtagctattataggacataaatgcattgatattttagtggatctcagtctagaggtgagaagagggctaatcataataattgggactgagtgtgttagaattacacatctttcccctgctctgataaaaaatatcctgccatagagagtcactgatactaatcagagcatgtcatatctttcagatatttggggacagagaaaaaaaggtgatgaattacagtactagagatactatagcctttaaaataaatattatatacttttggttctacatacttttaaatgaagatggtccatgaagtaagttatgatcaaaactaatgcaagggcttacagcctaagaagaaagtccagaatttagagaatggtgacctgtcttttcttggcaactaatattatgaacatcaatttctcatcactttgtggcttcaagaaattctcccatcatagagatgaatcacctttcttccaggtcttcaaaaaaaaatatatatatataaaggtctgtgggagataagcttagaaacagtggctgaaaaggagaaaaattcagatttcagtcctcgggggtttgcataacaaatgatgaagtatagttttatagctcatctaagtaccttggtgcttcttttgggtacaagtccctgtttattagacaggcatggtgacttctagatacattcttccaagacatcaagataattttacttcttagttttttcacatgttaggcaattccaagattaatcgtgtataaacttgtttgacacttgaatcaatttttggttttacataaacggcattatttcatgcatacctcagctgaaaattggcagttatgtattagtgcttgattttctagaccagtattaaaattaccttccaaaaatgtttcagttgcagaaagtattggtggccaacaggtcttccatgagtcgggacacattagccagtgtcaccctttctctagccagtcagttctatgagaatggtattggaagaacagacaacctacctgcagcacttgccctgtcctgttcatattgtggacaatcatcaaaagataaaagggcatatgaaagatttatggtaaatgtcttccattttctctgccttgagtacactggagttagctttcattttcatagttgcttactatgaatgtcttagatgtagcatgagaaaatcttatattttctttttgtctagaactctgctgttcaatatagtagtcactagctattacataattaaaatatggctagtatgaataagcagataattttaattcttatttcagtataatttccatttaaatttaaaaactcaagcagtgtaaaatagttttcatcaaacacaatttttgttctaataaaactatatttcacctaaagcactgaaaatttagcattgagtttcagtgtgctgttaagtataaaaatatactagattgtaaaaacttcatatcacgatataaattatctccaacaatttttatatacattagatgttgaaataatattttgattatattgggctacacaaaatacattattacaattaatttaacatttctttgtacagtttttaaatgtgaatccttggaaattcgtaattgcatatgtggttcacattatgtttctcttggacagtgctgagctagtacattctgaaatatgtagcaattatttctctatggcttcataaagaaaatgtcaatccaaggctgaggatttatttatgaaaatctaaagacagccggttttcctgatggttcatgccgtgggggaacgggtctctttcccaatatataagaggacaaatcttgggatgggttttttttttttttggtcttttatgacattctttaatgatttctcctgtgcttgccattctgccttgtacgtaatacaccctttctagcaatgggtttaaaggtttttccttcctctcctttttgagctgtaaaatatgcattatggggagaggtgagctgatagttgagaaaggtcattaagggttcagcctggcttagtcggaaagatgtgaattcaaattgttattctcccagatatatactaacatgaccttggggaaattgcttaacttttctaaattttagtttgcttcatctgaaaaaggtacctaatagggaagttttagatattaaaatcaatgaaatttaaaagaatcaagaaatatgataatgcctagtatataacaggccctcaaatgtgttctgaaccaagagatccctgtaagagttaaagaaacaggaaagaaacacgaaaagcggctcaacagtcaaagacaggttaattttgcagaataaacctgagaggggcttctggccaatttttggacaggagcactctctcttacagactaagagtatttattggttttagggcgagagagctttatcacaggcttggaatgtttctgtgtgggggagaaatttatggtggggttggaatgtctctgtttggaagggaagttatcctggggctgacctgtctctggtcggggaggggtttatcttatggttggaatgtttctggactgggatgttatttgtggtttatggtcatgctgacgttagccattaagctgatgccctttggatttaggcagtttttgatcaaggggaactttagaatggtggtgcttgtccaagatagccatgctcccgctgtgtcaatccccaagttttaaatgtgtatctttacttagtgacttatggagtcgtaactattaggacacatacagcagtaagtctaaggcatataccagcttatcagatggatcccctacctggcaaagggaagatcctctttctctactaccttagtccttctttttatactctgtgcagcttttcagttcttccacttgcattaaaattagattacctcttagattagatcaaaagattgtccctggttgtgagaagaaagaatactttaatctagcactaatcccttaatacaccattatatttgggtacattttttttcctagcagaaaaattatttttcagccttctcagaagtactaaaagtcctttgccaacatcagcccagtgcaagttaacctgttatgagatttgttttgtgctttggaaatgcttgtcagacaagctttcaacattgagatgtgtgatttaaattagtttgcataagaaaatgtaatgccagggacaaatttctctctttatcccttcttatactacaaaacagacaaagagggttaggtggttgctttttagtatgcgagtaatcacttgggattcacagaaatattagatgcagtgttattagtgaaaccttagttccctttatagatatgtcttatgtcccatttgtaatattattattgttgttaccatacgcaaactttatttcttagtttggatgcttggtctcaaccagacccattacctccttatcttcctatctcttagggtcacttcatgcttagaggcaacttgttgaaagtggaggtcagcgtgatcctttttcttagaagacatagccctttcatggaacttacgtagctgattcatagcctgagtcagtctcttggatctgtgaaaaaaaggaaaaatgaaccagacatggtgtttgcagtcagtcttctttgaatataaaatatataggcagaggaaaaaattaaaccaggcagattaacctcaaggcataaagacaaatgctaaaatgtactctaacgtgaagggttaagcattccaagatgcccgttggaaggttctttatccaacacttctctacccattccaaccccagtgtaaacattaaataattcttttaaaatttgaatactcaaacaagaaagtaaagcatggaagataatttttaaatcattatgtagtgattagaggaagaggaataaagggtaatgtgagattttagaaataggtgctttgaatagataaagagatattgcaaggatagatgaactcactatcgtctttgcagtatagtatcgttggtgcagaggatttgggatagaaatccagtctgggggccgagatgtgatcattatgtgcaatatcatcttcaaaaagtcaggtcatggttatcagtttgctacaaagaacatcttagtctcatttcctgtccaaggcaggaattttcccctgaacattcctgacagaagataacctgttttgtgctctaatcacccagtcttctaccagaggttgaagtgacattttggctccattttctcgtattttatgcaagaagctgggaattccagcatcttactctgctcatcagggatcctgagggagctggtaatatgcagaaaggatgtcaaagggccatgttactaatagctgtggaagctccgctatccacaaagcagagattatgaaacagtctatactttggctagaagcctaagcagaatctcttctacttccctcaaaatctatttcttagcaccagcaagactgggtctgtccagtgggttgtgggtttggggagaagcagaggaaagattgacatcatgtggaatctggaagagacagaacacatctcttggtgcttttgaaggtacagtgactccatctagtagtaaaaggtgttcaaatgaatggcttcaaatttgaccagattatcaaatgctgcttccctgataaacagctcagacatgggttagaagaggtggccctgggatgggaagcagtgcagactctcatgtatgaatagctccaattctcaaaaaattcttttagttaactgctgtctgtcttcttctacattgcactcaagcttaactctgcacttttaaaatcaacatataaattataactttctctcctatgataacttttcaaatgttttttgacatctattcagtaccgagctcccttttgaaaactgggccatcatttcccaacctccaatttctgactgtatttccataatttatttaaagactcctaacaatggagccacaatcataactacaggtcccctttatatctcaggatgacattcatttggttctaatccttgaactcatttgaagattctaattgctcttgtattctctcctcttctatctggaacttatctccctgataagcatctgtgttgtgattcttctagagtggagattatttctcttgtaaggaaaaaaattaaaactaccttgttctactttctctgttgcatcacaccttctctcttaagtaatagtcctaaaccttctctgttcttctccagacagatcataaatgttacaccccaacctaaaacaaaacaaaacaaaaccttccttcatgaattattattggccttgtatgcaagactgagttgatcccagtctcaatttacctgataccatctatttcaacaataacaataataacaacaataatgaatatttatttagagctttctctgttccaagcactgttctgaccactttatgtatatttacttggttgactctaacaataattactgaggtgggccaggcacagtggctcatgcctgtaatcccagcactttgggaggctgaggcgggcagatcacctgaggtcaggagttcaagaccggcctggccaacatggcgaaaccctgtctctaccaaaaatacaaaaattagccgggtgtggtggtacacgcctgtaatcccagctgtccagaaggctgaggcaggggaatctcttgaacccaggaggcggaggttgcagtgagctgagattgcatcactgcactccagcctaggcaacagagtgagaatctgtctcaaaaaattaaataaataagtaaataaaaataaataattactgaggtggctattactaatttctctattttggtgatttggaaactgaacttagaagttaaagggcttgagcaaatacattggactaaaaggtggaggagctgaggtttgaagtttcaatgcaggcatctggctccagggttcatggtcttttaccatgatgccatgctgctatgtctacttataggagtatgcacgcttttatgttctttcctgtttttgtgagccttattctagcttttatatatttttaaactctgagctccttagagagtttccaatggccagtcaaatttatttaggtcctctgaatagtctctgaatggaagaaagtgtttttcatccctaaagcccacatgtatacttcagatgcacaaggttcaaggtcagggcctgaaggagaaagtatcacagcacaagtaacaatgttaaacttcaaaggaagataaaacctcaaaataagatattaaggtcaaatactagaatctgcagggacactgtcctggttaagaggcaatagaaaggaagtagcataaggtgattcagcaggggagagatgtgagaccaacagcgttagatcagtggggctgtaagagagactctccaaattcatttatggaggagaatgccagaagagtggggagagagtgagctagagattcccaagtcccctggcaacgcgaaataccaggggtactagcacccaggtctttgcttctaatgccattctctaatgaaagggacaaggcatccttggaaaaatggctaattctagcacagagcagggaatagacaagatgagcccggagaatctggtagtgacagaaaggaagaaaatgcagaaagaaaaaggaaggaagacaagggaagggaagggatggtatgaaaggaaggaagaaagggaaggaaggaaggaagtccaatgaatgggattggggtctatttctatctgtgttcttaacaatcttcttcatcagggattagattcttgtttttttctttgttgccttttttttttttttttttttttgagatggagtctcactctgtcaccacgctggagtgcagtggcgcaatcttggctcactgcaacctccgactccgtggttcaagcgattctcctgcctcagcctcctgaaagctgagatcacaggtacacgccaccacgcccaactaatttttgtatttttagtagagacggggtttcaccatgttggccagaatggtctccatctcctggcctcgtgatctgcctacctaggcttcccaaagtgctgggattacaggcaggagccaccgtgcccagcctgttgccttgtttctgatgggagtccaagaatctccaagctatctatatgagaaagacaaaactactctttctatcctgtactgtaatcctacctgacaaatatatccttcatgctccttgtcattttgagcaaatagcctgagcttacctcactttcatttgaacttcctccctctttattgccaaggtactacgttcctttatctctgtgcctgaacaagccccccttgctataatcttcatgctgacccctcattctctagagtatatgctgttttctgcagcagactacacggccagtgcccttgcttggagcagatctagacatcatatcgccacggtcttcattctgaagtaaccttagaagtcactttcagttcataacattaaagcacaggttacaactcatatgactacatgggccatataaaataaatgagtcaatgtgccgaagatcaggaaagtgatagctcaggcaagactgacactaattcttggcctctctgtctaagagacagaagagagtgctagagactatggcacccaggagaacccagaccgaagagggcagccactgctcagctgctgccagtcatcacagcacaggagcaatggaccaatattatgaatttatcttcttttgaaagacaatccagaagtcgagacttttataaaaagtctgaattcattacctgtattaaattttctttgatttaaaacactgatcaggctaaatacaacatacctgtaagatattacatacctactgcaagaaccctgcctctgcatataaaggagaaagataagcacagttgattctcttcacaagccctgtgtcatgcaaacaggattaatagcccagttctaggctaacaatttcatagcaaccatgtggttattatgtgttgtatatatgaaattatgccataatgagctgtctcctaacaagattgtgcaggctataaagctgttttatagctccaagagagttgctcctgagttcattgacagtgcttattgtttctttccatctcagttacttttgaattaaaaagtgctcaccctactctttcttctcggctacaagttttgccatagtgcacagtgtttcttcatcttactttctttaaagaacctttcccatctcttcagttatttctacctgttccaacctccctcctgatagcaccccagtagtgggatggaatgtgctggaggggtttggccagttcttgggggagtttcacagtcacctgtctacagtttcagtgagatgggaatttatcaagctgaaattagcaaaagacaaaactgacattgtttaaacacatacttaacaaaagatctaaccagttcctcctagaactagaagatatttgaaaattagagaggagcttttttttttttcctatcgctttctttaaaacacacttttccatagataatcttatctttttggcatcaacaattatttataattctggaatgatttccaaatctaacttgtaaccatatttccaactacctgccaagtgtctgtgctggaattacctaatggcatttgatcgtggctcaaatgtgctcactcaactttattccgtgggctgctcacctcccctgtgtggagcctgggagcctctgaaggcaaatcttgactcatctctcacctctcaactgatcaaccagtagccacacctgacttaaatgccatctggaatccagttctctttcagctcttccatttcttacaggaacttttacagtaacttctgaactgttactcttgcctctgaactgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatctacttcatcgcctcctgcaccccaagctggaattacatgtgtcttattgccctgtccctgcatatcttctggccttatagacctctgtgcctttatctatgtcgttccttctacctcaacaggtttctgtcctaccatggattgtctaatgccttctgcacatgttctttatcctaggaagcaaaatatttattccttttcctgcattctttaatacctagtttatgcatgtctcattgcacttattctaatcggagcttgttcttgtcattttttttcatatttttttccttttgtgggggagtttaggacccaagtctttgtcctcttttggtttaactagtaccttgcacagaaaaggtagtcaataaatgtttgaaaaaaaaaatcccagtttgataattagttgaaaatttcttcagttaatgaaaacttggtacaaccaaaggaaaatgaattatcagagtttactatgctccatgagattcttttcatacaagtatgctgcagaggaatggaagagtgggaatataaataaatatgaaaaattcttagaacaatcttcttattatttgagacagagtccagctctgtcacccaggctggaatgcagtggcatgctgttggctcactgcaaactccacctcccaggttcaagcgattctcctgcctcagcctcccgagtggctggaattacaggtccccaccaccacgcccagataaatttttttttgtatttttagtagagacggggtttcactgtgttggccaggctggtcttaaactcctgacttcatgatctgcccgcctcggcctcccaaggtgctgggattacaagtgtgagccaccgcgccctgccagaacaatcctattttctaattggggtttttctttgttttttgtttctttgtttgtttgtttgagatggagtttcactctgtcaccgaggctggagtgcagtggtgtgatctcagctcactacaaactctgcctcctgggttcaagcaattctcatgccttagcctcccgagtagctggggctacaggcgcctgccaccatgcccagctaatttttgtatttttagtagggacgaggtttcaccatgttggccaggctggtcttgaactcctgacctcaggtgatccacccgccttggcctccaaaagcggtaggattacaggcatgagccactgctcccggactttttttttttttaatccttctactttactcatactctccaaagttaattcacacacaacctccccaataaaatggaagtgaggtttaaaatcagaccataatttaaccagctgaccaaatgccattttgtataagaagataaaaagctaccattgttgttatatctcagagcagaagctctttcttcattttattctttaaaaacatcattcagggttgggtgtggcggctcatgcctataatcccagcactttgggaggctgaggcgggcggatcacttgaggtcaggagtttgagaccagcctggccaacatggtgaaaatctgtctccactaaaaatataaaaattagctgggcatggtggtgggtacatgtaatcccagctactcaagaggctgaggcaggagaatcgcttgaacccaggaggtggaggctgcagtgagccgagatcaagccactacactctagcctgggcgacagagtgagactccatctcaaaaaaattttaaaaataataagtaaaaaataaaaacaccattcaatttatagttagcatgaagctacaccatcaatctttcctcgtgttcatgatcatggctcagcatttttctgaagtgtcattaataagccatgttagcaggaatgacctacacatatgcatgtcaggagggcttcaggccactgctgtctgtgtgtcaccttgacgtcagccttgataattgtccagggcctccaacttcacagcagtacctgggcctatgtcaggttgagttctatgatcacacactattttcatcagaaattttaataaaattatttttttctcagatgacttcccgcatactactaagtgatctgggagaaggagtcttagggtgtggatgggattctgccttgggcatattttgctctactgggccctggagtctttgcagatgctgtcaagatactgcacttttttttcttttttgagacagagtcttgctctgtcacccaggctggaatgcagtggcatgatgtcagctcactgcaacctccgcctcccaggttcaagcaattctcctgcctcagcctcccgagtagctgggactacaggtgtgcgccaccacgcccagctaatttttttgtatttttagtagagacagggtttcaccatgttggcccggctgctcttgaactcctgacctcaggtgatctgcctacctcggcctcccaaagtgctgggattataggcatgaaccactgcgcctggccgatactgcagttttgatggccatcactggtacaacaccctgcgtatgccaagactgtcatgccttgtcagctataataaaaagcaggagacaaatggccttttgttacctgaaatgatggatcagtatgtatgtgcaaggatgcacgctgtcaagttcttgtgggttaatcatgccaggctgatggaggggctccacgagttccaaagtagaaggagcttgaactccaggctgtggctttgaagcagttgttttctctggaattagctaatgaggctctctttgtttgaggattggaaagcctccaaaaacccactcaggagggaaattaacaaatgtctgttttgttacctccggataaatcttcatgatgaaatgtgcagccggtccacctcttcaatcttctctcttcttcttcctcagtggaagctcaattaccatgaaggccaaaataaataaataaataaacaacaaaccaaccaaataaataaataaagcagataaaccgtggttctttgcttaaaaaaagttgcagcaaagaaaagctttagagtaatttctagttagaagtggctgtgagattcactgtcttctggtgatatttgaaatatactatattcatgcaaatgtttctgattatttaaacacattatctgtatctataattatcagtagctgctggcattatgtgagcatgcaaaagtgggaacagcagcagtaacctgactcatttcaaccaggatggaccatctcagagggtcacagttactaatctctgcatgaactagattttataaggtattatgattctttcatagcttgtaacttttcattgatcatcaactttactgatttttgttaatactggaaattttaataaatgggttgtgcacaggtacttattgagcatctattacgtgccatagaatattctgattattaaggatgtcaaggtatataatccagagtcacggttttcaaggaactcagtcaataattacaagctaatacatgggtaccactgttctaggcacagcgtggcagaaaagaatagcgtggacacacattcaggggatttaactaggagaaaacagtaaggaaggggatcttagcagaggtagtatattaacagatgtatatgacaacttacactgctgtaagtcatcctgtttggctggcaagttttgctttagaaactgggtaaatattgttcatgaaacttctgtgtaagtttcacgtgaatgttttcctatgtgtatgtgtgcatgcttatttgcatttgtgtgcacttgtgggtatgtgtatttgtcctgtgtcacaataaaaggtatctatttctggactttgcagtcaaaaacattggaaaactgtctatgtaggtaatggacacaatagaatttagaaagcaacttttacaaacattgcagatttgtaattttctaatatcattgatatataaagctgagtataccagacacttgtaaagaaatgatcttttccaatgaaaacacaggtgttaaacagaacctttcttctggcctacaaatcactcttctaacacttggaaaaaattaaagaaatattcagcaatgtgtagaatttcaatcccagagagacaggaagagactgtatagctgcagatgcaatatgcttgttattttggcaaaagcgtaacataagaagccaccaactctcacagaggaagcagagaaattcagtatttgcttgtaacttagatatttctttctttgttttccccctaagaagaacatatcttttctggtgggaaaagggaatttagataattaaagcagagggaataaacattttcaggaccaaagagaaaatagccgtttgagccacatatttaaatgttaatctacaatttttttttttttttttgagacaggatttcactgtgttgcccaggctggagtgcagtggtgcagtcttggctcactgtaacctcccttctcccctcttgggctcaagccaacctcccaccttagcctcctgagtagctggaactacaggcatgtgccaccatgcccggctaattttttgtcaagacggggtctcactatgttgcccaggctggtctagaactcctagactgaagtgatccaccagcctcagtctcccaaaagtgctgggattacagatgtgagccaccaccgtgcctggccatcaaatgtttttcatagtggactagggctttatgatcccataaaaattatttccctcatggaaccactccatttatgtattataaagctgtcaacatctggttttattgataaatatccctggggtttttgagctttttcttttcaacatagtgcctgtgttttatcttgacctttgctttaaaattactgctagatgtaatgaggattctggaaagagcatggttcaagattttgtacaattgatataatgattctgaagcaaataatgggaaaggggagagtttcagaatttggtggccttagggtaagcttatgatttgttttatctttcctcatatctacctaatgctgtgaaattttgggattagatttggattggggacaaatgaggagtggaaatagtggagggagaaagggttaggaaagttacagaacttggcaaggctcttggaggtggtggattgatttctctggtgttgtgaagtgtcatcttctttcttcagttaaactgaagtacaggcaagcttctcctgctgcccctcagtttcactgtgtcaccatttttagtagggataagcagagacttgttgttggtaaggacaggaaggaaggtgatgctgatgaatttttgctggtgctaggttagctgccagccggcctggcaatggctgtggtccagccagcctggggcgcttctagtattctctgtcatggggcaatatgttaacgaattaaaatgccaaatagaaatgagacagaattccaaagacatgtaaactgaaaaacacctgtccccatttgttgattttttttttcctgcatatacttaaaaaaccccaaacctttatgtaagagtctcaggagtgcagtgaaaaaaaagtgtttattgacgagccatttccaatttaggccttaaacttcaagacccatttctaagacccatatgcttcaaaacgttctatataattcagctcaaaaggatcttcctctcctctagatctataatgtttattgactacatccctcaaagagcagtaatgcatcatggtgaaataaaaattgaactgcaaatccgaagacttgaattctagttcctgatcgtttttcatagtgtatttaatcacacagtttaacccctaggtctccttcactgtgactcattatggtgagttcgcgtgagaaagtgtccaccataggacactaaattcaaaagagtgaccagtaatgattgttgtcccaaggatgtccaaatgggaaaaccattatcagtctacactctaaaccagaagggacttattccaccaaaagaggttaagggctccttaccacagtcacaaaaccagaatatatattctttcagagaaaacccggatacagggcatgagattagaaccctagaatggcatatcaaaaacttctggagtctgttgagtagaagtttggagaataaacaaattgatagattgatatttgaatccccggcagagtaagaggaataataagattttgaatcaagaagaggaattctgccacatgcaactaggaagaaaaaagcaaattaactgtgataacactcattagggattatcattatatctttaatgaggaggtaataaagactgattatttactaggcatcccttattgatccctatttatcactacgtagagtaaaatgtacaatttttcctttcacttgtggatttcattaatttatacagtcatcacatattgattgtacatatactgtataccagacactttattagctttaagaataccaaaacgaatatgccagatatagtatctaacttcatggagtttgtagagagattttttgaactgaatttctcagcaaactaacacaagaacagaaaaccaaacaccatgtggtctcactcataagtgggagttgaacaatgagaaaacatggacacagagaggggaacatcacacactggggcctgtctgggggtaggaggttgggggagggatagcattaggagaaattcctaatgtagattacgggttgatgggtgcagcaaaccaccatggtacttgtatacctaggtaacaaacctgcacgttctgtacatgtatcccagaacttaaagtataaaaatgagaaaaaaagatgcacaaatagtgtcacatatagtataataatgatatggatatggcctaattcatagagtcaacattctgatactaagaggaaggaaaaatcaaaacaaaataaagaaaaaacaaagcagacagtagcctttaaccgtttccttttaaagaaacattgttatctgggttcattacttgttagaaagtaatgtgaagcacttaataaacttcaggtggtggtattaggtaattaacatgtgaaattcctcatatggttatttaaatttcatggtagtatttaacagttttcatgtttatggccttttcctgcaactaagttgtaaaatccttaagggaaaggatgaggaaaggaagacaagagagaaactagcatttgttgactggctactacgtgccagccacagcactagctactaaacctgtgtcactttatttaaatatgaaggtcagaaagcatttctcatgttcctggtatctcctgcactgcctagtataatatttcatacttacaggtgcttcatcaatatttgtgttggttgacttagcaatttaaactgcttctaaatagagttacgtgagtttttccccaaagactcatgcccttttttaggaggcaaactagccctttccatgtcaccttccttaagaagcagggcaaagaggtgacagtttttatactgaaatcagttgtttaattgttcacccatttatcaaagcctctgtagagttaaagacaagtacagtgcccatgtaccctttatgctgcaagttctggacagatagctgtcaatgcctgaaaatagtgtaaattcactgggtgaagagagcaacttgccagggggatgtgatgtagccccttctagagtatggggttttctacttgggcatagtcagctgctagtttgttggattgctgctgctggggaaagaccaggccacttcatgatggaatgcgtcaacttttggaaagtcaaattcaggatgcagtttcaactagtagtaactatatttttctatcttttaaaaagtgaaggagcaacagaccagtctagacacatggacgggctttagggctcagttgctaaagagatagaagtaaaatattatagaaaatgcttatagtacatgttaagtgagaaaggtaaggtaaaaatggtttatgacctataactgtgtgaaaactaaccaaagagacacgtatcatttaaaaagatttaatgttgtgcctgtaatcccagcactttgggaggccaaggcgggcggatcacaaggtcaggagatcaagaccatcctggctaacacggtgaaaccccgtctccactaaaaatacaaaaaattagccgggcatggttggggggtgcctgtagtcccagctacctgggagactgaggcaggagaatggcatgaacctgggaggcggagcttgcagtgagctgagatcatgccactgcactccagcctgggcgacagagcgagactccgtgtcaaaaatgaaagatttaatgttggtcaaattatacacaacgattcaacagtactggaagttgaggaggacgagcaagccagatagcaccaatgatcatgaataaattccttatctttcagaaagcattattgttcagtggtttcaagttttggatgtgcactcacattgcctgtatggaatcctggctccacaagtagttgtgtgagattgggaaagttgcacttgtttaatctgtaaaatggaaaatatctgaggattaaattaaaatatagctggatcatgcatagcataatacttggaatatactaagtcatgaataaatagtactgttgtcatttctttgacattaattattaaggcaattaggaaattttccatctagttaacatatagcaaatcaaactaagctgtgaaaaatatataatatgctatggtaataagacactgaactgtgatgctattattggggtctgtctaaatccacagaagcatcagaaattcacataaatcaatgctaatgtcaatgcctagtaaattatagtctcagaaacatgaagattctagatgttttccccttctttgcacactttgtttatatttcaccctattactattatcacctatatttatggtttttcaatcatttgtgagtgcttggaggaaattcattggttcagcagttgaaccagggtattgaatagtacatgaggactctcagactctgaagagctggtcgggtgtctctggctaacacatttccagtggataaagagctgctccagggacatctccttcctctgcagtacagtgatctttttgctggtgactagaaagtccaggggaaaggacagccagccaaagggtggcaaactgatggaaagtgggggcaagctttctgtaaccatgtaaaagaaactgccaattcccatgaaaatccattgtctctttttcttattaacaaatccccaacaagccaccatggctcaagcctgtaatcacagcattttaggaggctgaagcaagagaattgcttggggccgggagtttgagaccatcctgggcaacacagtgaggcatgcatctctacataaaaattttacaattagtctagtgtggtggcacatgcctgtagtcccagctactcaggaggctgaggtggatcgcttgagccaggagttcaaggctgcagtgaactaggatcaagccactgcactgcagcctaactgacagagcaaaatcctgtctctaaaataataataattttaaaataaaaataaaatgctaaaatgaaccaaatctccaattttatttgaaataacactgccttagttttttaagaaagaaaataaaacatttctcaccttttctaacagtcaagctggtatgttgctttaagtttggtgagtgtcaggtatgcaaaagtgttgagtggcagatacagaaagactgcttaaaggcatctgactcagttgcaaaggacatcctttgtccttcttgctgcctgtactatgaatgtagtggttggatcttcagaagcctatttaatcataaggtaatcttaaagatggaagttatgattaagaatgccagaacacaaagataaaaaatatagaagtctcagatgaaatttctgaatcagccttaaactataatgcttaaactgtttaaatgtgaagggataaaatttggggcatttatgccactattttatgttatcgttgttacagtgagtacaatttttaattggtatgtgtgtaagatttgctcagatctcaatcaatggttctaagaggaaaaagcttaattccaagctgcctctctcctgtctatgatatcccaagcatcacaaagtacacttccagctcctcagaccctgtccttgttttgcattgtttagccaaaccacttcttaacttcaagtagcaaatagataactcacattagcattaggttctcttattacaagtaattgacaagaattgtaccagtgattaggtgttgcccaaagatcttttaaaattccatgtgacccaaatactaccaaatcctaaaagatttaactaactggctcactaaccaatgcacacacatacttacttatttcacccagtatgtgttgactaccttttgcccaccaggagctaggcaggttcacagtgcctagctcccaggcacaaagataaatcagaaaccattctgtctaagtcaacctttcattttagcttagcaggaaacacactaaaccacggctgaaatatgccaggaagttggtagctggtgatgcctctaccacaccgcagtgcggttaatccagcattcgacttagtcgaaatcacttttttcttccaatactggcatttttatggatggatggatggatagatgaatatcagtatcaaaaggtccatgctttattttctaataacaattcatgtccaattatctgactgccagcacagttatctgctatggttgttagaaactttagaaagaagtaaatcctccaaaattgtcactcttaaaatctgagagaaaacagaatgaatagataagagatgcttcaaggcagttcagctctgtgatggttccgttgagatagaacacacatatacaaagtgtttgaagtaagaatttccttcgaggagaagcacaaagggaatagaagacccagcatttgttactggccttagataagcttactgttcacttatttatcaatgtaaaaacgcccagttagtttttagctcaaggaagagaggacatggccaaagatggccttcatgaacttttttttttcctgtgtgaagtatggaaactcattttcagtattggattttgactggattgtcttctacccagaagctggctctgcagaagttatgatcagatctttggaagtaacatttgatctaccgccgaatatagatccccttccttccctcttctactccctccttgcttttccttcttattacactgatttcatgcaaaattaattatcagtcctgtcacatcttgcactgctaacagtggtcagtattgaattatggggaacgtgaacagaattttcagcagcctaattgcttctcctgtgcccagcaaaatgttacgttaaatactcacagcaagtagactagactgtattctatttccataacaaactggcgggatttcattaccagaatccctagcatctactcacatgactctttcctaactgccctatcagactggtcttggataaagtaaattcctttccaaagctgcagctgcctagttaggtattgaaatattgtatccacttgcaggtcaaaaaggaaaaaataacaacaacagcaagtggtccatgagagtgaagtggaggtattaaaactaggctgggtcttctcttggaagatgacagactgagtcccacagtgcctcactccattcaaagcaattaggagtgtaggattgcagtgacaacggatctccagggctatcatagtgctttacctaaagataacaagagattagcccttagtgacagatgactaatatattctgtggacactgactgagagtttgggagtttctactgtccctctcaaggagcttagagaatatgtacacgggaagacaaaaattaaagaaataaatgtaatgcactgtataatgcataatgataaatgcatcttcaaggtacctaagtaatttagaagatattgcagtgggagaagagtactgagatattcaccaaattcctaccagaaaaaataacacttgagttggctgatgaaggttgactaggagttcattagacatagtagagaaagtcattttagaaaaaatgataataaccagctttgattgagagctcaattttgcttgtcctttttggaagtgtactgtatgtatgtattagtccattttcacattgctataaaaaactgtccaagactgggtaatttataaaggaaagaggtttaattgacccacagttctacatggctgggaaggcctcaggaaacttacaatcatggtggaaggggaaacaaacacatccttcttcacatggcagcaggagagggaagtgcagagtgaaggggggaaaagccccgtatagaaccatcagctctcatgagaactcattcactatcaaaagaactgcttggggaaccgtccccatgatccagtcacatcccactggttccctcctacaatacgtggggattatgggaactatagttcaagatgagatttgggtggggacacagccaaatcatatcaatgtattaaaacagttaatctttatagtgatagtgattctttgaggtattattcccatcttaagaatgaggaaactgaggcactgagaggttaactcacagctagtaagtaagagagcaagaattcatacccagcagtatgaagaagtgaaggatgagttgggaatacagaacttgatcattgagagtcatactagtcacaccaaggaagttagagttaatcaattgacaacggggagctcttgaaaagaactgacaaggtcagatttgcattttagaaatattgttgtggaaacagaaggattgattagaaggaagccagaactggagcctggaaagttggctacatggctttcacagtaatccaggaaggggatgatggaagagaggctgcagcatgggagcaacagctggagtgaagaagagaggatatgtgtgggaaatctttaaggggtacatttggcacaactaggtgatagacagaagtgatgggtggggagtagaattggtgaatctactcttctaactgcctttccctatctccagtctcaccaagtatcttgaattaggaagcaaggaaaaggggtcaattaagaaaaagggagagcaaggttaatggagaacaggctcaagaaggaagaatttaaaaatggaataaggcaagagaggataaagaaactacctatggagtgctatgcttgttacctgggtagcaaaataatctgtacaccaaatccccatgacatgtgatttacctgtataccaaacctgcacatgtatccctgaacctgaaataaaagtttaaaaaaatagaatgagttaagagatttggtaatcttgagaaatgtctgtaaagtgtccatgtattccatgggttcaatggggatctgccattgaaattcatagacctgaatatcagagaagggtagaagattagagaatttgctgtttggatagtcgaactccttctttcatagatgaggaaagtaaagtctagagaaattggagagacttgtgttatatcacttagtttgttacagagctgaattcataccacccatttccatgtgccctcaaatagtagccgacctcttccttcctgggagagaatccttaaccaccaagtcctgatctcataggcctgatagtcaatccttggaagggatactgtggtgcattgcttagatccgtcccacttaaccctgggacccacatactcactcaccaacctgctgggagtgctggtcactgacctgtctcaactaggttgactccaggaattgctctctgctaaaggattttttctgtttcagggatataccaaaatgaaaaaataaaaattttatataaagagcgtttgttgcctgggttgtatgcctgtagaatacattcagaggtagaattactgtttcaatagtattaataaatttttacccaatggcttttcaaaagtgtgcatccccaatggcttttcaaaagtgggcatcaatacacacttagaaatatgcagtaggatcaatttcaccaattatctcaccatctttttagaagctaattcattttgcattcttaaattccactaaatttcaagagagcagttaaagaataatacaaaactttgaagcactaaatgtatatatttaagatattatgtcttctgtagtcaatggcaaatatcaagaatagagaagatgcacaaaactgaccagtagcagaaacagagatccacattctaatctcacgtctttctactttggttaaaggcaataattcctatttcactcactgatgagtctttccctaacgagaatgtgactaaaaccagttgagtttgcgaaagggatgtagaaagagacaattaggtaaaggtgaaaaatgagactgacgaagtgacgttggtcaatctcctgtttactgagtgcaggttaggaaataacatcaactaggttttctggaatttgagaactgagtattataaaaacactgactccgttattattattattgtcatttttaattttggattcagagataggagctgaatagcagcaaaaaaaaaaaaaaacatgcttatgaagagctgcctagtgaaaatgacactcctttggcttaggaagagaaagaaaatgaaagccttacttctttcttctactgattgaagtttttactttctgctgtttacttgggtttttaatattgaagacttctttgtagtctctgatgagttttgaagattaattttgcagaagtaagataatattcctgtttaccagaaatatttctgaccataagactcattatttatttattatggatggtcattttatatatttttaatgcttatttaagactccggagtacatgtgcaggcttgttacatggatagattgtgtgccactgaaatttggtgtaagaatgatcccctcatcattcttagcatagtagtcaatagtcaggttttcaagcctcaacccttccctccccctctagtaatccccagtgtctattgttgacatatttatgttcatgagtactcatagtttagcttgcaattacaagtgagaatatgtggtatttggttttctgttcctacatcaattcacttagggtaattgcctccaggtgcatccatgttactgaaaagaacatgatttcattcatttttcttttctgtggctgtgtagtattccatggtgtacatgtaccatattgtttttatccaatccaccattgataggcacctaggttgattctatgtctttgctattgtgaatagtgctgcagtgaacatacaagtgcatgtatcttttttggtaaaataatttgtattcctttgggtataaacctagtaatggaattgctgagttgaatggtaataccattttaagttcttttggaaatctccaaactgctttcaacagtgtctgaactaatgtacattctcaccaacagtgtagctttccctttcctctgcaacctttccaacatctgtttttttgtttgtttgtttttcactttttagtaatagccgttctgactggtgtgagatgatatctcattgcagttttggtttgcatttctctaactagtgatattgatcactttttcatgtaattgttggctgcatgtatgtcttcttttgagaagtgtccgttcatattctttgcctatttttaatggagttatttgatttttgtgttgaattgtttaagtttcttacggattctagatattaggtgtattttaaatgcatagtttacaaatattttctcccattctctaggttatctgcttactctattgatagtttcttttgctgtgcaaaaagtctttagtttaattaggtcccacttagcaatttttgtttttgtggtaattgcttttggagatttagttgtgcattctttgccaaggccaacgttctaaatggtatttcctaggtttccttctaggatttttatgatttttaggtctcacatttaagttttcaatctatcttaaataatatttgtatatggtgagaggtgtaggggtccagtttcaatcttctgcatatggctagctagttatcccagcaatatttgttgaatagtagcgagtcctttccccattgcttgtgaccatgagattttatgtgatgttgaaacccaaaactacccaaaggaattaactactgctggttaattgtacctatattaaacactttctttatagtattttccttatttgggggccatctcaaagtcctaacaatcagaatttgtgtcttctcatatgatttttactcagaattacacagaatacagtattcataaaaatgaaccaaccataaaatatttattcttctactgtgtcaggtagtcttgtaggttcctaagagataccaaatacaggttcataattcttgtcctcgaagatctcccaatctactgataaagcaagtaccatatgcatgaaaagataaatgtctttataaagtttcttaatcatgagtgcccatttgagtggtctgtgggtttttagaagttattcacagaaacgaggctccttagttctgacatggggaccatttgtttttattttcaaaaagctctatgaagtgatttggatgtaaacctctgaaaagaagttattgtcttaaatattcatgggaggctaggcctacttgcatctggagttggctccagaagtctttacaaagttagcttggcattggctgggtttcaaagaataaatagaaggggataaaccaagaagaaatgtggatatatatggggcacgattgaataatttccagaaagaaatcagatagtacaaggagtgtccagagaatgatgtatatggctgaaatggaagtgttatagaatggtagttagtaataaagctttaatatcacaagcatattgaaacaaattgcatgtaaaacactgatgtaataaaaagatttagattgttggagtattttgatgtcaagtacttgtcttcctggtgatgtgaaaccatgcatatgtgttttaagtagaaatgtgactccatgggaaaacatgtaagaacatgagcaaagatggatgagaatagggtgagtgtgaagggaaaacttattaggatgctagttctctgaggttataaagaccataaggtagtggcattggagtacaataaaaagatgacgacattttaaaggaagaacctccctggcagcatggctgaatagacctgggaagaaagagaatttatgcctgaatgaatggaaaactgatgattttgtatctcaaagtggataatttatttagaggcaactggctttggaggaaagagaaaatgaggggttttctaatgtttgagatgatagagaaacaggcaagcatagatactttggaggcagttggatatgtagcattggagtcaaaggccaagtaagaggtagagaaagagattttggagaacttctcatggaggaaatacttgaagtctggagaatggatgagacctgaagggaataagatatgtagatagagacaaaagttgaagggtaacactcagactttgggggagatctacatttaggaagtaggaggagaaaagtaaaggcacagtaagaaaaagaaagattcaactaaagaaaaggccaaaaaaagtgtaacccacagagaaaagagcatttctggggctaaggagtgatcaacactatcaaaatactacaggtaaactagtaaaacaagtaatgtcagcattagtttccttgtctgcataacaataatagttattatgaggtatttttgtgaataaactgaaatgatgactattaagcatttagcccaaggctaggtaaaagaaaaggctagccaaaagcatctgttattataaatataataattactaatcagcacccaactatgccgggcacttttgtagttacacatttgaataagatgcaaccctcaatttcaaagaggtaagtgtcaatacaaagataaagatgtgaagaatagatagataccattttgtggtattgtttctacaagaaagatgtaaatacaatggaaaaggtgccagtggagaaaagtgataactttatgagtcctttgccagacataagtgatagggttttctgtacatattacatgttattcttagacttgtgcaatttgctaagccagtttatagactcttgaatctgtgtaattgctatgttcttgactcaaacctgaagggacagactcttgggagggaatagccaggttcagccttttatctttcttctgtgcacagaactcttgcttactttctccaccatgggtaaatcagaatggctttgaacaatgagcattttctgcagcctgagcagcagttgctctttagacccaatttacaaattaggaaaaacaaataaattatttatagcatgacaaaaataggatttggcttaatccaacagctttctcagttacaatgcttgctgctcaagtaatggatcaattcacagttggctaaatccaggtgtttttgaacctttctatttaaagtatggttctctgaccagcagcatggagatcccttggatatttgtttcaaatgtagaatctcaagccccactccaaacttaactggataagaatctgcgttctgtcaacaactttagaggcactgtatgcagattgagaggcactgggctagaatactgaattagggctgaggaacatcatcacattctccacgctgtcccagtatactgttggatgatgtcagagcaacgtgaaaggattttgggttatggtttagctcatagtccatgcagaagaggccataattagcacagggtaccatggcacttctcatctgagacatgtgacatggatttgcacagatgagtacttctgacctattaatgttagtagtagaagtgatccttttgtcagtggaaaaagctgccagactcagaagcaagtaaaacctgaagaatcttttagaactgttagtcaagaacttcataggtggtttatataaaatttattgtcacttgctaactgcatggctttcggcatttcttaacctttctaaacttcaatcttttcattcatggaacgtagataattattgtacctgtatgacagggtcaatgaaaggttaaatgagtgaagatacataaagtagttagcacaggatctgggatttagtgagggcccagatactacttgtctgttattatttagtttatttagtttatttttatttatttatttatttgagacagagtctcactctgtcacccaggctggagtgtaatggcgcaatctcggctcactgcaacctccgcctcccaggttcaagggattctcctgcctcagcctcctgagtagctgggactacaggcatgtgacaccacgcccggctaactttttgtatttttagtagagatggggtttcaccgtgttagccaggatggtctcgatttcctgacctcgtgatccacctgcctcggcctcccaaagtgctgggattacaggcgtgagccaccgcacccggcctattacttagtttattattatttcattattattgagtatctattatttgatcttttatgtaataatagtgaaataatagacttctgaatatttgcagagaaatccaataattttaagtgatattggcaaatactatgatattagaaatctaggtggtacttaggaatctattttcttagtctctattctgtggccagggaaactctttattccttttgtccctgctatatttgagacaaagatcttgaatgcatccactcttccctaaggaaatgccatcaactcatcatccccataccatgcaaatgccttttacagctgcagagcaggtgtgggcagatgcatacagcagcatatgaacacatgtttaccctccttggccacactttgtcttactctatgttttctaggaacacattttggggtggaaatgcctttattccatttatatttagtcaattatctggtttagcttccattcttacaacctaattaaattcagcccatcaactcagtttaaggcatagcagctgtagacacttcgtttatctacttggagagaaaaaagataagttggtacaggggttccccatcttgtgaatgcaattcccattcaactacatgcaattgaatatgagcatgggatggtattctggacctaatgttaaattctgctactaagctatcatagttgaaataatatactcaactgcaactttacatattttccagggaaatgcaaatgattgcttttaaaggaatgacaactcatttgcctgcagatttcattcaggatatttaattctgaactactagcctatcacccattaactgccatttctaatatcttttgactccctcaaagagggaaactcataatttgtttcacttagaatttacatttttttaatattctagaaaccatgaaagaaatcactgagtccttagctcctgttttttttttttttttttttggttgttgttaaattgtagaatattagaatgtttcagttttactgattgtatttgttaatcattcttcttccactaccgttgtcttttcccatcctcttggaagggtgttagagaagactctatatctcacctacagatgatttcacctagaagcttagcctcccttcatgactactgttaaagataaagactgcctttggttgacaccataacccacaagaaatgattgcattcctcctggatggggagcaggtgacattgcagatgttacacttcccacatggctaagccactgatcgagattaaaaattcaaaagacaccaaagagccacgttattgtcccctcacagggagctctagaaatacatgacctaaattgtttcttctaagcatattatcagttccattttcaaggtatcaacatgatatctttccattggttcacaggaagaccaaagagtgacaagagaaaaatgtttccatttgtagtttttctacagactcatggtataggtcagcttttttattgtaaatatttaagatgtacatttaaggtgtctccatatatgtatatatatatatatgtatacatagtgaaattactagtagagtcaagaaaattaacatatccatcatctcagttacctttgttgtcataacggcacataaaaatctactctcttagcaaatttccatgatacaatacagtagtagtaactatagttatcatgctgtaccttaagtctctagatattcgttctacataattgtaactttgtaccctttaacctatatctccccatctcctcttccactgcatctggtaaccaactttctactctgtgttactatgtatttgactgtttattagtgtcgacttaggagtgagatcaaactctttcactctctctttctttcccgtttttttttttgtttgtttttgtttttttttaaacaagatctcacactgttgcccaggctggagtacagtcacatgattccagctcactgcagcctcaacttcccaggctccagggattctgtcacatcagtgtccttagtagctgagactacaggcatccaccaccacacctggctaattgtttgttgtagagatgaggtctcactatgtttcccaggttggtctccaactcctgagctcaagtgattctcccacctcagcctcccaaagtgctggaattatggtgcgagccactgctcctggcctctacagtatttttcttgctgtgtctggcttatttcacttagcataatttcttctgggtccaatcatgttgttgcaaatggcaagatctccttctttttaagactaaataatatgccatttaatatgtacatctaccacaatgtctttattcctttagcatgaggagaatattgaacattactttgagaactagaaaaaaatgaacatgtgggttattttagtggttaaaaaaaataggaaaataactataaagacatgaaccaactatcaggggatgtttgggttgtttccatatcttagctattgtaaaaaatacaagaaagaacagacatctctatggggtgcttatttcatttcctctgggtatacccagaagaacaattgctagataatatggtagttctagttctaattgtttgaggagcagccattctgatgttataatggctgcacctatttatattcccactaacagtgtacaggcattccctgaacttcactctatattttatttcccaaatgagatggaagtacatggaataaagtagtattcaagccagtttagtcttcacattctaaatcacccctctatgaaacctctccagattaccttttctccccatgtggatctgaatatgctcctttattcccagttgtcctgtatgtatccagttttacagacatagcatctgtaaaggacactgttgtcttacaccgaagtgtagcagttaagaactcagggtttgcacctttccagctctgtagacttgggccggcaactgagcctctttcacccatagtttctttatctagaaaacaggagtgatgcatgtctcataggaccggtgtaaggattaaatgaattgtaactagaaaattgttgggaaataccaaatataattatataatgactagcctctgtaggtataaacagtttaattacttataagtttacatgtctgcttatattaaagagggaaagacttagactgtagttcattttcatgtctctgtaacacagcactctgtttagtagttacataaatagtgattgaatgaatgtacaagtgagtgaataatcatctcaagtctatcctttgtcaaggaaaatttccagatagagttctttctcctttagggggtctttaagatggtcccagtgccagcccaagaagagccagagctagatcttcaaggcagtctgggacctggatcctcccctccagatgcctagaggtatctcctgggaccatgatgggtctcagtcataccccttcattcattggttcatgtcttcatagtcattttctttttttttttttaaaccactgaaataaccctcattgtttgtcattatttctaatactcaatgtagttttaaattttctccccatgctcaagaagagaaatggaaatatggcaaacatctccatgaacccacattttctcacatctttagatcaaaaactcttattcttcagataaacaggttgtaaaattttcagtgttgaagagaatgaaatatgacatttgattttattgattcattgcttatttttggcagaagttatcctttattcagtttcatctctttatgtcttaccacctctttgtgaactagccacttgccttgagggtttacaaattcaagatttctcagcacgattagccctaatagtatgctttccttccaaggtttccagattatccaatacagtattatttctatcccaatcatgtttaaggattattattttacatagaaataaataaagaaaggggaaccaatacaaagtgttagaaagacagctacgattaatatattggactggcccattatcagaccctctagattttacaggtagctttctgatcagaaatctcgggtgagaaatagtaagaatgatggccttagttaaatcctctatcaatatgacaggttaaaaaaaagacatatgagttagttaaaagcacctctcccttggtaactctaagtgttttagtttttcagatggcaatttgtgactttctatagctttttcttgagatgaatttgtggaccagttgaatagtgatagaaatacaggacttgctaaaaattacaaagtgtttatggcagttctggcaaatatcctctagatcaccagataatgccaagtcagcaatattatcaataatgagttgcctactaagaaccaggggaatgggggcatggactgaaactttaccatagacatctttgctattctggactgttggtttgcttcctagtgtacttctgcttatcctttcttccctttggcttcattgagatcctcagccactgagttctatcttggtgcattccagccacaccccaaaagaataacaagaatgaataagccatccatctctgaatgtagagcaggttggaaaatgataaccttattcattattattgcttgatacatttccgaatttgtgttatctgtcattaaatagctaccacagccttctttcattcttctcggtatcagtttaataatttgttcaatgaatatgagaaagaacaggatcacatccagattttaccacttactggctgtgtgacactgggtatggttattaaccccatggaacctcatctttaaagttcagatgatggtaactaactcatgaggttgctagggattaaatgaagtaccatgtttaaggcttctggcgtgggtgctgagatatagcagataagagatggtagtcaaaaagaatgtgtcttactttttttatagtatatagagtgacaattttcaatacaaatagtgtctgtatatatgcagtcttaacacggcattttaaaatttcattgtagactttaaaaaacctaacaaattggatttcagcctctttcttactatattagaaaataaaagaagattaaaataaaaaaaggtttccttttaatcaatctattaataaaaagataagtactgagattccgttgacataaaagtaattgaaagtttataggcaaattcttgaaatagaaaggcactttttttcctcataagaggacagtttagaggatttaaaaagcaatcaaaggtctcatgttttatatgatcaattcaaattgactgaattttcatcatcatcctcctccctccttctttctgatagtctacatttgtggaatagagagatttttgtctttcaaattctaaccctgaggatttttgctaggcacaagttaagacctgtattgttttctcctaacagttcctatgacatttttaaagtatttactttattctagtatgtccattctgttgatcttcgaaggacctgtgtctctaggtgacatctgtattcaaccaattttgaagactcttctgattggatttagcaggagatttgtagagtgtggggctttgactaggcccaggtcctttgccagccaggcatagtttgtccttgtgagggcagatattggaaaggtggaggagaattatgttctatggcactttcagaagctcgagaataccttggcagagccaagccttctgcttagggaatggctagcagtaacaaagcatggtacctgagatcaggtacatagtcaagagttaggttgaaagtcgaatattaacctgaaaaaggaagatttggcagcacagtgtatcttacagtcccaggaaaagagccagttgacatgttctgtgagacttcagaaaactgtacgacgtgaaagtagaagcatttctaatcatagttatattttgagtaatctcttcacagtagaatgagtcccccaacactggatgtactaaagccaaaggaagggccaccacttttcagagttattgaaggaattcacccatcagatatgttttgattttattcagtgattgttcaaactagatccgtttctctaccttattttcaatgggcagtggttctctagttcatcaaaaagtttttcctctggaatttttgagaagcaatagaaatccagagcatttaaaggtgatgattaattagtatattaatcttagataaatgtccccagataatttttaaatgatcaaatttgtatcaaagacattatttattttagcatcattttgatttcttctactttgttgctggggttggggtaaaagagggagaaatggagaccatatataattccgaaatgaaaaaaaataagcaacaatacactgaattttcttagagtaaacataatgctatgctgggttgttatagcatttacaatgctcatcttcccttacacttgaatgacttcctcctggatctgaaacaccttcctcaagagcatcatcacaggactgttaaaaatcctaacatgttacaattttactacctttcttcttccagtattccagcttggagactttgcgtagccctggttaattaatgttgaacttttcagggtatctgtgaatcatggtggggggtagggttggggactagaatttaattaaaggcacaagcttcatggggattgtgaaatcacagattccaaaagggagacagccattctagggagactgctaatagggagtaagcagggtgacaaagtgtgcaggaactgaaggaagatgacattcaaaggtctaaacaggggagaagaaaaacaaagagatcagcatgttacagctgagccttttcaaatgcacggtgataaagaacagatatgttttgtgtgtgtgtatgtgcgtgtgtgtgtgcgtgtgtgtgtgtgtgtgcgtgtgtgtgtgttatgcacagtggcttgaaggtagcagccctttcccctgatagaaatttgatgatggcagcaacaaaacctaaacagagaataattaaagagtaagggggtagttaatgaaatgaaaataactttaaaaggatgaaaagaaattgttgttaacacaccatgtggtttacctatgaacctagctgctgtggaaacataataacacagagtcagctcctgcaatgcaagtaagccacttcctgggtagaaatggggctcttcggaaaaagattaacttttctgtccacaggggtattatttagctcactggaatagcaatttgacaaatggtgcctttatggcccaagtgaatactgctggtttctgctaaaagggcaggtgctacaaacccaagaagaaaaacattcttgcatacttgcccccctcagcataaggacaactttgagcctgttcatttttgagagttccagcagtggaaagaaagctctaaggtttggtaacctgtgactcacagagagcagaatttcaagcctagttgagaaaacattccttcaagagggtgctgcttatctgctttggccacgttggattttggaatcttaactgttcttgtcactttggtcctggttcaagtcaaaagagtttcttctacttgggacttgaattaggtgaagactgacggacatttatttacgtaccaaaatacacaacatatgtgttgcagttagttcctccttacagaggaactggtaagcactttagccaggtagggctaaggcaattttcacagttctgactgtatgaggattcctgtttctttgttgtcctattttatgcatcatccactgattctcatctaaaccccaggccattttgcgtgaaaatagtccttctataaataaaaaatttagaccagaggcaaaggagcctccatctctctgcttacaattattgctcaatgttcaaagttctcaagacttatctcttcctattgcaatccctaatatacccgtatatagatacatttaggtctgagaatgcttgagcttaaagagagtaagttcttgtttggtacaagctctgcataatacgtctgagctgtctccctgctttagaatgcagtggtagaagttttttttacagcactctgattttagccaaggaactaacaaccgttgtgtaatgcactagctaaaatagtctcctttatcgtgtaaaagtcatccattgactcatttatttatttaccaagtgcctactatgtttcagaaagggttgtaaagggaacagctaagacaaggtccttgtcctcatgcatgtcatactctaatgagaggagacagatcatactttaattggtaaattatagtcaattgccaacagcagtaagtgctagagaggaaaggaccagaataagggtaggaggtacttttgagaggtgacaacgtgctagcagccctcgctcgctcttggcgcctcctcggcctcagcgtctgctctggctgcgctggaagagcccttcagtccgccgcggcgctgtgggggcccctctctggggctggccaaggcctgccctctgctggcggggaggtgtggagagacaggcagaggtgggagtcggggctgcactgggcgctcgctggcaggcaagggttcgggctccgtggccccgcactgggcgcagccggctgatgcctgctgggcttgaaaagggacgagctccctctgggctgccggagtgcccgtgctaggttccaaagtcgccagtgagtgccactgagaggtgaagccggctgggcttttgggtggagtggggacctggacaacttttctgtctagctaaaggtttgtaaacacccaatcagcactctgtgtctagctaaaggtttgtaaacgcaccaatcagcactctgtgtctagctaaaggtttgtaaacgtaccaatcagtgctctgcatctagctaatcaggtaggggacttggagaccttttctgtctagctaaaggattgtaaatgcaccaatcagcactctgtgtctagctaaaggtttgtaaatgcaccaatcagctctctgtcaaaacggaccaatcagctctctgtaaaatggaccaatcagcaggaggtcggtagggccagataaggaaataaaagcaggccacctgagccagcagcggcatcctggtgggtctccttccacactgtggaagctttgttctttcactctttacaataaatcttgctgctactcactcttagggtctgtgccgcctttatgagctgtaacactcaccgcgaaggtctgcagcttcactcctgaagccagccagaccacgaatccaccagaaggaagaaactctgaacatgtccgaacatcggaaggaacaaactccagatacaccatctttaagaactgtaacactcaccgcgagggtccacggcttcattcttgaagtcagcgagaccaagagcccaccaattctggacacacttcgagtagtgtggttggagaaggtccttgggagaagacaacatcacacctgaaataagagagattagaaggagccagtgataacagacctggaagaagggaattcaggacagagggagcagaaggctctaacgtggaaacaagaaggccagagtacccagagcagaatgagaaggggattcctaatcaggaaggaatcatatgtggttgttcactgagagcaatcattgacagtctcacccatgttctacaaaatttcacttcatgattaaaacaaattatatctctgtctttgcctaagacgtgtattaaataacagcaatacaaataataaacatattaagtccattctgtgttctagtcacaatattaagtattttatatatattatttaatcttcacattactgctaagaagcagtgataaaaccaagattttaaaatattaaccaatttctcaagactaaacacagctagtaagttgcacgacctggatcaattctccattggcttgtttccaaagccacaggtttactttaacatatacagcttttatagcactaacattgtgttctatgtgtccgtcattaagttgggtattttacacacattatcttaatatataaaacaattatatgcagcagatgttattaccatgatactgcaaataagaaaactgagaaatagaacattcaagggatttgctcacagccaaataatagtaattggcagtgttaggatttagactgatttctgtgtgatctgtagtccattctgttcaacactacatgtacctgccttcccgtggtatcattgccccagttctgaaacctaggtctaggtcgcaggagaactagcttgataaggatgggctttagagccaaaatttaagccatgctttgtcttatctgcataattttatgttcccagtcaggtaaaaccttacccatttatctttatttcctatcaaatgcagacttccctatgagctgttgcttggtaagttccaacccaatatgatgtcaccactgggtggacctctatggcacctgtctcactctgccttggttccagttatttttgtatatgcttcattgattatttctactcacttcccggaaatgttccctttccctgagaaatggagttgtatctccctcattgatgcatcctctgtaacatctagctgtttaatgtgtcactcagaataagtgctcaataaatatttatcaaagtagctgatgtttcaggaagtctaggaagcaaaccacctcttctgttctgctcttggattcaagaacttaagaggattttgttggaaatccacaaagaatattttaaacgagacacataataagactctcttttgagatgagagaaaccaacaacagcaaaagatgggtggtaacagaacggtgctgtttgctgccagctgatgttcttcttgcctcctggaaagatagagccagaagtcttccatcacttcttgggatgagccaactggcctgttttaacctatattacttgagttttggctaccaaaactctaagcattcacatgggcccccacgaagctctgccatctgacactttcagcaccttcaactctatccagtctcactcctgctgtactaacaaacattccataaacacaaaaccaaaaccacttaaaaaaaaaaatcttaggctgtccctacaacttttgctatcctcacgaaagagtgttactccagtgagacaaaagtccatcacaagaaatgatttttctacggaaacagctgtgattggagcaagatacaaggtaaaacatgttgtggtcaagttcaaggagaaaacagggtggctagccctagcaatcctactggtggacttacttctgcacacttcatgctactatctatcctgtgttgtctaaggctatataatgtcgagagacgggctagtccaggaatcatgacagcaaatgagggagagagagagagagagaggagacagagagatggctcttgcaacctttccaatagcttttgataggttacgtatggaaaaagcctcatattgacatcaggtttacttaggttcaagtgaaaataatgtctttaaaataaattatctcttttgatgaaggaagtcctttttgttttttgataccatgttgcttttgggaaaacatgcctgaaagtaggcaagtttctctaaagcaagaactgtaaaactcacagaaacataaagttgacttgatcatgcccattttataaataaaggaatggagactcaaagcggttaagggacatgtctgcagtattttacccgtgagctatatgccctctgggtttctcctcatccatctgcccccaacaactatgctctttcctctttcctttactgtttctgggcatatcaaagccaaacttaacagcaccaatttcacattaaacaaaagaagaggaacctactgaccaacctttccccatcgccaccacgtctagcctcgccagactctggtaatcattacactactctgtaattctaagatcgacctttttagattccatatatgagtgagatcttgaggtatttgtccgtctgtgtttggtttatttcatttaacataatgctctctaggtttacctttgctgcaaatgatgttctggtgttctgttgcacagtagggtaactagagttaacaataatatattgtgtcattcaaaatagctagaagagagaattttgaatattctcaccacaaagaaatgacaagtgttagaggtgatagatatgctaattgcccagatttgatcattatacaatatacacaggtatggaaacatcacattgtaccccataagtatgcacaatgattatgtgtcaattaaaaacaaaataaaacataaacaggagagaaacatgagctaaaaagaaaaccagtaagcaaatgcactagctgaatcagatcattttatgcctcttgatcggactttgatggtgggaacatcaggctacaactcttgcctgaatccacagacatggaaggcaagagaaattatttaagcctatgcaatcatccaggaatggaaagtgggaatggggttcaccaaacgtactagttttctagggctgttgtaacaaagtgtcacaaactgggtggcttcaaacaagacttatttttttcctattctaaatgctagaagtctataataaagccagggccacattcctgctgaagactgtagaatccttccttgcctcttcatagcttctggtatgtgccatccacctttggtgttccttggcttgcaactgcatcactctaatctctgcctgtgtcatcaaatggcgttttccctgtgtgtctgtatttgtctgttctcatgctgctttgaagaaatactggagactggataattcataaaggaaagaggtttcattgactcgcaattccacatggctgggaaggcctcaggaaactcaaaatcatggtggaaggggaagcaaacacatccttcttcacatggaagcaggagatagaagtgcagaccaaaggggggaaatggcccttatggaaccatgagatctcatgagaactcactatcatgagaacagcatgggggaaactgccaccaagacccagtgactccttactgggtccctcccatgacatgtagggattatgggaactactattcaagatgagatttgggtagggacaaccacatcactgtctgtcttcacatggtgtttctttcttcttataggaacaccaatcattttgagttaggatgcattctaatgacattatattcgtttgattacatctataaagatcctatttccaactaaggccacatttgcaagtactagggattaggacttcaacatatctttttggagacacaatttaacccataactccatgttataactgtactttttcagaatatcagtacgatggtgcccctaatcaacaaatatattgtcaccaatatgctgcagtctgggagaacattcagggatttaatttttctgacacacagactgtgagttcttttgttttttgtttttgtttttctttttttgttttcagcacatcacactctggctgtcattatcagttccccataaactgtgataatttttgtgtcacatagagtgtttaggttggcctctgatgaaatgaagcccaagtacttgctcttccaggcacctaacccagggcaaaaacacagagacctaaatgccttctctcagattatttttttattatatttccagtgagcagaaacattacagatgtgagacttgttctagaaatcagagtatttccccagggaagcattatcactgttcagatattactaagaagtgtaaaatgctggagggcaattgcatccacaccgtcctctgcccatcactgcaaagggagaaaggagaaggccatggggggatgcagcaagaccccaaggtctaggctcctctgccaaaggagcatggatgaccaatttggaaagaacacttgagaacctctgctctgtcctcttcacttcactagtgagaaagctaaagctcagaaaggataaatgacttgactaagctacttattggaaggtgggtgattaggatgtagcataggggtaagactgtgtaaccagctgacactgctttaaatgataaagcattgagttgttctgttttaatggtacacaagtcaaaattgttcaaggattgagagtggagccagaaagcctgggtgtaaatcctggctccttcacttacaagctgcgtgatttggggcaaatcaggtaaccccttcctacttctgtttcattgtctgtaaaatggatattataataatgtttacttcatagattgatgtaaaggtcaaattcataatatgctaaaagttcttggaacattgccttacacagatcaagtgttaaagaagaattgatattattattattgttattgttattattcttattatccttgagttcataatcagggtgtcctgaatatactacacccaggaatggaagccccaccacattgtaaagacacattcacttcccttaaacctcggcatatttgaggtggttgtagcaatagtggagggagagcagcaaggatggacacaaagcttacagtcacccagcagtgtaggaaaggggggaatcctgcacacactcccagacatggtggaggtcctcaatcactgcagagaagactgttgtgggaatgacagcaaacatgtagctcatcaagaaaatcagctgacttattagttcttctggatctggttggagtccctgaccccagagctaaattataaaggttattttgttgtaattttgatgctctaagaaactgatgtaagatatagaaaagttcttttttttttttttttttgagatggagtcttgctctagcacacaggctggaatgcagtggtgccatctcagctcactgcaacctccacctcctgggttcaagcgattctcctgcctcagcctcttgagtatctgggattacaggtgtgcgccaccatgcctggctaatatttttatttttagtagagatgggttttcaacatgttagccaggctggtcttgaactcctgacctcaagtgatccacctgcctcggcctcccaaagtgctgagattacaggcatgagccaccgtgcctggccttataaagttcctcctatattatacgtgcccatacctctatactagtttttctctcttaaagctacattgccatctcttgtattatccgtgcatttgtcacctgccacttgtcccccatgcccctcctttctagcctgtggtttataacatgctgtaagtctggaaaccaaataatcatgtttattagacttgtatgtaaatcgaacctaatgctcctttcctttgttgttgttttccttgataatgtggtcttttaaaagagtaaaatttgaactaggatttatgaaatctaggtttaagtttgagttctttttctacttatgtgatcttattcgagtctcctgacttctttggataaagcccaaaacaccattttacaggtgagaaaactgacagagtgacgtatgagtagaacagaggagaaaaggaattgaaaattcaggtctgtcaaactgtaatacccaggttctttctgtttgataacaccgttttcaaatgttgagaatgactaaagaaagatatagaaatttgtaatgattaggtatttatacattctcaataatgaattttggtataaaaacatatttttttatctaactatatttttcatgcagtcatttcagtcagtatcaccatctaggtttcctctagggaccacatatcaatgactcttaaaatcactgttgtgcaaggtgagtgggaaaggaacaggatggtagagtttggattggggaacagactttgagcactgaacagcaggcagcattgctgttggcagagtaacggagaaggcgctgaggcttacccatgccatcatggcaaaaaatagcacggaaacagctggtgagctgtcagaatgatcttaaggaggaaatgtgaaatgtttctgcttggtgcattaatcgagagttatttggacagaactgaattgccaggggaggaacaagcaaggtggtaactcacccttccctgccctttcatctctctgtaatacggttctatgtcatgggcctccttcacatacacactcccccagttgtccattactcccaccctctccgtcttacccacacctagagatatgtgtgcacacatccaaagagataacagaaaaaaaatccatttgaaatgcttacagatatttcaagacaaaatttaaagagatattggacagattagcaattatgacttttttaaacttttattttaggttcatgtgaagttttgatatataggtaaactcatgtcaccgggctttgctctacagatattttatcacctgtgtatgtaagccttgtacccaatagttatttttttctgctcctctccttcctcctaccctctaccctcaagtagacctcagtgtctgttgttcctttctttgtgttgatgagttctctagaaatctttgtgattagttgtagttgagtactaatgtggctttgttttttttttcatggagttgtttaaatatgtgtcctgattaatttttgttaactgttatactaagacttttcaccatcaatgaattcagtgaagggttgaagggaagaagtgcaggaaaggagaacacacaaatgagaatgtcagtcttgactgctgggtgaactttttttcgctgtagaagatgaaacaaattgagggccaacctcttgaatcaaattgcaaagtaactttctgctgggaacagtttgagtaacccgaagtagctaaggtcataaatatttttacaggtggctaaggaaagagcatttgcagccatggaatcaggtgttgttattttgggtgtgaccttgaatagaggctgctaacttttggcttctgtttccgataataaatctccctcctccccacccccaccatcagccccaaggaaagatgaatgactcaggtgcttcagagacttcccaagaagtggtttcagtatatgcagcaagtggacatttagaatggcacagttatccatataggaatattgttgaggcagttcatcttgttgtccctatagtgtaattctttggagtagaaagcaaagagcaataatttgtccaataaatgaaataaggaaatgaagagaaaatttacataagccagggaggccaacttaattttctaaagtagtgaattgactttttttccttggattttgaaataaatggcaataaatccagttgtggggtagagttctttgctttcagtgatagcttaggaacattctgcagattgttaggattgcttgtatgtggttttaaatgaatgaagctgtttctatacagctattttcagaaattctatgatctaaatgttttagattcaggcaaataaatacatatctatattgggagataaggtttttgctcaaacaagcaatgagtagttttcccattcctaatgtccacactatcttgaccactaccaagaaacactttttgcaccatgatgtgcaaaccatgtatttcttatcatcttgatgctgttgctcattttgcttaagttttaaagatttggcctttctctttttatgttgattaccaagagtgtctttgcaaagtcctttatgcagtactcaaagtatgtccatgccatttagctcctataaagaaaacaagtttttagccttcctaggaaattaagtttcctacaaaatatatgctcttcaaaagctctctcggcttcatttcaagcatggaaagcttgctggtgacttttgttctacttgatacggcatatccattcttgagtgaggctgagtacaaacagcattatcctgatgtaaaggaaacaaaaataattctaaccactaattaactaacagcaaagagactgatagtcttaaatggaaagaatacttccatggtctagtttctagagaacactaccaggggcttgaaggtaagtagcctctactggaggctaagggaagctaaacacttaagttttcttctatattatcagttgctgtttagaataaattataatctccacgtttttttttgagacagagtctcgctctgtctcccaggctggagtgcagtggtacaatctcggctcactgtaacctccgcctcctgggttcaagcgattctcctgcctcagcctcctgagtaactgggattacaggcgcacagcacctcgcctggctaattcttctgtatttttagtagagattgagtttcaccatgttggtcaggctaatctggaaatcctgacctcgtgatttgcccacctcagcctcccaaagtgctgggattacaggcatgagccaccgcgctcggcctcttctttactatagagtaaaagttgcatggtcgttttcttgcatttgggtcacagcttcagaaggttattaccaatcagaaaaaggttttgagtcttttatttcctaaaactgagtgtattcgttattgtctaatgacacagcataacaaaccactgaaattcagtggcttatcataccaaatatttacgcccatgtttacaggcctgcaggttgactgaaatttggcttgtctccgctgggctcagcatgttggctctcctttggactgcaggtcagctaggattggctccaggctgggattaggttcagatatgctccatgcatgtttttttctggggctcaaactgaagggacagtgtctatccagggcttagtctttcatggtacatttctgcagcacacaaaggctccctccaaatgcagcaattccttcctcagcggtagtagtccagacagaaacagttttggtggttgcttgagttctcccagttgttctcctgtcattttgcaggtcaatctgcttcattataggaacattctactggagaaaaaagtctatcattattcaaaatatccctccttatgcatacttcccactgcttagatgtctatactcagaaaagttactatgtggtttttctttatgggacaatactgcgtgatcgtggcgttcacatttctccctccaagtccttgcttttctagtttctgtaatcattcctcaggtgacataaaagtattttccgaagttttgccattttcatcacacaatattgtggacaaattaaagcctattgatgactttattaaagcagggtatttaccacaaattaggattctctgcattttgcctgactcctgcagagcacagagaccattcttgtctccaatagcaacactcttctattaatcaatcaagagctgacatgaatgtttttatagagattctgttccacttagcgatcctattgaacccctggccatgtggtatccccacagctcttcttctgaaatcccattttgaccaagccatccaaattatacacttagactgtaattgtttcttttccataaatgaatttacattcatcttaattcacattcgttgagattttttctctgtttccaagtctcttcacagcatttgtattctgtcattcaatacatttcctccaatacatcatatcacattcatatgcaatatgaatgaacttgtaacaatatctctctttttttttaattcaagccactgatacaaatattgaccaggtaggttgtaaaggacatggttctgtggccagccctgcaagatctccttatctgtttgtttagtacaccatgtatataatgtgtaagcctgcctcagttttcttcatggtggcctcagagatatcactgaagacctatctgatgctttgctgtgatttttattccctgttcacgccattctcctgatttcctgtatagtaactatattctcaagaagatgagattagtttgatgtgactattctttgtgaagctgtactagctaattgcatttcctcttagtttctaaaacccagaggtcccaaagtcaaatgctttgcagccaggcaagtaacaaatgtctgggtcagaagctgggtattattcgtcatttcatgaacagaaatatatatcctctgagtagaagactctgccagcagaacaaaattcttctgttagctaatttcactagccatcatatgatttagcttctgaagcagcttgctgctctgttattcgtgtgaactcatatcctttctcatttggaaagtcaagaccacatgggtacacctcttatcacaagcttcgtagagaccacaaagatgccactttagtcccaactcactaaatctcctctacaatgtctctaaaaattatccaatagtgttttttaaaatatatatcaaattatgctatctcaccacatcacagtatagctgctactattcctcctgtcttcctgtctcagaggaaaaatttgcttatcaccttccacagttgagtctacctaggtccttggcctcctgcccttttatcttttctgagatctcatgccatctgttacctcatctctattttatctgttataattcctctcctctgcttcttccccagctgctcagaacatactgaaatatatgtaagattttgggttttttttctggtcattttgctcaatgacttcctaataccaactgaagagagtttatatttcttaatacaacattgaaagcctaacatgatttggcctcaacctacctttttttatccagtaaaattcatttctctctaatgtatactatattccatccaaactaacccactgattagacttcatttttcttttaattactgctttttgctgtgctggtcccactgcttagaatgttatttcctcaaccttatttctgtttcctacatttgttgaaatcctagatgtccttcagaacccagcctctgagtcacctcttgcaggaagccttccttgctttccctagcagaacaacaatttctactgaaaccctgttgaattttgtctccattattgcctttaccaccttctatgttttgacagctattttgactatgtcttatctacccaattgtaaacttaatgaatacccacactgtatcctatttatctttatatctttagattgcaacacaattctttgcacatagtgtgtgccaaaaaatctctattgattgatggtgcaattctgatatttattaataatgatcaatctaagtatttatccaaatcaacccaatgccctatattttgggacaattacccttgagatttttataaaccaaattcaccccatgtaaaacagatgaaattaaccttaatttttatctgatgtgtaatggctaattggctaaatttctttcataaatattacatatgtactattttttatctctataagtattctagtttgtctagatgaagaaacagaggctaaaaatagttaaacaaaaaattacctgtttcagagcttgaaagccagatctgtccatggaaatctcctgagagaagaaggtttggggatgcatataatgagagcagagaactggataaagagatgtctggatctatttttggctgttgtttagatttactttgtgactgaaggaagtttatctgaggctttcccatttgtaaaactgagattcatatacaactgtgcaaaatatgtgtccctttacttacctccctctaagagattaatgagatgatactcaagaagcactttgattttctctgatgaaagaaatggataagtatgaaatgaagcatttactacttctatcgaaggtttttaagatggcagcctttaaaaattatcaaagtgaaagctaaaggaagaaacagccgtgtacattttaaatcaagtcaataattattgtagtgcacctaatgattctctgatatgtgttttgtgcattaaaatttaccaagcacttttacatatattatctcatttgatccacaaaactatcctgtgaagtatgtaggctaggtggtttcattaccatttttgaaataagaaaactaatactcaggccaaatgacttggtcactgctgctcgactcatgtgaaacagtccagggttaaactcaagtttcctggattccaaatcccaattcaggtatcttgcatttctgtccacttgttaacatcatagcatgcacattggaccatctcctctgtgttcacttacattctatccatgttcaggattgagtttaaatcccatttctgctcttaagacttcccttatcactttaactgaaaggcagactttcttattccatattttttttgtccttaaatatattgtttcctggaggtctttctagtgagttggatttcctgtattccattcttccttaaaataagcctttggaattcagcccagcttccacacttcttgatagctgccaccatccatttcattcctgggactgagcctcagcacaaggattatttaaaagttaaaaatagttgtattcataatcccagcattttgggaggccgaggtaggtagatcacctgaggtcaggagttcgagaccagcctggccaacatggtgaaaccccatctctactaaaaatacaaaaatcagccgggtgtggtggcagacacctgtaatcccagctactcgggaggctaaggcaggagaatcactagaattcaggaggcaggggttgcagtgagttgagatgcgccactgcactccagcttgggtgacagaatgagactctgtctcaaaaaaaaaaaaaaaagtttttttcgtgtcggtattaatgcctggtataatacctcgcacacagaaggtgttccatatatgcctgctaaagaagtggctagactaatcaacaattatggatgggagggaaggttcagaaagtttggtgacaatactgggaaaaaatgttggcacctgataatggtggacctgggataccaggctgaagagtttgaaacttgcccttttggcaacaacagatttattggcaccaaggaatagttttgctggattccacttttgaactcatcaaattccttgcttttcttttccttgtcttttcaatcctactgggacctcctcccaccagtgccactttactggaggcttgtgatatgtatgacaggcagtaaaacccaagtgaatcaaggaagcctgttaagagcactgatttctatgatgtctcagtttgttaactaaattgcaggttgtactgcttggccagagacagctgacaggcaactctgcctgaacaagtagcatctccaaaatgacatgtgcactttagtttcattagaggcagtggtatcatgattgcctgggccattgcaataaatatggtgatcatatgtatcccttgggatttggggttgacagcatagttgggctgcactaaagagtcttactctgacataaatgacggcaaagtagatctctgggcccctcagcaaggaggcagaagttcatgttgcaaagaaagttccacgggcctactgaaatattaccaatcaaaattacaatttcatttattgacaagtcatatttaacattcttctaatgttttttctcacatgccaatgtccaaaaagctaaaccatcagctgcatgatgctaaggctttcagcagtcagcagaagcagtggtagttgcgagctggttattcagaggcagctactgtgctccacataaccataaagtgaacattttgacattcccgaaaatgtaccaacctccaagtcacaaatcctctgtagatgcctgtggattggcttttcagatcctcttaaaagccaatctgtggtggcaggattgtctgaagagggtagacttgggcttctggtacgttacagaaggcatggtttctccatctacactatgctataagacaactgctcttctctgaaaagaaactactggaatcacacttcttgtaacttctctctattcccttatttagttggtgggattggatgaaggatcttcacatgtctagtgagactcctttcttctcttcttcctatccaaagggcttttcttcctgggctgagtgtatccaggcctatttcatctttgtaggaggcaaagggaaagagaagagaactagaaattggtgtaggcagactgatctgtggccaggtctaagtgttgccccaatccgttctcccatccaactccacaagcagtaaagtttgctggtcctttcatctatgtctatttctcaattggcttggatttcacaatgaagagggctatgatttattggcccacttaaacctcaacatggtagagtggcaattttgtttttctggctcttatattgcaatgaatattttttatttgacagtctgttataaacgaaaataatttttttcactatcagtttctactcaaaattaaatggtagctctagaatagtggcctgcattaaatttttctttatggttatagccatgcagatagatgcatgaactcagaggactaaaaatgtgtttccatgtaatttaaatgtacctttctatacggaacggtctgctgtcatgcaactttcaaataatgcattttattatcattatcttttccggcattgattaatcctactgtttattggctaagtgtacatttcctattggtatgtttctgagtcaaggtgaaagcagttaatacttaagagttgagaagcaagtttatttaaatctagtctttcttatgagtctgcctaacagtgatagattttgttgttgagccacagtttatgaaaagtgcattaaaacctcgagccgacccatctctctgaagcagcagttgggccattacattttggcaggcacttcagatgtgtgtatgattttatgatcaggtctgcttaattcatcccaactcttcaaagaggaagggaactaaaattccttgagcatcttctagtatgtgctagatgcctgcatatgttgttttatcctcatgacaatctctcatggtagatagtattttttcagcattgaaggtgagaaaattgaggttcagagagtttaaataatattgtcaaaaacatataggaagtgatgaagttaagctttaaggccaggcctgtctactcaaaagcctgtgattgttatattaagggttaaaaaaacaaaaaagtttgcaagagacagacaagttatttgaacggaatgaagtataagaaaacctgtgctttccttaatttttcttgaatcctgtggccttctcagtctatcctttattgaggttcagagaggttgctacttatatggtagcaaaagtatttcccttccctacttaccctactatacaaaacaaacaaacaaacaaacaaacaaaaaacagaaaacttgatgataaatgtcaatcaacactcagcctctgcatctgatgagcaacagaaattagcggggactgtggtgaattggaaaacctgtgcctttctctcccaatcagctctggctgattgtcctacagaaaatgttggctctgtgttactaaatcttaccattttttaaaagaacagtctagctgttcacgagagatctgatcttaaaatgttgaaaactaattcacatagaaaaatactatgtagtacccacccctcaaaaataaaacttatgtgagcactcgatccagcataaagtctctgaatttgtaagttctgtattacacaaggcagctaataagtaactactgggaaaaataattaacaaacaaaaatcaaatcaaaataattttcattactcttccaataattgtgccttccagatttagtactgtttgtgtattgtgcctctctgtggtagaggcatgacttctggtcctctatctgcccttcacagagtggagatgaggccagtatgcaatgactactcaagttttagatgttctgagcacttgtttctgtgctttctctggatagatctggtagtttggtgagcagagttggcgtggctcatcagcagtcaccctttggcaatggaaccagaaaagcatcatgctgtctgttaaagaatgtgtctatgcttgtagctagtttcctaagatgtttgcctctaggtatttgcctgcagaaagttttttgaagtcaatacaaagtagagtggcaagcgatgcatccatgtttgaggatttgggaagcatttttctgtattctttcaagtaaggcctggtcgataagtttagccacactcaatctaattccttgtctgtatccttattatctcccctcctcttctttaagttttcacttccttctgaccttaatcactccctcaatgaacccataagtatcactgaacatgggtgtcaccagttagcaacagtaagataaccgctaacttctgaaacatggaagctctagcattgcttggatgatgtcttccctgactgcctgtgagcctctggccaggatccggggtaagtgcctcacaaatcactgttcatctaaacagctaaagctcttctcctgatggaagagggatacctacagcagaaagcaagggagtccaccaggcacgtttggaaaataaaagattttatttatatttattttgactctatagtttctaaattccataaatgaaattttgccattatcaaggaaatatttgctagggagtataaggaaggccctttgggtaagagagaagatattctctaagctgtagcatgtttatgaaccttaaaaattacttgtctgtgtttgtatatgttcagctctgagagtcttccttaacattcaaatgtctctgtcttggcaaaaattagtgaggttttagaaagtagaaaagctggttgatagtgtaaggaatttttaggccaattttctattttttccttctatagactgaattttatttttataccaatagtttcaatcttctaaacttctcccattcctctttactttctcaactgcatccacttaaatacatcttattgtttcagtcagccttggctgctataacagaatggcatagattgggtgacttaaaaacaacaaatatttattgctccccattctggagactaggaagtccaaggtcaaggtgccagtcaatttggtttctgctgagggtccatttcccgactgacagatggccaccttcttgctgtatctttacatggaggagagagaaatcatgcctaatgtcttttctatctccgggcaggtagtgcaggaattgaacttggttggaggacatccagctggtgtctgctgcagattgcttgcttgcttgcttgcttgcttgatgtgtggggaaaaacctccacacatctagcgtcagaagcgtgttgtgagagtataggagaaactgagtttgttttttctacacagaagaatttcctatcctgaaggccaggtaatgaatcctctttctctggttacttgggcaatttatcaatgactgtctgtggatatttatttggaaatattatatgggaacgttccttcattttttatatctcaatttaggaaaccatgtgcttctttctcatttctcttttgtccccatcagcgatctatatttttttaaattgttattagaaacatctcttatttaatctccatcatcacccaacaagctcagcaatgtgactttgtcttacggatgaggaaactgggtgcagagtatttgtggctttccccaaaacctgcagtaagtgaacaactagaattatatccaagccttctgattcaaatgcagttgccctatgcaccacaccaaagtatcgtttacactcttgagggctaaagaatgccagatgtatttatctaacttctgatgtgcctcccaaaatgccctatacagaggataggatcaatacacacttgatttcaaaatttctatgacttgattctacttacacatcttattgatttggagaaataaaggtacttcttgggggaaaacatgactacatgttaaaattctgaatttggcaagtctagtgcaaactgaaatggatggtggttgaagtacagccaactcatggtggtccaaaagactgtggtgaggggatggcctcccaagaggcagggattgagccctacactgaccagaaatcactgcattacagaataatggagaaggcaagacaatgaaactgagtttctctgaaagcttggcatcttggatatttcaaagattaaagttgtatttaatgggaatcacgtggttcaattaactggtaataggatggatcagtgtccacctctaggacttcaatttgagtctaatccaaacacagaagcagagtaggttgaagcccttggtaatgaacactaagcctttcacctcccggtccacagagaaagttcctctcaggccacagaggcctgctggcaattttcctgaagacagtttggtagactatgtgaaacaagtgaacagctatggtcacctgagaggtagtggtactctacattttcaaaagttctctcccaaagcaaaaccatagcaaaaattgaaaagcagtaaatgaaccatggatggagatattgcactatgcacttgtcttgctagcagaagaatgcaaaggtgctttcaccattgtgtcagatgcttggctgaacatttattaaacttttgatatggaggaagacatagaacataaagatgcattttcttccctcacaatgctcatggtgtgacaggaaaaaaaaagaattgttccattaaaaaaacattgaaatgaatcaacacaaactgatgttattattgaatagataatggagagattgtgggataattagagaataaatctggttatcaaagatgtctctggaaggcacgtgtgtaaagttgttttcagctctgtacacctgtgcacactggccaggaaagctggaccttctgcagagaaaactgtcttctccagataggaaagtgtgcctcattgagctttgggctaggccagagctagaagatctttcctgtgtttgggtcattcctagatcagtgatccctaatgaccagttccattccctaaagctaatgttgactctagatctttctgacatttgattcatgctggaatccatagtttgttttgagtcaggtctataatagattcatattcctgagaggcttcctattgaaagtgaagactcaggattccactgactgttctgccactgtttaaggacgatattacagttggattatagatgacctccagtggacacagaggtgcttagattctactgagccaccattactttgcctaaaagaaaataagagggtcaaagggactaacttttgtgtaagttttaaggttttattcaaacacaaacacacacaatcacacacacatttacatggcaacatatctacaaataactatttctctagcattatgttcctcagcctcttgaatgacatcatttaccttcgtcatgttaatgaacaaaattgtagctcactcataaagaagagagagaagaatgtttgtgccctttaaatgtcaaaaaataaatgcttcttcatattgtgtatgagttcactataaactcatggataatttgtgtatctgaagctctgaccggcttccagagggcttacagtgcctgccatatcttaggggaacaatgacctcatgctgttccagggacatttctatttctccatttggctgaaacttactcactttatactttggtagggatactgaattcaagtaaattaaaattaggagatgtgttctctaattattctatcgaaagagcacatagctttgaaataattctcaatgctagtatggtggactcttttcaaaaggtatgagtcagctccctgtgacatgttttccagtgtctgcttggggtcacctttactaatttcatcaggactgagggaaagcactttccttttcatatttctgcttgggtgtccagatcattctcccctacagaggctttgatgctgtcatggaggtcatagggccggccttttttcgaagtactggagctttttaaatttcactttttaaaaaatttttgttgcttttattatggtggttgggggtaagtaaggacccaccttttgaattagaattactgatcttatccaagagagaatgttgtagtgggtgatagttgacgaagaagagaaccataaaatatcacctggatgaaagacctaactgcagcactatctccaggacacacacacacacaccagagtccccacgtgcagacaggcactgctgatatattacagtctgttggccattttgtttatgataactaggaaaggaaaaatgagcccttatttcagtgtgttcatcccaagatgatgacacagtagattccccttgcaggtaaaccgagagagctcagttaatcaccatttatcactcaagtgactcaagtattttgcagatgcattggagccctggagactgagatattcattgggctgcaatgctattctcttttctcattccatctaatataataaaataaactcaaatcctaacatcagagtgatgtgtgctatcttttagagtcccaagcctttaaaatgtatttgattcactcccatagaactagatacattttccaaacgaaatgtgatatcattacaattttaatgacttataactttgctccatctcctccattaccagactattcctagctactaccatcttttgccagaagcctctaatttatttctctgcatctgcagctgacctccttcaaacagtgttattttgagttgattttagtatataaaccactctcagtgggatctaagatagattagtttatgcctaattgagtgagcttttgtagatcctcttattttatataacttattagaaaatatctaagatatattgttctatttgccaaataataattgtgaatcaggttcattgtacactggttaccaatatgcctgagcctagtgagagagaacacccccacacacaagtcacatataggcagtaaaggacagcagaagctggggaatcattttgagctcattctccaaggctcaggaaagctgcctatggcaaatggaatccacctgtgcacgtactgcacctaagggaccttggaaagtaccccactctgggttttataccccaggggcaatatgactcaataagctgaagtgttgaaggacatcctgttctggtaggaagtggaacagagacttggctattccagccagttcctccttatctgagaatgttacatttctggtatattctttagttatttttgagaactacaagtgagaaaagaacacaaaccaggttggtccgaggctacctagagaactttcttccaataggtgaatgagcaggtatgttacaggttcctcatttgatcctctcaccctatttgagttattctgaccacttgtacatcaactattgattaaaatctgaaaaaagaaaatcataggtgaccttaaattaaacttaaattaaacttaaaaaaaaaaacttaaaaaaaattaaacttaaaaaaagttccacaacgaacaggggtcagcaactttttctgtaaagggccagaaagtaaatattttaggcttgtaggccacatgatctctgttgcagctactcatgtctgctgttgtagcatggaagcagccaaagataataatacatcaatgaatgagtccagccgtgtcccaataaaactttatttataaaaacagggaacaattatatttggcacacagtttgctgatctctgctctaggccaatctatctcctccaacttttgcatattcatacctcaaacatatcataaaaaactgccacaatctaaaccgtattatctgatgaccctaagtactaaatctctccattctgaaatgtgtatattaattttttttcaggtagagaatggtatagaatttagacagggaatttatctgagggattgactgaaaatgccttacttatgaaaaaagagttcttggttggtgtttattattcatgtaggtccatttaccttgaagccataatgctaatatagcctgtcatttggaagttagataaatagtaaagcactttaaagaatcactaaaagtttcctcacaaccacagaataggtcttggagggttactcacgctttgctgatctctcatttatagaggagcagctgctcatttttggcctagaatatccacctctaagagaagaaatttctcctttgcatcctgttcagagctgatcatgcatattcttggaaactgactaaaatgacctagtctgtagtaaagtaactaatttagagttgggactatcaactaatgttattttgccagaggagatgaatgaaaagacttccttagggactagcagcaatcagtcagtagggaacagggttaccaagaccagatggagaaaatggcataggacatgtgtattagacctgccactttctggctctgtgagcatgcatttcaaagtttatacctgcaaagtgggcatttgacagagtaggggacagtcggagagcttatcgatacatacttattgctctccttgtgttctgtttgctggaacacaattttagatcaaatatttaaaaattcacacgtgcgtgctcatggctgtgcactcatgtgcatgtgtgcctgttgtgtgcgtgcatatataccatacagaaaagtactgtctggagaatacattagactatgcatgtaaatgtgtgtagaatgtttttcttttttttcatgcaatacatgctctatggatatttgttaagtgactgaagttttgcactccctggtgcagtttctcaatagtggcactattgatattagagccagctatttctttgttgtgtatcattgtatatttagcagcatgcgtggcctcgacccactagattctagaagcactccacttcagttgtgacagccaaaaatgtctccagacattgccaaatgtccctggagataagcatccctgttgaaatcactgccttagtgaaccaagacattaatgtaagaaagtggttcctaaactttagcatctgaatcaatcaccttaagttcttgtgaaaatacatgttactgggcctcacactagagtttctgattcagagggtcttgcactagcactagacccaacaatttacatgtctaatgagtccgctggtgatactgctgctgggggtcttagaacctcactttgtaagcacataagtaaggtgtaagatgttctggaaaaattccagatgagttaaaatgtgtttcctcatttcaaggactgtaatgtttgttgttagtgtgagcacagggcttaaggtttctttatgaagaccgctgggtggttcctcacagctgtggttgagatttagcggggaaaccggacgtttatgggagacgttcagtctgtactggattttagtcagcactgccctgccagctgtcacctgagtcctgccaggagactgctccaggtcttggcacagggctggggcacctatggaaatgaacttgaagtttgccttgcagtcaaacttaactaccaaataaaccagcatgacattggggtctgtgaatgagaagtggatgttccgagtagatttgaaggacgtgatgactcaggatgccagttgtgactggtgacttagagccgtggtagctttgacttgcatcttatttacttgcatcggctgtcttgtccttccttgcttctcgccttttcaggtcatggttcctgatgtcctaagctgtcatccctactctctctctctcttttttttttttttttgcttggagtcagagatggagctgtctcgagctatttatcagtcttatctctctgcgccctctgttagcatttcagactgtggatctaatccactttaattgattgacctcgtgcaaccagacatcagtaaaacaccaggtgaagcacaactgcagccaggggagaggtggatgtaactttcctggttgggtgcaaagttcgctgaggcctataaagatttagaaaaggagaaatagttttcaagccatttaatatgaattttctagggacaatgtatacagatcccagagtcgatgaccttgactgggagacagtcgttgtaaatagagcagtatcctatagggagtgtgcaaatgcctctgactcacctgtcatccatattagtactatttctcagctagcatcactattatcaccatctccaaacccatcattaacatatttttacatcattgtttgtagataccttcagaatttgccaagattttatttatttctcttaataagtactatttaacacaagtattactgttgctcttgtcttcgttatcgtttttctagacaaagcttgagccatggatagttgagggacctgctcaagatcacatggaaaaaataatgtggagcctcaatcagtcccaattcttttgattctaaatctcaaattcttctagaacacaaagtagacattttcctctcccctgcttttcctgccacagccacacttcagcttctcaaggggaggggactgggtcattgtcatgaggtgatcatggactttgaaagatcttcaagctctacagccgtggtcttgtcagtttgggtgatttctgaaaggcatcttctctgatttagatttttcaacggagagacctggtctcttacctctcttgaaataccttaataatgaagtgcttactctgtgcttataaaccaacaactgtccagagtgtagaacaagaagaccataatgttgaaagagtagagactaatgatcttcactgaaagacacttaatagccacaaaaagagcgcaaattatgttctactgagttcaatgttttattctaaagaactgcagtaaaagcctctgttagtcaaagtcaaaattgatcaatcaggtaagctgtaactcatctttttgtattttacagatgcatttataaagcatagtgagatgttttgcctaagatttattgcacgaaatttgaatatggtagcaataatttattttatcctataatactgaaatcatatttggtctcttatggtacaaaaaagattcttctaatttttttaaaatcacaaccacacattctaattcatcatttattcatttccatatccattaatttaacaaacatttactgagctcatgttaggatacttacatttaaaatactcacaattaggctaagtggacagataagttaggcctacataaaatatgtaatatgtaacacatgtatttctgttatagaaataactcaattataacatgtaaaagctgtgattgtcgaaaatgcatggattttagagtcagacctggattctatttttccataagtctcttattgtgtgaattctcttgtaattaattgtaagaatttgaatatacttctattataaaaatatttactgagcacctattctgtccatttaggtagcctggtttatgttgcagtgacaaaagcctcaaacacttggtgctataaagcaaccaagctttgtttctcagccatctgcatgtccgtagcaagttggcttattgccatcctcactcaatgacccggaatgacaaagaagccgctaccaggagtttgctgggtgcagtggttgacaacaaatgagagaactctcgtgggtctcacaccagcaactaaatgcatggctcaggaatgatactcaatttatcagttaacactgttctcttggcccaacccatcacaacgagacccaaaagtcctctcttactacaaccctataatggaggagaactaggaaagtgtggtaaacagtgccgctcattattttctttactaggaaccagactttgaaatgggtatggaagaccttgctgtgcctggcccacaagaggcattatttacatattgccttccttgtgttcttgcctagcactgaactaacaaattctgtgggaagcctagcagttaagacactgagacctgcttccattgcccatatccctggcatacatttgaaaatcccagttctgtttctctcagctgcaattttctaaaatagcggatgatgcattccgtcttccccaggggcagtctggaatgaacgaagagatagccttcagtgacatctttattcctgagaattcttcttgcccctgagcatttctgctcctggagtctgaccctggtgtcggtagcatctcttaggtcagcaccaataactgcagtgtgactgattgaggatagggcagctgaagctggactaatttggggagccaggtgggcttataaacagtcattattgatgaagagtgacttactggctatttaaagacagctggtttctgtgctgttcagttttttttttttcctgaatgcacttgaggattctttggtaatgtcttctgatttaccacttgtttttgtttttaatatcaaggaagaatatagattgaagcaattgtcttggtagcaactttagtggtgatggctgtggagttattaaaatttatagtcatgctgtttttgcagctacactttgcatttcttagagaggcttataatatctggttacaaagaatgtagagagatagcaactaccaaattgggataggaaatcaaccctgcataaattgttttaatatatattctgtttgctaaaatttacatttattttcacaatatgtcttgatgacagtgcccaccaagccaactagcccttagctcatgacactactttcagttacactaatgaggagaaagaagggagaaagaagactgacattttgtgggtccaaaattatccacagtgaatgccaggtgcttcacatgtctgtgctctcctataaccctcacagcaagcttcagaggtaacaactggcccctctttccctccacacatctctttatgaaagagaaatcagaagtaaaataaccagaccagggtcatacagctttaagagccatcgctgttatttgaaccatgctaggctaaaacccacatttattctattgaaacagtttctccaaaaatcagagtgttttatatctgatcaaatgatgggtggttccttctcctgatctgttttatctcatatatttatgtaatgttttattacttataaagtaccatcatgttcatcatattatatcatccttacaacagccctatgaagtacgaaatgctgatatcctgtccttatagtgtattatcaagaagtggcttcagaaaaatcaagtaatttgcccaaggtcagtcaggtctgacaccaaagccaatgcttttgttccctcacatcttctcttttctagacacatgagccagcggagttgatttgcatggcagctgtgcatgatagtttcaagcctgggcaactctatgggtattcgccacaaggcttccgtgacttctaatgaactgaaacaaagcagttagccatggattataatgccaccgtggtcccatgacaaatgacaaggaggttgcagtaatgaaattttattactgcaaatagagaccacatctgagatctagcacggccacatttaccattgtgggaaacaaaatgaaacacctgggaaaggatctccactgactttagcagtgagctaacaggattaagaagatctcccagaaacactgattacaatggcaaatgtgtggcacctaagataaggaccaaatatttattctggcagagattaaatcttttcttttcctgaatcaaatatggatcttgcagaaaatctgcccaagaatatatcttgctgatcagcgaactcactgagccagaaccgtacttggccactgctgtcactgaaaagctacagaatgctgctttaaaggtctccatgcttcccctaaaactgttttccatccatgattaattagtgacttaggggtgaattgaatcaccagctgtcctttccatgcatccaggatttatgtactggtttctcattgaagaacagtggtgcaataaacagccctcatttgtggggtgggcagaggagtaatggtgtctgcagtcatggtttcttaactcctctagtacttccattctgctaagcaggttatggctcacattattacagcctagcttatttaggcatgagggtcgtgggcagtgacacacacacacccttagaaatgaataccagttctttaagagaaagcagaaaagtcatattaccatttctgaattccttgagaaataagaagaataaaatggacaataatattagctatgggcatgaaaagtacaaaaagaacccataatcaggttcatttatatatgcatgcatattttaaagctaggtgcttttcctagtgcagagatgtagatagcggtttcaacaaacagatttacgaaatcatgagtgtgtttagtcacaattttgggaggtacctggaactcttttcccagagaacagaacatggggattgcagacatcattttatattgcatattatgtaatcagggcacaaaggaaatactgaggtccaccctgtatctctgcatccttgaatgctcacagcctgctttggttgatcattctatattcctcgcttctaagatcaagacttctgcatgacttgtccattcttttattggatacaagatgaactgacatactaagtgataaatggaaacttgaggaaagccttcattttgggaaaagaagtgaagtgtaccaaactatatatagaaaccagtgtccctccctccagaactcttaatttgttgactttaggtgtagtaggtgcttaataaattttgtatttgtgtatttaatgaatacatgaatgaataaaacaaatgactaaatctgagatttagaaaaactcttttctatatcttgatttatatggattctggacttttctcacattcttctttttcttttcctccttctggttttcctccttctcttccttttacttcttcttgaataaaaaaataatagaagataacaaaggatcgtgaactagtactgtgactcagtcttgtagaatgtcagaattactactgatatggtttggctgtgttcccacgcaaatctcatcttgaattatagttcccataatcccaacgtgttgtgggagggagccagtgggaggtaattggctcatgtgagcagttacctccatgttgttctcatgatagtgagtgagttctcatgatatctgatggttttatgagggggttttcctcttttgcctggcacttctccttcctgctgccacgtgaagaaggatgtgtttgctttccaggcccccacagccatgctgaactgtgagtcaattaaacctcttttgttcataaattacccagtctcaggtgtgtctttactcacagaatggaaaggactaatacaactactaaattttattatccttgaatgcccaacatattgccagtaatttggaaaactaaagaaattgagcaagatgtctcccttctgtccttacacatgcctccaacaccctgcaatgctatgtctttccaagagcttaagagaggctgattatatttgaatagtaaggttacatttatttcatgtctcattgtgactactagttccaacttttagtcataaccaattattagagaagagtcagagttttaatagcattattatgtatgctttgtgttttagtgcacttcccaggaggttggtgatatcaccaccagcatcaccatttgcatcattattatctgtattagtccatcctcacattgctataaagaaatacctgagaatgagtgatttataaagaaaagagtttttaattggctcacagttctgcaggatgtataggaagcatagcagcatctgcttctggggagccctcaggaagcttccaatcatggcaaataggggaggaagagtctcacatgacaggagcaggaacaagagagacacagggaagatgccacacactttaaacaaccagatctcataagaactcactcactatcacgagaacaggaccaagggaatggtactaaaacgttcatgagaaattgtccccatgatccaatcacctcccaccaggccccatctccaacactggagattacaactgaacaggagatttgggtggggacacatccacaccatatcaccgtcttcactgccatagtgttactcttatctaattcattgcaatttcccttctgacaagtctttgatggccacagaggttctcttctgctgtgttgcataagctctggtcttgaatatatctctctttggattaatctgaggagtagggctacaagttgggaagcatggcagccatctaatcatgaaaattctaggtgagtttcattggcctctactggggttaccttttctatgtggtttggaactgcagaaccattatgtgcatgtgtgtgtgtgtacgcgtgtgtgtgtgtgtgtgtatatttatatacacacacacatatatccagcccctctgacattggctcctaaccattctgtacacctctgctttgccttgatcgcatgaaaatatgctgagaagctcatatttccactttaattgtaaatctgaattgataaatgatttaaggtccagtgtcttggtgtactctcttagtaaacaggcctaattcatctcacagaaataaactttgcattgtcattgcatagctactaggtagttccaggcctgatttgccttgaggggaattgaatgatgtaacctgtgcggtgcagcctgtgagagcaatttgggtggtttttatgccattggtttttatgctcaggatgaaagctcatggagaaatgtagaatgctattattatcttatcttcatgctgacagctccctctgggcacctacaggtttattgctggttggaggatcaagtttaaagggagagaacttcgtggttggtgataactatgccttttgtgtttctttattataggaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggtacatgttgttcgctcaatggtcctactctttttgactctcccattctcacttttcagtggtgatttttctcatgactgtcaccaaattccagaacactgagtgaagtacacattcatgatttttttgtatgagaagataagtcatctctttaggacttgatccagtatagggagcttctggagactttaccaactatgcactggacactttttgtcaacctttgactgatacagcctgactggctcataccaaagacaattacggtagattttgcagggcctgtagatgaggagcagtgaagggaaggatcatctctatcatgagctagtgtcgataatcataagatgctccatttgagacccagactttgtggtgccatttagtcggatgcagttgaaggtgcagatgccagagagagactctaaaaggacaattactgaacttgaagacacagatcaagtcatggtaacaatgagagaaaaactaaggtggaattttattcgtttggtggactttgctagtttttattttctcacttaccctaagcctgcctggatattcaaaggttggtcctagtagtcattttaatagcaagcatgctggtgtggcaggaaaaggggttaatcatctgtttaaattttacagtcaagaaacattcagcaacaaattcccagagccagatggctgaatcaagcacaacgggagaaaaggttgccttccttaaaagagatcattcaaataatccctcagctttccctcttgcctctcacttctcccaggaaaagtcctgaatgctgatcgtaaaagtgccaggaatggaagggacaacccttcagcaaagggccattgttccacaattgcactgtcatctgatggatgcaagagaatagtgagaatattgcacttctcactaatgtgggcatgaagtgatgtgctactctctatcctacacaccaaactcctcacaattttctcaccacttttctctaacttcctttacagtgaggtgggcacaataacaaagaagcttgaagcacattttcacatgtctaagagccattagctaataatggttatgcttgtgagaaagatacaaagtgaatttgcctatttgtaggccaagactttgaatggcttgaaggctgttgtatctccacacctaactcagcattaattttctttaaaagcctatcagaagtatctgcgctgttgggttgttccctaactgctagagtcccgctatatctgtttaagaattgtaagagcatctggaaacagcatgcaagacccccaaggtattgaggcaaaaagctccacccactattgatttgccatctcggtttccataaaacagccagctcagccattgctaggggtctcagaatttcttagattaaggcacataaatgcccttatgaggttatctttgagtatttgaagaaagccaaagctattaacagcttctaggaatttttatcattcaaattcactacacactaatagacttaatttttaaatgcttcctgcttaatccctgatggatgggggagagggtgaaaggaataaaagcagtccagtatcttaaaagctgttcataggctcatagaaaaaaatcaatctctctctccatatgtgttatcattggccttgctagtgttgctgaagggtttgttgtgtttctgttaggaatttcaaagatttctaaattgatgttaaccacttgccttgagccaatatagaatctacaagtttgctgccagcaatgagcaggctctttaatggtcatttttaaagccacagctatgtaaccaaaccggagattcttgctgtgcgcctatcttttggtgtctttctttagttccaaattatgggttgcttcctatatgttttcaaaacagattaagcctttctttaatagcattgctccctcctgaaaactattattatcattggaaactgttatttagtaacgatatgtgttattatttcaggacagggtacagtatagcatttataagtatgggccttggagtcaactggctagagttgggatcttggtttcatcacctgtgagtctaaagaccttgaaatgtcctaagcattgaaatatttggtgcctctccccacatgtaattcaaaatacagtaacactgaaccataaaataagtgtaagaatttctaagagtttttatttttctcctctgatgatttctgtaatgctttcaaaatatattagattctttcttcccaaattctcattttgtactttctctgttttgttgttctttaagaagatgttcattcttctccctgagactgtttcctagtctagacaaccagggtaatgataatacctggttaatgtgaagattaagtgagttgaccacatgtataatgctgggacaattaagtcaatcctcaataaatgttagctgtgaggattaccaatcatttggctagcattttaaattaggacatatttttgagtacagatttcttcattttgaagatgaaataccctatcaattagacaaggtagatattttttattctccatttcaaataaaaacagagacccaaggaggtgctatgcccttcctaaggtcacatagcaagtgaaggaagacctaggacaagatttttctgtttccaattgggcagttttcactattgctcccccagagaattgggggatgttctgaaaaatgcatagctagaaatgagtatttttcttcttgtgtcatcttagatttctttctttaaagaagtgtcatatctcaaaggtcactttccaatgatcacacaaaagtggttattgtgaggtgttgagttcaaaatcctcatttaaaagttttattggcaccagtgaccccaagctgctctccttacaacaatggcaatgtgctcccatgaagcagctgaaagaatagtgagtatttaaaggagctatatccccttaccttgctgcctcaattaaaaagttgttgtgtgatatactagatcgaggtttatgttccactctgccaagacttcctaggagcggttcactttttgagccttggataccttattttctctcctctctgcttccctgtgctattaaaaggatcaatttaactattaataatttaaagtatcatgagaaaaatctggcaatgtttattttaaatcataagatcaaaattccccgtgtctgggccatcaaacaaagccatcaacctggcaaggcagtcttgacagtttctacaaaaatgtgtccttttgttttctaaagtcattctattttattattttatcaataacagtaggtttagaaatcatcaagggtttagtctcactactcacttattactaatgtttaaacagtaaagacatacagagtagctcctatagaagatttatgttaagttatctcacttggagaacatgctctcggggaattgttcctgcctacaaggtctgaatgagtcagctgtgcaccgggatgaatgggtcatctccacagtcttctcatgggcatttatggggctctactgaaacatcccaccgtgaaatatttagaacccagctgggcacagggcatgtagcactggctctttctttgtgaatcagggaagaaacagaatgaaaatagttctatagcaatcggaatcttatatcactaaattctgggaggtagaactgaaaagcaacttctttctttgaacctgaaaatagaaaagctaagaaacaggagagggaaataaaagaagaatcagcccagagctatcatccaggcactgacaaatgttccttataaagtctctgattgttgtccctatacaatgcggtggtaggaacaagggagggggggtgaaaggtgacttgagtatgaggaattaattttagccacagctctaggccccctggaaggctgagctgactgggtttgttccatatcttctctctgctgtgagtgggtggccggtgatactgtcactgctgtaagatccctgagcatggtccagtaaaggcttttcaggtcctatctaggcttcctgggacatgcagactgatacacagcttcaatctttgtatgtcagggggtgctgaggagagcagggcataccaactcagttcaagtgctcttcacagaattcctcttcttcagtctttaaaatgcacacggatgacctacatttaaatcctatttgaccacccaacttagaacgtgaaaaagaggtaaaagtagctccctttcaaggatgctacattagaaaactctctttatatttgagtttgtcaaattccacagaaacttgtctttataggggttggaagagaaaacattgctatggtacttataaaacattgctatagtacttattgatgaccaaaataccttcatatcggttattacatttgagcctcactccatcctgtgaaggacagggtttggtattattactcctgccatacccattttaaggttacgttatcaaggctctgaaaggctaaataactttcccagtgtcacacagcttaaggagcagagccaacacttttctatcctgatcctcagactgcacagcctcaaactttctgctcactttcctatttctcagagccacgattttattaataatgacagtatttctttttgtaaaaacatattctcaaatggaaatctctgcctggagtagtctagttagtaaggtttttcaacctattgacatttggggctggacacatctttgctgttggtgtgtaaggaagggggcggggtactgttttgcacattgcaggatgtttagcagcatccatgacttttaccccctggatgccactctcatgtttccacaagtgccaaataccctctggtcagcaaaatcacccccatataagagccgctgacttagagaaagtttccaacatattttgtttaaatgttcatcatgtttttgtaatttagacagtatacatcggtataagaaagattttttttttgtccacatctcttcctcaattattgagactttaaaggattaaaaacaagtctatgtacttgacatgatgctgaaatttctcaggccttgggttttcattaattcctagccaggaggtttactttccttttctttatgtcttttcctgcgaacatttgagaccttgccagatttgaagcatgcattaaaacaagccccatctacctgctcattcatccgttcaggactagcgttgctttcagttcaacagggggaaaaacagagagagcagagtcctgcagagggaataagaagtataaatacaatcaagaaggaaagccatatttgaacaaggtttcaggactacagacatataagggcaaccagagaaagcctcacttaatgaatgtgtttgaacattgtgaggaacattttaaaaccatcttataaagaaggtgctccaacattcagtcacaaaatgtatcaattaatcactcaaactagtgtatcttgaatattcacactgctaactagtcatcctttccaatttgtcagaaatgaattaggattcacatgtttgtgagtttctatttccaagggaattatttccacattatgcagtttgtcttcggttaacaaaaatgttttaaaagaatgttttcaataggcacttatatatacatatttgtgtaaagcaatggtctgcaacctggctgaaattgagaatcccctgggaagtttaataaattgccagtgctcgggcactggtctcagggcatctaatttaactgaactggggtgtggtccatggatcagcagcatcagcttcccctgggagcttgttaaaaatgcagactctcaggcaccaccccgtacctgcaaaatcagatcccccagtgctatgggtacattgtaaattgagaaacactggcccaggcatttttttgtttgttttttgttgtttttaaaaaaagctcctaaggtgattctctgtgtagctaagtttgacattcactgatatgtagaagctaaaaaatgtgtctttctttcagactgactaccggtactgttcaatgtggtagccgccaaccatatgttgctattgagcagtgtggctggtatgacggagattctgaaatttttgttttattatgtacttatgtcctaggcactgaaggctttaaatacatttctcattcagtcctcactccaacactatgaggctataggttagaggctagtattagccagtgcaggactacaatatgccatcttttatttccttttatgtgttttctaccatgtaaacgatgggcatttgccttcatgtaccttctgaactcatctaatgagttttgatattatacaatcacagggataataactccaccctatccaagcagctgttggagagtcattaaagggtgatgattaagcatgagggttttggagtcagactttctaggtgtaaccaagggcccctggccctgtcacttgccagcttgcccacaaccttgagaaggttcccgctgtcgagaagtttctctatgctttgatctccatgatcatatatatgcattttctcgcattaaaaccaagtgaatgctcagattgacattactataggacacttcacaaaaaaagaaagtactggctagaggtatgtttcctaaacacacatggcaaactaccctttcttaagctatatttgtatgctctgacagcatggctatggtgcaaatctatcaacaaacttgaccctaagaagccagttacatgacctataaaatggggattgtgttcattgttctgtcttagaaagtggaaagttctttgaataccttaaagcattgcatgaataataattgtacctgcaggtgtattgtctggattatctaccacccgtatacattttaggaccattttttatcttgactttctacaatgaagtttacttatgaaaggtgagaataggggactaagagattttccatcttgctttctcatccttcatggagaattccacaatagtagaaacggttccaaagtgagggacatgtgcactgaataaacactttctcccagaggtgtaggaagtggcagatggtgccattcaccgtctctcagccaaactcacccaggtggtgatggctgccatttgccgaacatttatgacatactccccacttcatgggcagcatcctacttagtcttgaaaccacccattaggacagcgttggtcttattcccatttttttagattaggaacagtctatgggagtgtagcttagtttgggaaatgctggtattcaacccagaaccatctgacttaagagtcttaatgtttaatcacactctgctccttccttagattctcgtaaacaccctagaacagttgcatatcctagaaattctgggtttaactcaaatcttgacaatttagaatttttctctcaagttaaattatagaattcccccctcaggttaaatctctgatttctgcccagtctagaagtcagcatttccttgggcatctatacatatttggctttatctatatcatcggtgtggcctctggaagccttgtcagcctctttctttttgcgatcttgttttaccttctagtgccatatctatgcaaaaagaaagaacttttaaatgaaggtttgttttgccatttaatagtcttgcttggggagtgacagagtggcaagaaggtgcttagtatttttttaatttaatttttgttttatcaaggaaacttcctttcttctctgtgaattcccagccacagataaacaggcttgtatcttataagttaaatacaattactgctatcaaacctagagcctttttctctctcccataaatgtctctaagaagctgataagcatttcaaggcaaactggagcttggactaatgctaaaattaaacataaccacccagaagacaaagagaccagatagaaatacataaaacatttgaggtggtgggaacacatggacacagggcacatagaaacttgcccccaaaacattaggttaatacatagctcaaggttatttataaaggaattaacatacacaaaggagctttttataattataaggatttacatcagataataacaattgtagtagccaaagatattatttatctagaattcacttgtgaacagggcatgcttttggtctacagggctgttgagcaaaagaataattttgctgcaaccctctgtaggactttataggatgcacatttacattttccccatttttagtagactatcttgggatttaaagaagaagttggaattttaaaaattagaaagcacatcatatttatttagccatatgttaaatgttataaatattatagtttagggactcagtaaaatgaataattaaaaatttgagggtcacttctaggtacaatgtaaccagggatgtaagataaagaatttcttgatttccaaccataatgcatctattttaattaaataatatctttcaagattagaaatacagtgtagtcacactttatgggatttttaaaattatacttatctgaaatagtgtgacataaataaaaatattaataacatctccctctatgtgaggcatcagtaataacatacattcttctgaattaaaacaatcatcaaatattgcataatttcaaagctggttagtgaattacaagttttgttttccctattgtcacatggaagctctagtttaagtagttaatacaaattctggcctgcagaagttgtctctaattacgaaaacttagaattattatcccagccataaaatacaattaccctgtaccgtttttcctctgccccagagctgcctgaacaccaagtgtcctaccacccatacaagagcatagttttatttatgggaaaagtttccaagttccagtctcttcaatttaaattttgcacaaggttgcagagtctctctagttatttaaagtctaaaaagaacactgagcttctttgagaaaggtggtacataaatatccaataataataatatatattcacatacagtatgtcatttatacttctataaagcagagaaggtaatgaaaggtgctctatactgtaaatcactcaatcgattgtaatcatattgcagctcatctcaaagagataaagaccttccactcctctaaaatccctgtcaatatcctagcaggctgaagagaggggaaagggggtcagaagaggaaggagggaatgagtcaaggacaaagcggcactttgagtcttcagttcatggagttaacatgaatttgattggattcccagtgatatttacagttttctccataagatgcatttcttttccacacggtacttttacagcctttcagtaagtccctgatgctctgtgttggccttgatggcatagtttactaagtgccaatggtagatatatagcacagcataagaagacttagggactaagtttataagtagcaaatgtcaattcgacagaacttaaatgctgaagtgtatatcaaacaatagaagtcgattgatcatgggctagcaaaaaatttatattgcactttcaaacagcagaaacactgtaaaaacctttttactaactgctgttgcctttaatgtaatagaagtattcccctatcctcatcaccggggtagctctgagtggagccatttctttatgcacttattcattcaccttcattcactattcaacaaacatttgttccacatctactttatatgtgaattcatactaggtgatgggtatatggtgaaaaatgaaacacagctcctgacctcaaggatcctcaagtgtagttgaagagaaatacaagtacacaaggaagacatttttattgagcagttattaattgccaggtagggtactgggttcttgtatcaagtctttgcagtagccccaaggggtagatattactgttatcatttcacaaatgagaatctggagcttctcctagggtcaagctagcacatgaatacctggaactgaagcctgtatgtcttagaaggcaaacccaaagctcccgtacgctgccctatcttgaacctacaattccacaaagtgaaagaaggtgctactattgaggtgagatccaagttcagtagcgggtacacataaatgcctaatggagcctgaagatcagacaggggcgagcatggaatacaatttgggatgtgaccttgaattatctggaacaatgccaataagctctgctcccctacctagtgtgaaagatgacatgacaacttatacctttctcattgaggaaattaatgaccatggaattctttcttttacttaaattttttttttacagttttattgagggatgattgataggcaaaaaaatcctgcgcatactttgatgagtttagacatgtgcgtacacctgtgataccttcaacacagtcaaaataaacacattcatcgtaccttattttacttagtgtcatctccccagtggttccaaggtagaagtattaatctccctcatttacagatgagtaaaccaaggttcagggaggttgagcacatttgctgtggtcactgtccaccaagggtcaactctgagattccacacagatatgtttgccctcatttgccctcacaacctaatacccaggttgcccactccacttttccaatgtcttccaagagcactccagtttgcatcatctacagagctcaaattcacatggttgacagatacaaattcacatgcaaatgtactattatttcctacatcccagtgcatgcagaacactgtaatcccattattaaacatttactagaaatgtgcttctgcctgatgcacaattgccagcctcaatgtttaattaaactagatttgttttcattttaatcacattagagaaatgtgtttttctcagagttcagtggtgaaatcttcattccaaatgcctccaagtgactgaaaactgtatatcccagaggaagggatgagggtattacaacctatccttgcataaaatattttaggggaaaaatattaattaataacaggtaagactgggatacactatttgtttttgaatcatcatagcatcctggaaaggggtcctattattattattaccattttagagatgaggaaacgaagtctgagtggttaagtaacacactccagtgttgcacagctagtaggtggcagaaccaacatttggatgtagacagggaaaccctgatatctttatttagattagggatcaccaaaccttttcccccaaaggccaaataacaagtagcataggctttagaaaccaacctatcttataaatataaatatatttagatattaacttcaatattttattaatataaatatgatatgatttgcatgatctttgttgcagttattccagtctgctgttataatgcaaaatctactatagacaatacataaatgaataggcacagctgtattctaataaaacttgctttacaaaaacaagctgtgatgaaccacgtttccccattaggtttagctgggggaaccctgatttaaatcacggatagttggaagcctacagcttttactaatccatcagctttattttttgaattgtcttatctgtttggaataaagagagcaagagtatctctaagtggatgggttaaatccctagagagacagagaatagtactaccgtgtagggtgacatagacctactggtgaggttaattcaggataaagaaataaagagatacaatatgtaagaaggacaggcactccatttacgtatagttaaaaatgacaaacaacaaaatagctaaataccatttttttaattcaacaccaaagacagacacagattccattctagagcaagatttgaagatgatggacagaaagcattgtttctttacttctgttacttctacttaataagccgtggtgatttaaatacacccctctctcctaaaaaaatagtgcttacttttcttttaaattcaagaattttgattagccaccctagcctatttctcatagcccttatgcataaaggtgccagttgatgccttgcattgatctttcttttctcctacccgcaccctgattgatatgtctgtcttctaagtcttagagagcatgcccttcattatctcagcattggttgtccctgtcttgctgctgagagcttcctgcttgagcttcagttccattttcaagccattgatctgatgttctgaggatggactagcccactttagaggtggctcagcccacttcatgctattgagttttagagattttagaatcagatcccctatttattaaagcagcaagaccaggctatcagtttttatagatgtgcatatgcctaaaaccatgtagtatttaaaataaattttgacctacatcctctattccccaccacgcctggtacccaccattttactttctctttctatgtatttccttcacttttattttttgctttttggattccaaaaagtgagattgtatagtattttttttctgtgcaaagttataagggatgaataagtctagagatctaatgtacaacataaggactatatttaataatattgtattattatatattgataatttgccaagagagtagattttaggtattcatacgacaaagaagaaagaaaggaaagggagagaaacaatcactgtatgagatgatgggcatgttactttgcttgactacagtcatttcagtgtttatatgtatatcaagattacatatataccttatatgtatatataccttaaatatatactttttttaaaagccaaactaaagcacactgggtttttatttacaaaatagggacccccttcacagtttgctgacctcaattttgactccaattaagttatcaaagttctaactaccagaatagaaagcatatactgccagatttggccctatagtgcaagaaaagtggtcacagttttcttaatcctcttttaaaaaggaaagaaacaaacatagtaggtaatcagtaaatattaaactgtacaactgaggtttttggagctttctgacttcaatgactgcatatacacaacaaaaatataagttgttatacagcatccttgacaagcattaactataaatacttttataacaaaagaaaaatatcatttactacaaaacttttaagcttttgctttagaaatgtttctttattgaaacaaatatgattttattgaaatattttttatattagtacgatgactctttattggtctcaaagggtggattgccaagtataattaaacaaaatgataaataggaggaagatttcagtatccttgacagaaaaatacatataaatctaatatagatatatatgtaaaaagtaaatctaaaatcttagccaaggtttagaaatcttattacttcatttttatacctttataaaactgttgcgaggtgctgtttcaaataaaataaaaatttatgtaagtaaaatacaagctaaaatagaactgaaatgtctttaggtttacaaaatgaatagctggattagtttactgaatttttttctgtggtatgggtggcactggatctctagaatcggtaaaaataaaggcaatatattgttctcagggagcaattgagctctcctagaggaggcaaaccaagtgaaatctaatagttttgcttcattctgtgactttcccccgctatgacctcagaattttgagctacaagtaggtctataaagggaattttggaatactcttaatagatctgttcttgaaataagtcagctaaactgagtgaggtgctttgccaacacattaactgaaagtcctgaccaaccctgatcccagaccttcatggacaattctcttgttttatttccatttccagtagttgtatgtaattcttctaagagacttgttccaagccaaccttcctagtggtcttgttgaaatgagatagtggttgtaggtatcattgatgaacacataggccaaaacattattgaactattcagaaagtaaatctagcttattctgtggctgcataattatataactgtagctttctgtcaggttacagtggctttaattttctgatcaaataaaacaatcaatataattgtactttgttcctccctcttctggcttcgattctttgatttgtgccactcaccactctcattcttccaacctccccctactccactggcccctgcagctacttagaatagctagctgttgattaaagggaccaagagtttgagcagttactgtatactttcaaaccccactgccatttggaagtgaagtcccaactgacatagccaaactgtaaggacaaaagcaactctaatacctgctttcctttgtttatagcaactgctcaaattctcctctaaaagtattcattaagcatccttctctataaatctctgtggtagaaactgaataataggacttgaaccattattcaatcagaccaagtttaaacccaggttaaggaaagaggaagtctacacgtctttgctgctcactgtgtttagtatatatcctctataattcacaatcaaaagtaaatctttggacagcattcttgtttgggttagaagaaaaatttcaatccttgttcagaagtctaagcacttgtgaggattccaatatgatttttaaaggccaccatccctgatagtcagaaataaaaacattaaaccaagaagactgcaggctttcttctcacctgtccatctcttgtcctaattacaccttatacttactaatgttgtaagtgctttttgacaagacagcaatggtacatcaatagatactgcatgaacttgagtaggcaaatcaagtcactcagaggccttcttttaatctcttggatcattattgcaaagataaaagcaggtttctgaaggagtgaaattcaaaggaacctagtaattagaatggtgaaaataccaggtcacccggtccgtttccctgcttggttcagatatttctaacaatatgtactagtttaattttattcatctaatttaaaatgagagactttatctttcttccaccaagataatatatctgatttctcctctttggcttaaattttttttttcattcacatcttttattattagggttgtcagttgaaattattttgaataatttctttaaatcatggatttttttcttacatctcatatctaggagctatttcttgttgcaaggtgcaaggttctatggcacatacaaaagcatgctttcatttgggatatttataaaatctctctatacacacacacccatcaatgggcaaatataaaaagtattgcctttgtgctagcatgtagttaatattcaatgaatatctttacacgtaaaatcacctataatctttagacatgttcctcagatagccaagatttaatattacatataaagtcatatgaaatagcttaaagaaggaagaggcattgttattttatgtatatgtctcaaatgttataaaggttataagaacctttctgaacatcgaaaacttcaaagctaatagtttaatagtttgttggatacctgccatcttttgaggtggccaatagttgtcaactttttgagtatccttgagcactgaaggtatgtcaatgtttggtttcattgtgtgttaaggagggaattatagaagtagaatggagtaaaaagcttaaaaaagaaaaagcactgcttctaaggtgattctaatttcataggaaaaaaatactttaaggactaatattcaatacagagtagcggaatctgggtgccagataaatatttaacatttgtggataattttacataatcattggccactttcttaaaagtgttttttaaagccctaattttaaaaaatgctattctggccatcacatttacaatgtgaataatatttgagtcatgacgtaactataagttacttctaatgattgactgtcacttgagttgtaaatcacagcatttagcagtgctagttgtccttacttttggtaaccccttagtccctggatcttgatcattttggggtctttactctagagtctatctttgctctagagtctagctgccattcacatgctaaagaaatgccccttaaatagtacctataacatcctaaggaaatgatttctaaactcttctcaatgagtttaaaaaggctgctttttgctaatccataaactttaacaggggctgaagaggcagtgcctgctttttaaaaaccaatgttgcaggctgggcgcagtggctcacacctacagatgcatgcctatagtcgcagctatttgggcggctgaggcaggggaaggcgggaaaattgcttgagcccaggaggtgaaggttgcagggagctaagatcctgccattgtactccagcctgggcgatgagagtgaaaccctgtctcaaaacaaaacagaacaacagaaaaaaaggtaaaaccaaggttgcaaggtaggactgtttgtgtgtgtgtgtgtgtatgtgtgtgtgtgtgtctagttttgatctttaatgagagttttggtttgtttctattgttgtgtgttagtagggaatgtggtggaggagtgcctttctagtctaagtatacgtaagtgtattcatgaccagtattcaaagggtattcataccctgcagggacataaatggttttgttttggaatgttagggttaagaatgaaagtgatggccctgtttgctcagaaaaaaaagaaggtaatccttcagtgctctctgtgaaatcatgtatggaatgaaaaaattcattgatggggtgagaggtctcagtgccagcaagtcttactagtaaattcagaattcagcctgctgttcctagagatcttcctctccactcctcatccaaagagtgatagaaggaggtcagataagtaggtccttgtccctttagggagctacttaactctactcattatcgtcttggagtcaatccccacctcattccctgctcttcccctagtctgtgtctagaatcaaggatcagagaagcatcaacacatgcatcaacctttctccaattttccttccctttcccaactccctcagccttaccctctcctctcaggaactgcattattgcatctcttcttttggatttggtaattctttccttagaaagaggaacagggctaaggataggcaacaggggcccagctgtccatgtctccatccttggacccctaagacttttgccacacaaactcctttgaatctggagactgcaacggagctgcttccctcctcctgctgagccttcatggaaatcctcataggagatagtgtttcctttacccactctcggacccctgttcttcctggatctcctgaattcctggctatatcatttaggttcgctgcattgcaaaccactccaaaatttccgtggctcatgtgagtgtttttttctcttctgggttggcttggatggagctagatgatcttgatggcctcatgtacccctctggggtctcagttcagatagccgagtaggttcacatggctgggtttcttttctcatggaagttcacatggcaatctcaggtgtaggcagcaggcaagggcaagcattcatacacagatggctcttcaagcttctgcttatatcacatttgctagtgcccatatgcccaagcaagtctcacggcccacccagaaccccaagggtgaaaagatagattcaaactgttatgagaggagtaagagtctcactgccaagagacagattttgaaatgggattgtagctattttttttttttttccaatttaacacactggaaaagaagaaaggctctggttctactaatcatatttccctcgtaaattttctccttccaaccctgattcaggtctcaagctgtggttggaaatcagtgactttcactaagggattgtcctttcttttctttaggacatggctttttgaaattaatcttgattctttctgccatatcccaagccttacatttttttcctttttttctctatgtctgatcattttgctttaagtcaaattgattttttaaaaattaaatgcccattaagaaaattatccacattcatgttcccttggatgctttcaaatattttattttcctttgcttttggcagttacaatctatcagtgttatttgtaaaatgtcttatatttgtatagggtatgttctccctttcctcttttcttcttttctttttaaactaagatagatgtgttataaaacagcccccatgctgatccatacttttctctagacatttctgtgagctcagtactttgttgtttatcattatcctttgtttgtagccagatttgaggccatgttgcagttctcacaaacaaatcaatttgaattaatttgccaagtagaattaacgaggcattgtatgaattcaagacatactacaactacggcatcccctgaggttatttcttctctgggaaaattttgattcttgtaccacattttaatagtgtatatctgacctttgaatcttgcactaaatgatacatggctgccagctggtttaatttttgagaagccttaaaaattctatgcagccaaacaaataggagtgtagacaattctttaattattaactttacggggagaaagttgtcttcaagatcgatactctctgatgcttgcttgttgctaggagttctttttctaatgatgttctaagcagaagtttgagaaacatcaaaatagagaatatatatttcttagatggtctttgaggtctccacaacctaaaaatgatgggctccttctctcaaattataagctataaatcccagcaaactctactcccagaaactgtttttatttaattataaaatgggaaagcatttactctaaagagggaccatggtgattacctgaaattccttcactccctaaatggacatctacatctgtcactaatatattatttagcaaaagaatttccttcagactatgatgaccaatgcaaacaaaataaataagaaaatccagtcccctcccacccctcacacggtgaggaaatggtaatagagttcttcaaagaaactctaatttctgggtcttagatgaataacattagaagtgcttaaggaacttgaattctaagcccctttaatgttcgctcagaaataattaacaggagccagtcagaatagaaaactagtctgggaaaagtgtcctaaattttacactgtataataggatggatctcttaaactcgggactgatatataaaacttctccagtgtttcatttgaccaaaaattggcacacatttagctagatttaaaaaagaatatggtgatggctgagaactaacctgggctcattaaaaaacaaacaaacaaaaactcacgcatgctagtgtaactttctcttggatagcaatagcaaattggcaggtgaggaggatattataaataccatgcacagtgtatcttcatttccctaaagcagtatactgtaatgtacagagaactatgaagggatcttaaagagacctgcctgtgttccatcatttgaagctttctggttacactgtaaagtttgaggtaaactaaaataataaaagtaaaatttattatctcacagtttctataggtcagaatttgatagcagcttagttgagtgattctggcttaaggtgtctgatgagttgcagttggtatgaactacggctgcagtcatctcagtgctatctagacctgggagatctgattacctggaaatctttcactcacatggatgttgactggaagcatcagttactctctggctcagttccttgccttatgtatgtttccatagaacttcttaagtgtcttcatgacatgagtctagcttgctcgaaatgagtggtccgagagagagcaccttttatgactcagtctctaagtccacacactgttccttctaccgtgttttactctgtagaatcaagtcactaagtccagcccacaatcaaggttgaagaatcaaacctcacctcttacacagaggagtttcaaagtatttttagatattttatagctccatcataatcttcctattcagggactagaatgaatgcacaaaaaatatgcttattaaatttgcagataacacaaagctaagagaggtatctcctaccagaaacaaaaaatcctagagttaaacattttcttaccatgtttggatgctgttatgaaacaaaaagaatacatttaatgagatataaatacctgttggacgttcataaagtatgttgtatgaatgcaacgtggaacaatttctttgggaagccattcaactagaaactggcttgagttttagttagaaacaagcctaatatgcggtcctgttatgatgtggttgttgaagcaacggttgcaaatcagtatactagtcaggcctcctgtgggtggtgactagaacagtgattgttacttttagatattttgggaataataaattcattcttaggcaagggggttcaaggatggtctaaaatgtctacaattttataaacactggcaattctataggatgtatacagaaggattactatgtcataagtttcttgagcatcggagatattaataatagcatgactttcctgttgtcgggatgacaatgttcctgtgttgtgcagcggaattgtcctcccaaacctcctccctgtcctctgagctgtgtggggacaccacatatgtatgtttaaatgaacagaattttaaaaaatcaaatattctggcattctggcttcaaaaaccttgcgtttgatgttctctacttagaaataaataaccaaacatgagaggaatgagaggagatggggatggggagtgggaggaagagggtagatagaaataaaaggaagaacaacattacagagaagcagagatgacacagagggtggacacgtgggaaggcctggatcacaggggaaagagtgagccccaaaataacactgtggcttttgcagcaaggaggaaataagtgataagaggaaaggcacctggggaaatcttgaagggatcatatgtcaaacggctgaagagcaaacattaaagctttattttgaaaaggatatttgaaaatatttgacaccaaaaattctgtagggaagtaattcttgtggagtttgccttctttttagtttaactcttctgaatcaggtacttgttataacaaatcatatattgagggattattttgtgccacagatttgcaacatgctttatatacatttccttttaattctcaccgcaatcccatgttgcaattattattacgatccccttttaaatatgaagaaactaaaacttaaaatgcactaagacatggctaaaactaagcatggttaccagaaaggaacaagacaaaattcagacattgaaatcaactactgtagcttcagtgcatatttcagaataattgtggaaggaaaaaaaaagtgacatttgaggaaagaaagcaaattttacagtcagtttatgttttgttaatttataacatggcctttttgagaggggctcttaaataaagaattggtgccaggttaacctggcatactgaagaaagtttcatttgaagttgcttgaaaatattctcttaaattataggaatgaataaagaggttgcagtcgcctgggcctagttttattaacctaactgggattgaaagtatccttgatagaggaggagaaatgagcttcaggaagtgagttacaaatggcctcaaagtactgagaaaggataatgattggtaaaatatgttgtaattattgcatcaaagtaaatcattttagtacataatacctcagcagaaatggatttttgatttgtttaggatatgaaagagaagtctaatattaacatgtatgcacaaaacatgtatgttcaaccagcaacagacagcaaggaataggggcatgaacattcggatagctggacgtaatacaccagggttacatctccggcatggttccattcccattccatagcctataagatatttggacatgataggccaggtgtggtggctcttgcctgtaatcccagcactttgggaggtcgaggcgggtggatcacgaggtcaggagttggagaccagcctggccaacacagtgaaaccccatctctcctaaaaattagctgggcatgatggtgcatgcccatagtcccagctactcgggaggctgaggctgcagtgagccaagatcacaccactgcactccagcctgcctgtctcagagaagaaaaaaaaaaagatagttggacatgataactacatgtctacaggctcatcagagagagagcacaggcagaggctagagctcaatgcaaatatcgagactgaaaaaggttttggaaggctctcaaggcaaggatttaccctgactcccatccccctgctgttcaaggctccttactgggagaaagaactttcttttctaagccttaggtgagtgttagggaaggatcctaagaattaaaacaaatcacaggctctctcaactcccaacctcttttgattccccacaagctaagcccttgcctgagttattgcatttaatttggataaaaccatgcaatatagatattaccttttttaaaaaaacaaaaaacagatgaagacaccaagagtcatctagattaaataaattgcccaagttcacagaactgataaatgtctggacttgattcaaagtttgtctgactccatatccaatattcttttcactcatgtttgggccatctttgcttaaacagatcaactagcacagcctagagttggtaaacccatactacaactttaatttaggaaggaaatgatactgtctgctcgtatatatttgccattatcagaacatatccagaagacatgtagaggtgagctttatcagccaacttggtgtacgacagggtgatttgcacttctttccagggtctccctggctcaaggagccacttaaaaagctcccttacttaataatgcccttgtgctctgggtctattaatttacttcccacaagctgatcaattttctgttccaagacattaatttctttaccttggcacattaaaggatcaaagctcacaacatataaatagttctttttccttctgccccaaaggtgtgtagtgaggattaatgagatgatgcttataattgcattttgagctccttggtcgaaaggcactttataaatacaagatattagttttttgctgagatccatctatcacttacaagtggccaaacattctagatggcctttgggtgtgcaacacctccctctctgactctgagttggtctgggacaatgccagaaatgtggctcaagccaagttcagagtttctggagttcccttcctttagtgtcatatactttctctgaaacttaacttagaaagtgttctttgggggaagagacatggcaataacctctaaactgccctagtacttgagggcagcagtaccactacattgattttcttttgcctctgactttaatacatagcatttattctttgactgttcattagacccacagtctgattttttagtgtcaacaaagcaataaagaaaatttgttcctcctttatttcagggctcaagacaaaattcaaaaatgcctttggcattcattttgcacagacgaatgttgttaggatattcctattagcatgtccacgtgcttgacaacatttcaggtggtattaatagtctacctgcaagaaagtgctttctgccagcctggtgcaaattggcagaacctttaagccactctttctcagcttagcagcagtatatcatcattacctgtggctggaccaagaaatcacatttgtcaatgcctgaattgctcttttactttcagtggttttagaaatccactttgttttggaaatgggcttagctgagtatgttagaagatacagaaacatataaagtgatagataagggatttaagggaatattaaggatgttacattttctatggtcagttgatctttggaagatgacttttgtgggaccaaatagaatatggtcatcttttgaatgaaggactggtaagtgggaccaaatagaatatggtcatcttttgaatgaaggactgataaggtagtgagacaagggaagcataccgtggaactaatgagcttccttctgatcactagaaaagagtcgagtcatattaataatgatagtttaaatatgctgtactccctattattctatactaagtcctatggtaaattgagaaatggggaaactgaggccaagtgacttgcccacgatcacacagctaataagtgataaagttagaactcaggaccagatttgtctccagagcccatggtcttaactcctatgctgtattgattatggctttaagagtattagtataccttctaattaaataggacccatgtttggaccaataaagtgtaagcgcagtgttgtaaaagttattttccatgttatacaagagttctatttttcagttttttcacttgaaataattgtattccttggagactgttaataaatttcgagtctcaccttaaagaggaattgatgtatattgaggcctactcaagggtcagtttgctttccgtttctttcccttttacttttatcctaagtggattcacccaaagtggaaaatgtgaggttggagtgtaaaggttggaactatgaaccagttgggcttcaatactttcacctcaaagtattctgttcttcacaatattataattccacagtgcatgtgcttgttgcacacgtctccaggagttgaaatacttgatattagagccagtggtccaaatgaaaatgaccagaagaggccaaatgtataatgttctcaatcccttatcaaaaatagatgggaataaacacacatatatttaagtacaataaaatgtgactaatatgtttttttctaaaacccagtcccatataggtgtcggatccacagaagtaatttaagaatggtttatttgaagatctctttgtataatttatagatttctcagtgtgattaagaaatgaagttattacatttttttctctaattagtaatgcacgtatgcctccttttaatgatattatgatgtttactactcatagggccattctttcttgagtatagccatcactttctgttgaagaattgatttcactctttgtttaaatgtacatacttgttgctatatgaaatatatgactgaatatcattaaagatttagcaagaatgtaggtgaatttggtgaggtttgttcagcttttagagtagccctgtataagaatacttatatttagaaggttgtttgcgcttcagtcaaactagcaaatgaggcatggggcaaataactcattctcatgcacatgtttctaaaacagttcttactaatgtttgagataaattaaaataaacaccaacaagaacatgaaaagagactaagaacaatgttaatgcggcaacttaaacaaatttggttttccaaatgaccttccatctttcacaacttttaacagcatgcaagattgctatccttagtgccagatactatcaatctggtgtggaaaacttaaaacttttttctaaatgtctttaaagctgaggtggagaagaatgactctctgtcactttcagaagggtctaaggttgaatcatgaccatgctgtccttccccatgtcacttactgtttatctaacatagttatctctttttctagcctgtatcatgcccccagattattttctatggtgctttacgtttgaaagagagtagatgatgagggtggggatgcttaggagggacaagggccctgtgtatttggaggaagtaaattaatacagcttcttaattaatttggtgtatattaaattctagaaatttggaattttagttacttctgattttgccctgcattttgctaagaatatttagctttatacttgctatcgactacaccaatctattccgtagtgagtagaatgaaggtcattaatatatttaatgtgtagccaacaatggcagatacagaaaacccaaagtaatagaatacattcaaggcagatctggcgcaagccaattaccttttctcagtatagtattctgttgtgtctaaaaccctagaggatgaatgacatcctttatgatatctgtcacctgtagggtaggattatgagttatagatgtatattcgtttcaaaaaggtacacgttctttttctatgaaaacgtctaaaaagtttactcaactttattttgaatgaatagaatgttgtaccaagatctaccaaggtagaccattataatgatctctaatcgatagctatattctttcgccatgggctattgaaacaccaagaaattaacttgcctgtctctttttcctctttgcctgccctctccatttttttctatgagaaatgattccttgaggaaaattttaaattatccactgcagttcgaaactgttaattgttcctattgcattttatttttcaatacattaatatgttataccctgtaccaaccagatacagtcccaaaacataggctagaagcagattcatagttgcctcttttatgagttcttattttaaaaattcctggtagtaaagatatgagtcagcttgttagaataatttgtctgtatgagaagtgaatggggaaccttgtgaacatcctccaatattgctacccgtttcctatcctatacccccaccctcacaacacagaaggtaggtaccagtttattcccaggtggaatctcctcagccaataatgactcctatatggagatggccctgcaattgaaatgctttagcatgcccctattcatttggtctgatgctatatgcaattctaatattctttatggcttttagaattctttgtaaattgtttccaagccacctggtttgagatttttctttcatttttaatattggtagtttggaatggagttccccaagttgcaatataggcctatgaatcaaaagtaatgaattacaattcactaatttctgccagatcaatgtgaggttggttgatgagatagaacagttcccaaggcatggcttcatcattttgttatttgaagcatattcattaagggtgtatctccacagcaccactctccaagtctgtcctaattatggaaaccattcagcagtgttaataacagttacgaaggaagagggggggcatactggcagttaaaaccactatgtttgagccttgaaactaattagatatttcatgcttggaagaagtattcctaacaggctttatgaatggatgcttgttcagaaaggtcctcttacagtaaggtaagagaaagagaaagcaggagggagagaggaaaggagggaagtggagggaggctaaatatacaaaatcagtgtctattataaaatatcggtgctcaaaagtctacaaatgttgtaccactatattataattacctctatttcctttgacatttgagtttccttatttttaaaaatgtggaacaaatctggaaagatagtgatataaaagcttatctgtactgatctacctctttgacaaagataatgagatgcaaggacatcctttatgtaataagaagtctcccttggccatcaaggcttaaattgtcctctcctcctttcccctgtcggaacataaagctgttgcaaacacttgagaggagaagaaaagaaggacatggccctatgtttctgatgggaatacggtagattaatagtgcagcttgcgtgactgtggagcgagggtcccgtctcacatgtgaaactgatctggcaggtgaattagtcatgggtcaaggagatccttgtgtctcaactggcccaattaaggtgtggttgagatgagacagagagagagtgaaggtaaatccatttccgtaaacggccagacctcttaaggattcccattccatgccacttttccaaaacatgatggagtactgcatggctaagactaacctgacctttaaacctatcgaccaagggcagagtgacttcaactccacctctactaaagataaattgatatctatctctaaaaacttcataaaacaaaccaaaaaacctaggatgttttttaatgacttattgacttttcagattgttctttaagctgttttttaaactttaaaggcaacactgataatgaacgcttccaaatggtaaaacagaaaatccccttcaaatataatcggcctgtagaggagtggctgcaggaaaaaggtaaccgtcattaaaactttcattttaaaatcatttgatcctaaaccctcatttttaaagcctgcaaataaatgttccttaaatgataatcgcctgctgcataaatgactgttttaattttcattataatttgtgtcagcttccacctgccatatgttgataaatcatgctataatacattgccattaaaatacagttaaagggactaacttctagcctgctatcagcatgacaaacacaaacaagaaattccaggaacttctaaaacagaaatgtattatggcaatttaaccactgcatgacattatttattaatttgttttaaattaccttttacaccaaagctttctaaagaaattccaaaagggctttttaaacttacacctggaggctgttttggcttgtagcatgcttaacaaaacaaaaaacaaacaaaaaaacaaacaaacaaaaaaccatagattgactcttgtaacttaaactacttaaatattgtaaggggagcatttttttttaacatttgttcttaaagaaaaaaatgaaaaagatgaattttgcctttaaaacctacagaggcaaaattattttctaagagattaaggttgtgtcctagttgctgactgaaactaaaaacaaaaacaaacttattttacacttcggttgtgtgcatacacttgtgtatttgatgttttatgcaacaaaagtgtaagaagttaacataatgagttggaaaagaaaaggttcatgaaaggcaaaacagcagtctctgatttgctggagacaacaaccactgttaataaaagagggcagcggttataactgatgttagaattttcctgtatagcttctagctgttagaaaataaaccattgtttttcaatgaaaaacagtctctaagaagatacgtattctttgttgttgttgttgttgagccagtgtaagctactcttgtctcaacacctaaagggagctcttaacatttgtagagatttcattgagttatatagaagaagtaaccaggtatattacttagtatacaacttaaagagcaaaggactactacagttttaagttggaggaagacattcagacctttaaacgtggaaaatcctcacggagtgttaactgtttgccctgtttttaatgtatgtggtctaattaaaaataagaataactctaaaaagcaaataattttgtttagtaatcatcagctcataaagtccctttaacattaaagacaatgattgcctcactttaaacaggaaaagcaaactagatgcatgtctgagtctcatgtgcctgagaaacctttttgtttctttcaattttatgttaataatttttattttactccattgccttttaagtctaagtttaatagcatgccaggcattttcatttgtataaaccattataaagttattagtaggcttttagtttttcttacaatagaattgttacccgttggctttcacataaaaggtgctttcaaatatacaagttgaggggttgggatggggggaggggtggctgaggtgggactggggaagatatcctagtttcttaaatatatgtatgattatatatgcatataaatctgaaaagaattatttgcaaaccgtgagtttctcttctacattttgttctctgaaaaaaaatttttgttgtaatttgggtgagtaacatctatgcattctattgtcttacctcttcctctgcctagctaaccttcccttcaaaaggaataaaatataccaaagacttgtaaagacaatgaatataaaggataaagatagatggatgattagacagatgcatttggaagtatttggaatgcctctttggagttatttctgtcactggggtggagagctgggtcatagcattcccaagtctcttttctggctctgtctactattgactaactttctgaccttagacaatccacttaacctctctatatctcagatttcccatctgaggacgggcaaaataatactgcctattccccaagggtgttctgaggtttaattaattagtctttgtgcaacactgactggagacatgcaaagatttaatttaagcagtatgtgaacttgatgtccaaatgaggtaataattaatgacttccaagaggatgggtatctaaaacaaaaagtaacctgctacaattcctctaccagtgtttgttataaccaaattttgcattaagaaagataaaatagttctcagattaggatatatatgcataaatatgcacatatatatatatgtttttatgtacatataatggtcagttattataaaaatctgatcataagccatgagtgaaaataatgagaataatgagatctggcattgatttggggaaatcttgggcaaatgataaaaagaaactggtcagttcttcacattcttcatagggaatgaatagtgatggttttttctgttattcactaacccctgtttatctgagagataaattaatcagagtaagggatggcaggacacgaagagtgctctactgttcctttactgattgctagctttgccattaaccacctaatccaaggtacagggagctaggagagggttttactacagcagaagagcagatctagccagaaacagaccatgaaacaaacaagcaaacagaaaagcaaacactccctatggcaagatgaaaaactgaaacatagacaaccccctttactgtctcactccatcagtgtcttattctcaagaattgattagtcagatctctctgggaaagtagctgtagtcaggagtagaggggtagtttaaatcttgtagcccaggaaacctgccttgcctttcctgatgcttgggtcagtcttgaacaggcaaagagcactttgtggagtgaatgatggcaactggaatgaaggagactcatcatctctagccagtgtaattcagctttgcattttcagttttctctgatcctctttttatttgtaagcactggcataataacaccactggagagataagatgagaactattatagaggttatcattgtgaagtattttcaaggatattagaatgtaagattttctacctgtaatcaagtataactgttaacttatcaccagtgctgaactatacacaaaataaagagatggataaatattatgattcgccagcagttgtgtgcatggaaagtatctcttggcattaggctgtctaatgtaagatactgaattttttcctagaaatctcctgctaggcagctgcttctaatttctaattcattatgttaagctgcttcaaatgcctctgtggggttgagggagaatttattttccccttccatcatttcatgtcttttgtagtaagctcagggcttccagaaaaaaaaaaaaaaaaaactgtcatcaacaataaacagtaaagaggtatgaactccagcatattacttagtattattatgcattgaactttctgctgtgtcttgtgtgaagaggacagaggacaaaatacagacagtgatgcatatgcacaacacactaaatgaattgctgagaaaatgatgaaaatctatgagatctgttttgattgcatccttgggatctgggtaattctgtagtcattaaggccagcagatcccatattcaggttctggagatttttataaagtatagatcattttcactataacaaagttctctggccaattcaccatactgcagtgttgaaagcttccaaagggctattatttgtaaatcattcttgattaatgggcactatgagttgcctagtgtgcagaattaactcttgtctaaggagtatcctctgatcggatgagcattctcttctctgccacttccatttctttcattgttatacattgagaaggtatttcacattatacaccaggaattcaaggacagatcaacattgtgtagccttgaagaccatgtaatagtggtagatttttaaagcccaaacgtgacaatatccctctattcatattggaaattataaagcaaaaagctttataattttgttaaaaaccctctttttattaagtagtcataaataacaaaattgtttctagttatttctagctaaggtaattcaggtgattagattaagaatgagtggagcgttgtttgatcactaagtagagaaaacttcagaaggcgtatatttaattccattaataagtctttcttttttcctttcttcatatggaaaagcaaaatgaagtaatctggagacataacagtaaagaaggccttagcatattgctgttctgataaattgcaataaattttaaaaagctcttactttgagtttgcttgggaaaaaaatctcatacttgagagttttataagtagaaagagttgggaggaattttagttgggtttcattcttctaaactctatactggtatgttttttcattttgatacttttcagagcagtataaatggtgtcaaagtgggaactcgaaataaagtgaactattgatattcttcaactcattaacacacctctatgtcattttaaggagttttatatgttgctttcttcattaatatccatccattttaaaaaatttattaaatctgaaggacaacttccccaggactggagcattaccaatatgcttatatttcatactgagggaataatttagttgtgggaccataatccatcctcctaaaaacaaattaatagagataggaatttatctctcatgattttgttaaccagaaaatagaatattatgcccaatgaagatttataggaaatgatacgtttggtgactagaaatgatacgtttggtgactagtagttcatttttacaagtatgcaatgaatccaagtctcttaactgaaatttaatttcagctaatttaattatcagacctggtttttaaatttagttttctgagtcacctcactgagtttttttggccatatttaattcttttcattctcattattttacttcgtagctttaaacattaatgcagtaggtatccgtaatttattctggtcatcacctgatttgagtgtttctttctgtcatcctcaattatatacccaagaagaccataatacttcttatcattgaaccaagatttcttcttcctcactatgaaggaatagagacttgattgttcaagttatcaaagattttcagctagacagtggaagagataaccataatgaaatgttacttgctaacgtcagtactgaggttttgttgtctattttttcctccccttcaattgctcaaggaagcctgttatgatgcctggtccattcagaccaggtaaggcaaacaaggaaaacgtatgagaataataatgtttcctccacccaacccactaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcaggtaggcctttttccaagtattaattgcgtctgtatttttatctttgcaacattgttatcatggtcattgctttatgtagctaaagagtttgaattactatgtaagaaggatgctggcagatactcatagtaatgagacccaggagaagagaaaggtgaagtcattgctaaagaagtcataaaagtctgtggcactcctgggttgttattcttattgtatttatcactgaaatggtaaagctgttattcaaaacgagcaatggactacactttcagtatgaaatactctctcctttaattttattaccttttcaaataacagaaagggcaagggagggaaggaaaatctgttatcatatgaaaagctatatcctagttcaatttcattcacattctccagatggctttgctataacatgaatctttcattattgaggtcaatgggtaccattaaatcaagggcagttaaagttagaagtgcaactactccttgtaaaatgcagtctttatgtttgttatcaaatcctgattaatcatgtgtcaggtttgtgcccattttgttttctttatatttgatcaagatactaattacagtagaaaatttgaaggtttgagtttggctataccggaagtccttgtttttgtggcagtttttttccacttgaaagtaattatatccaaactaagcttaatactttgctgactcccttggcatttcataaatctagttagtagggggtaggaggttaactgaattattagccttaaatgctctggcataccatgagacattccaattgctgctgcgacaacaattacttacccctatcctagttagtgtttatagaaaaatcagtagattagcacttgtcctgtttgcttctttgttttaagacattatccaggagctcagttgtgtctttaacatcacctttacactgactccaatggacgtggttaacttaaagtcaataatcaattataccacctatgtgttcccatttttcagaattaaatgtatgtgagctaggtaatggtaagtgtattatctgttgccttcctttttccttttccttgagcagaagtatccagacagctctttgcatggctccacagtaacaatttggagttatatatgctgacagtgtcataagggcaattttatcgttttcaaaaggcttctaaaaacctggttagcatagtactgttaccgtcacacatgctattacctgcatacctacacacatgctcacgagaaaaaaaatagctcttctctactgatattaaaccaataactcctgacaccttgctctactcactgaaaagaagataaaaggcaatatatatttctattatgactctctctagctcaagagcagatctgtttattgttggtgaaaggatagttctgtctgcacaggtcttggcagacttgttttgtttctgtcagaatgtattctgctaactctgtgggaagcagagaagcaaatggctttttcttcataggaatggctggtcctgtagttctttttaaggccaaattttcactgaccttgagatgatttaatgttacacggggattcgggaaccaagctgtagtaattattggttttttggctttccctcctgtagcacatacataaatgggaataaactgggtgagttcctgaactctttccgcaaattaagaaagtcagaactttggaagaaaagtagggtacaagatacaaaatcttgctagtgattataactctaaacgttatagaacctatggccattttagaggagatgaacaactgggaatgccttctccaatagcctctctctggcatgtgtttctttaagtccagtaattatcgaactacatctacatgcttttccttttacttccaccaagtctacaaaaatgagttataaacctgttgagactctttggttttaagggtaagtacatcctcttggaggaaagccaatagcctacaagaattgattagactgcgatgagggattttaaaagccctggattttttggaagactaactagaggaaataactttctgccaagggttttggaaatcttttttgttcttgaccactagtcatcagaactctgccctgtgctccattaaaaacttaaaagcctcatcttcaagcctagtctggtcttaaacacattctgttgatcacatcaaacctatgttaggactggggacccaacaactattggattctattcaaagtttaggacaattcccagactctagagactgcaggtaaggaaggtcagtcccagaagcattaatatgcctatgtgaccccactacttttcttagatgaggaggattcataaagttctgatctctgggagatacttcagaagtgagtggggaaaaaaaggtagggaagactggatttcatattcaccgggcccattattcacttttttatctatatgtgaaatcatacatagaacattttccaaatgataccactgttctgtcctcttttgctaaatttaataacattgtcaaagcaaagttttcctaaaatgagactcctctaggagaaagaaaataagcatgtcagtccaccagtataaaaacctgtctgttcaaaaatcctctagttctttcttaaagcataagcaaagaaaacatcctttcaagagttctttcctggtcaacctgaggtagtgttgatttcagatcaaaggaaaactgtaaggtgctttcagtgctgcttttaaccgtgtgtgaatgtgaacaagtagtttttgagttggtatgtctgtctagtgttatagcctcttagaagtaattggtgctttgatctttctgattccattttgttacaggtaagagtgtagaactatctgtgaataacctggctgatgttaatttactcatagcaatcatgcccaagcatcaggtcttgatcctacattgagaaggatagctctaggtactctattgaattttaaaaaatttaagatgtgcattgagaaagcaggtgtgtgagtgataattctcaagtaaaggcctggcacttcataggtgctcagtaaatatttactgaatacatctgaaaacaagacaggctttattacctactttagagtcatttcacaatggaaggtagcatagcttgaggaaagtgtttcctccacagtgatcagggtgctttggccaaatttgttgtatttttcagtagtaaggctatagcatagtgattcagtgcatgcacttggagctagattagctgggtttaaaactttgttcatcctcatattagcttacatgaccccagacaagtcatgtaagttctagttaactatttatatgaaacaaattttcccataacttggtggtttaaaacaattatgtcattagatttcaaaattctgtgagacagaaatttgggcacagttcagcaaggcaattcttctgtgccatctagagagatgattgtgttcactcagtggctgactttgcctggagggtctggctttatttacataccttgtgctttgctgggttaactgggaagatgggactcagcagggcccttttccctctctatgtattctctgggattctccttgtggtttctccagcaaagcagatgggctgtgtttatagaggctcagggcttccagagagagtacttccaggggcaggaagtagagggtgccagttttatatagcctgggctgggtaactggcagtgtcacttgtacaatatgctattagtctaaacagtcacagagctttcccagtttcagaggaggagacataaatatcacttctcaataggaggaggagtagcaataatttgcaaccaacctaagtctaccacattactaaggctaccatattataaagtagggagggtggtgtacttctagtggctatgttatatgattgtcataaggataactgagttgatataagtaaaatgcttaaaataagtgtaccattcaaagtaagactgcatgcgttttaaccattattattatattctgtttcccacaattggtgtattaaatcaagatcctctcaggcaaatatctgcctcagaaaatggggctgtgactaccgacagtagtggctatagtttagagtaagggctaggaagtttgggggaaatagagatttgaaggtggatccaagcagaatttaggggctgaaattagtcctggcaaatcaaaatttctatgatctcaggaacagacttctctgacacctcactacccatctttaaagttctgttttattttaaaccaacttagagttctatgagtctttgaaaatatgttctgtctatccacatgtcttttagggttgcaaagaagacaaatccagattccttaccatcgtggaatttacaatctaaatagggcaagagggtttgacatgagctatccatatgaagtagtgactcatgaatggctctttgtgctggggatggcaagtgttgcatggtgtggcttgactggatctcatgcactcattctactaggccttgttgtaaaaagagcacaattggacaggtggtgagaggaacatattcctggttggtcaaatgtcagccagaagctaagttgttaaaagcagagattataatctctgggagagatagccaagtccaagtagaacagagaatgcataagagggagtttgtgagtagcaaggggtccagaatcaaaatcttggcctgaaactttgccaagtgggagagggcccagaggggtaaactgaattgggttccctgtgtaccttactaccaggaatgccccaataattgcacaaacacttcctctacaactgactccaatattggtgggtaattattatggtgctgataggtcagcttctaaaatagaaaagttcaactcagtctacactcaaattcgttggtcttccttcaggatagaaggaaaaagtgagaaacaagtcttttaccttatgtctccatcctgagttatcagcagaaaaaaaaaaaagctcagtgtgttctgtgcaaatcaccatttggaatcatttataaactatttgcaggatactgatcatgacatactttttctgtgttgggcattggtaaagtcaccttgacattggcaactgctgcctgaaaattgccagaaaatcacaatgctcagcatggattggaactatccttataactagtcaaaatgaaagacttaagaggtttgtgagatttcattctcaagcttcacaaacttggtggttgaatgtgaaccacttttgcaaattccagaaggaagccacaatttctcatgttttgtaaaaattcttataggcaaagtactcttagcttttcagtgtcagactggagacagtaagaagcatgcttcagccttgatactgatgattacaaaacaaagaaaaaactttggattaaaatgttcatcctgcgcaacgtctgttctgggtagagtctcagtgtgttgaagagcgtgggcttttgcgtcagagtttctgagttggactccaggtttttccagttgcttagctgtatgtataagtctgttctcacactgctataaaaaactacccgagactaagtaatttataaagaaaagaggtttaattgactcacagttccgtatgcctggagaggcctcaggaaacttacaatcatgatggccggagagagaaaggagagtggggaaactgcccccctgatcccccctcccaccaggtccctccctctacatgtgcggattataatttgagatgagatttgcctagggacacagagccaaaccatattgctgtatatctctgggcaggtgattagcctctctaagcctcagttttactgtctgtaaaagtggccttacagtacctttcccgtaggctccttgtaaatagtaaagtgcaatcatgtgtgaaaagcaccccataacttttcagtaaaaattttcacataaggaaaccacttcaacctaagggactctcccagaactcacagatctccctagagcttagccttcctgtggggctggataagcccaggaacaattttgtttatactcatacaaactcacaagggcctggattgtgagttcttctaagggccccagattgaatcagagccccaagctcatcaatcaggagagattgctacggcaggctctttcatattctggagtgggaattggctttgctgaacagttacaacacatagactattctattaggttgaagtgtatgaaaccactatttttgtagatcaaaatggttaaatattagcaatatcacatggttctacgatgacacacagatttacagcatgttgttatcaatggcacttcgaggcccagactagaacctcagatattctccaggtcttcaaataatcaaactgccttgcactgggagacaagatagatccaccttatccccaaatactgtgctatagcaggatgtagatcacactgtatcaaaactggttatatttacccaaagaattatcccctctgggtccttccaccttttccctgctgccaccagcttgagagaaatgagataaggaatctacacagttttcatctccttgcttttaccactagacaacagagcctccgggggaagtttatttttaggatcagggctcaactaatattgattaacagccttacataatgtgaggctccagggtttgttcttttcctgccaagcctcataactggagaaggcgctgaagatttgtcagtctaatcagactttagctgccagccaagaaatatcttctgtcttctccttacccttacgcaggtactttctttttccctcttagagaataatttggggggagagaaattgcactctaatttacttgttgcctggtaagattctctggtgacatttactctctggaactgcacagttctaacaacaacagaaaagggagcttgatgggtttaccttcctcttaaagacttagatgttggcagtacaaataggcaagtgaaaagagtgcagtgtagtttgttttcatccttcctttaatacgtaattttggtggatggaacaggtgctttccaaaactaggtctagtcgatgaaagggtcctgagggcagacgaagtgtgaaagctcccaggagaattcatagagatgcccttccaattaggatgtaatatttacaggatggaatttccaccagaactactaataaagtgctggctcttatttctaggcatctgaacagctgggagggaagtggggtcagttcttggctacccacgggtggaggtccctgagtgtttttaaacctcagggtggtttttctaattacctaacagactctttagccgaatctaaagccaaaatccttgctgcgtggcatatggttctcctccttcctattgctctgaccatattttccaccacgttgctccaatcacacaggtcttcttgatccttcttgaacacagagcaagaagaagggtgaaaccggtgaggcaggattatgcaattgcaagcttagattttcatcttaaaattgatatttgactttttgcttttgcagatttttttcctgcattaatattgattttaaaatatttcagcaaatgaaaacaaagttttagcaaacccccgttaaatcttacaccttaagcgagtgtctcattcaatcttctcagccctgcctgaatgtgccaagcgtgcctgtgccttttcacctgccatttcctctgcctgcagcagcccttccctgctattcacagtactcactccctcacttcacccaggtttccgcttatattgcaccttccagaaaggaccttcttgaccgtctgtaaaatacaacactctatcgccttttcctgttttgttacctctcatagcacttatcactgcctgacattatagctcacatttatttgtttattgtccctatttagtagattgtgagttctaggatggcaagatctttattttaggcactaaaatagcacagtgcctagaacagtagcgagcacagagtaatacgcagtcaatgttggttgaaaggtataaatagtcaaccatccaccagtaccttctcagggagtccacaggccacacaatatttacaggctgaatccaagcccctgtttcccaggacccactccctcatgaggctcaccagtgagggtgggcaccactgggtttgctgctcttggatctttgctctaggaataaggagtcccagagatatctccttgtctctggtatgtaagattatttttgttagcttccagtcttgttgctcagccaaaagcaagggctaattctagcacgtatagttttcaaatcacttttggaaatgtaatatcacccacctttccctttccagtttcttcttcttcctttccaaataacttaatccttaattctcctaaaacccactttcaaatatatgcaaataaaaattacttggtaaggatggaaaattaacttgaggcttttttacttttttttttttttttttttggtctgttgagaaaagggcttgtagggtggtgcctgcataaactggccataaaaatatgggacaataagttgttgaaagccacaagaggcctctgaggaggaaagcctcctaaatgccatcatgttcccaggctcagagcgagatctgctctcttatctgtaaacactgtgttcaaaggagaaagactctgctttgaagcattgaaatgtggccagatatgctggctcctagtgaggcccactccccccagctgctctccgataaattaaagaataaatcagtagttaattttatgctgcttcagcacaaagaaaatttacctaaactgccattgctatagattaggtgtatgacacaccgcccccctttcaccgtttcacccctgaacatctgcttcttagagctaagtgattgtactcaacaaatagtgtggagaccagagcttggcgcctttgcagcctccattttacacttggccccctggcactccactctttatgcactcttaacctgtctattctcattcgtttgtcgccaccggacttcgggtaccctacgggtggtgctgaggctggtccccaacattggtctaatggctgagtatattgtgtgagcaccatttattcatgtctgaaaccctataatttgactagccccatatttacccatttttagtgataatttgaaaaaacattgatgattgagagaaggaacaatagctatgttgctcatcattggacatttagagcctagaatggtgcctgccacaaagcagggctcaaaaatatcagttgaagaaaaataaatgtgttaaacgaatgaaagtaagttaagcaaatgcttatcatcagagtgaagaggcagtgggggccaatataatttatttacaaagtaggcaaagggagttaggaggaagcagcctggtacggaggaaagtgcattgaagcaggcatcaggagacttagctcatgactggagaagttcttaaaaccatgactctaggcagaccttcatttctagctgtagaattttggccagggtcctttgtggagctatgtttttttattatctgaaatatggggatgatttccaacttcaagggtaggttaagataatataagtcaagggcttaaatgggtgcggctcaaagattattattgctgctgtcttaaatgggattataatctggtctcagctgataaaccagtattgcaactatattttcttttttattctgttgctagtttgtggtctctgatatggcaattagcttccttgggcctatgctctttcctcagaaaagaaagttttattttaacattatctagcatagtgtcttgggcacacacacacagggacagttaaatgtaggaaacaatgaattagaagaagtaaaagaaaggagaagaagtaaaagaaaggaaaaattgagaaggagagaaagacagcagcgatgctctgtaattattgctataagaattacgtgcccatttcatggatttgtatggcttaggttgagagagatgaataaaatatctttgatataattaaaatcataatataaataatattttttctatatctcccctctttgctgaaagctgttgggtgagacatcacaatgaccacttctatgtaaaaggtagattatagatggccctctgcatatgtgggattgcatctgcattcaaccaactaactgtgaatcaaaaatatttttaaaaaattgtgtctgtactgaacatgtacagacttttttcttactattattccctaaacaatacagtataacaactatttacctagcacttacattgtactagacattgtaagtaacctagagatgatttaaaatgcacaggaagatgtgtataggttacatgcaaatactatgccattttatattgaggacttgaggattttgccatccatgggaggtcctggaaccaatcaatcccccacagatgctgaggaatgactgtacttgataaatgtctcttgaatcatccaaaaaaaagaaaaagccaatggtttcaatttaaactgaggtaagaattgttttttttttttctgaaaatatatgatgttctatttatatataataggaaaacgacttcaagcagcaatcgtcacttgccaggcatcaaggcggatatttccattatgtctatgacaaggtggtgggaggggtgggatgtggtttcatacctttctggtgcatgtttgaatgattgtaaaaattagaaacacactgaggctgttatgacagccttgccttttgaaaccttctaattaatgccttgggttgtctagagagcttgttctgttagctaaatggtgatttgtaaggttctccttgatttcctcatcattcatggatgaaataattggggaaataaaatgattggggaaataaatgcacaccacgtctgtggtggctagcagtcactgagagaattacttgatgggaatttgattgacttgtgtgtataatgcaacctcttatatctctggccccatcttattatgtgtgtgtgtgtgtgagagagagagagagagacagggagagagggaggatgctcgtgtttgcttgcactatggagaacagtgcttcttaaactttaatgtgtgtatacagatcacctgggtaatcttattaagcacagattttaatgcacgtccggggtggtatctcagatcgtgcacttctaacaagctcccagatgatctcatgctgcagatatgtgtacctcactatagagtatagagcaaggctctaggaaatatttacggttccttgctgagtaatcatggtatctgtttacctatctcttccaaatggtcttcccaaacttagctcagttctcttcaagacaggaaattttgttaacccaaagtattaatgtaagtgaaagggtggataccccaactaaggattagaagagaaaactgtatcccatcagacaatgctgctccgggtttcagatgccccttcttcctgtcccttactttactgcatacccccaaggcagatggaaaaaaacataggtaaaatttaacttgtcataatatttatccccctttctgagaggtgacctccaatggaagcagaaggatgtgaatgattttaatccacggtaacaatggggagccagtcctgaccatcttaagcagtataaatgtataaaatgacagatttttctgctctgcctctccactttctcctcccggatactgagagagacacatattcatgcacccacaactcacactataatgcacaatgaaatttcacccagcctttatctcggggctgctgttctcatgattaatgccctactggctgggaagctattccactgaagacagacaaggagagaggaagatgcatgaaatatatctctgaggccatttctcattattattattatcattattagttccttactaccctatctatctatcctgttagaggatgcttgatctattggcaagggggaggggatgacatttgaaagcaggttttatgagggagaaatgaacaaggacaaagagagaaatagacagtttttatgaaagagaattaacctggatggggtttttgttatgattgttgtcctttatttgggggtttgtttgttttattgttgctgttgttttccatttaaagtcaaaaataatagatgcctccatctgcggcttctgatttttttccctagggatttatttttgcatgtgttcttttgtctttattgagtctctgtctgctagaatcaatatgatataacttatgcaaattatatccctgaccacttatgcaaaaaacagaataatttcgttgctctgtaacactcttaatataattacctccatatcctggttgatttcaagcttttgaaagggctactttaaaaaaaaataataaaaatctatttatgtgttgtataaaccacagtgtctgattctctcctgtttctcattcaaagaaagggtgactgctaaatgatttctggctctgtcatttaagaagactgcacagcagtggtcttagttgggaagttgggaccacaataagagtgctattgtaacacgtgtctactgataaaatggcaaattcattagcctagacaaggagtactatgatctggtttcaaaaatgctgtatacttccacagtccagtttatgagggcatgagatatataactgaggtgcccccatgttacttcaattttagtttgactttgaatttcattaaaaaatatttgagttatttgagtgcctagtatgggctaagtactgtcctgggcacttgaacaacatcagtaaacagacaaaaaccctcttttcttatggagaacattttctattccacaaacattgggtgtctcataagtgcaagactttggagaaataaagaatgaaatagaaatttttctgctttagaggaacacacagtctggtactgttcttaaatattttcagactacaagcggactcacttgcagcccagttttttacaaaaactttagcatgctgattggctagtacagttgcaaaggcagcagccatctatatttacagaggtctattccaagaatagggtctttaatttctattcaaaaaagaccaaatttcaaatgtaaacaatatatgttttgactaaaaaagacagaaaccgtaaagcaagttacaataaagtgattgaaacatatttcggtcctggagactaaatttgcaatgtttatggcaaatatcttcttgtgttggtttgagattatagttttatggaatgtttatattggaagaatctcagagattgagccccacacaaccagatgagcttcagagatgggccattctggtttcaagtactagtttcattgctcaaagctctacgtccaggggcaaattgctcaaccactttataaaaaatgtaaacaacaggtaatttcacattttaatttatttttatctaaacaatatattcacatagtttatttttagtgtatatatgtatatatatttatttcttatttatttcttatttatatatttatttatagagatgaggtcttactttatttcccaggttggtctcaaactcctgggctcaagtgatcctcctgcgttggagtgctgggattagaggtgtgagccactgtggttggcctaagtaatacagccacacaatttaaaaccttgaactgtgcctagatatcccctttggggaaaaggcatcaccttagttgctagagtgctggctgatggctgttggctaaatccttcacgaagaactgcctttgactattgaagccaccttgcccaaccaaggtcaagccccttcctgaagggtggcccatatccaattaatgatggtgaagggtggcccatatccaattaatgatggatgatggagctggggggatctatcaagactcagcccattgtctcaagactggataactgggaagggccttttagctagagagtttcctaaggccagctgaggtctctattgcatgaatgttcacctcccccttctgcccagactctgatgtcactctccccaaacttcccaaacacgataccgggcctcagactttgttttctgaaaacgcagctgaagatagatagatagcatcgtgagacttaaaataagaaaacaacaataacaaaagaaaaacagtagtatctttctaaccttgccctaaagtcctgctctatactggtaacccttttatatccttttcagacatttcccttcatagttctagcaatatgcttgcatttctatttcttgactttttcagtttgacatattaactaatgacttctgcttctggaagtaaaagttgagctttctcatgctctccctgccctacaacccacacacacttttttaccttccagtttcccagtaaaattctatcgcatttcgattaaataaatgttcagagtttgttattatgactttgtaatatcgcctattgaaaacaatgtaagatcatacatgaactgacttgttccacaactattcaccagctgcatagaatgtgccagacactgttctagagactgaggatacagcagtgaaaaacaacagactatatttctacctctgacaaaacattatactgttatgacaatttctgttttcctgtaactctttgtttgttaatgaataccctcgttatctcgttagcttatttttctagccacccatcagtgccacagccaacagctacaaaagacctcacaagataaaccgacaggactccattatttctttttctgtcttggaggtctcccttctggagtcgtctgacctcctgctttagtctgggctgggcgctcgctgagcctgcctcacagctatcatcctgcgtcttccttgctcgtcatgctggaaaatccctgggccctgctcctgtattaaatcctagtttcagctctatttatttcctcattttcaaggtgcacattgtcctgtagcctcctgagaaaggatagctaaaaagtaaaatcattgagacattgctcatctgaagaatgttttattccattctcacccttgacgataatttgcctgggaaggacttgtatcttggaaattatcttcactaataaatttaaaagcatccgtccaatgtttttgggcatccaatgttgcagctgttgacatcacagtttggtgtctaattccttgactgcactgatttttacttttttttttttttttttttttttttaccctctctctgaaatatccttatcagtggacctcaaagtagcacttacaactcaggtctcttgaaccacatgctgctgccccctatagttcttgcttttgtaaagttgtggttatttgccgattagctgccctgtgttggcatcctgactttggtatgatttgatgagctaagctattactaaactataacacacacacatacacacaaaaaatgaatagctataattaattagcataaagttttgagggtaaccaactttagtagagatctgagatatatataatgtatatatatatatatatatttgaacattttgccttgggttagagagggaattggtggtacagtaattcttactggaattgtgtagtgatagctagtttatatatacatatatatatacatacatatacatatacatatgtatgtatatataaactagctatcactacacaattccactaagaattactgtaccaccaattccctctctaacccaaggcaaaatgttcaactcttttttgtattcccttaagagcccttattttttttttcagtttcaccaatcatgttcatttcttagccacctcagaaagaatgagaattaaataatatgtataaaccctttgaattttttacatccagaaatgagcataagctcattcctctgcttcacaccagatgcttatatttttgagaggagcaaggattagaattgtcactctggaatttttatgctacaaaatgtcaatcaatatgtttgcatgtcactgggttccatcctacagtgtttggtgataaagtcttttcatttggctcccagctttatcaccataatatatttatttactttaccttacatgtgctagttggtagaagctgtagaaaaagaattactcccacatatttctttcccctaaagagaaacaatatattgtaagaacacagatggggctccacacaaaaagaatgccgaattaatgttggatggatgtacatatacaagaacttgctatcagtacacaattccaataggaattatatatacacacactgaaaatagaatttgattaaataattacactaggtacaagctacattttacttccattgaaggagagctaagtggaaactagtgtgagacaatcatgaatagaaaagtgcagaaggaatttgatgaggatgttcccagggctatttctagccagaaaacgaagctggaggctttgaagtaaatcaaaatatttgaagaagtaagaggataaatagcaaaactcacttccaacatcatactaaaagcaccatgcaaccatatagaaaacatgcataatttattttgactcaaataactatagggagattcttgttttttttaattaggagatttgaggtaactgtctagactacctatttttatgttgcattcagcaatatgtctgctaataattagagggaaataaattacataaaacaatgccagtcatgtcattgataaaaaggaaattaaagtgtgattgtgtttctctttctctctctccctcattttcagtgagctacatcctcttgttgtcctcctcacctgattaggcatttttgtaagggagtttgcctccgtcctctgttgtaaacattttccttacctcagcatcctttttaaattcaaaagacactttcctttgcaatgcactatgaaaggcgattgtgttagagaatatcagagatggctttgtcatgtctggtgctcttaaatccttttcttttttttcttttcttttcttgagacggtgtctcactccgtcacccaggctggagggcagtggcgtgatcggggctcactgcaacctctgcctcccaggttcacgccattctcctgcctcagcctcctgagtagctgggactacaggtgcccaccaccgcacctggccaattttttgtatttttagtagagatggggtttcaccgtgttagccaggatggtctcgatctcctgacctcgtgatccacccacctcagcctcccaaagagctgggattacaggcgtgagccactgtgcccagcctcttaaatcctgttgtgtcctaaagagtccactaaacgaggttgagggtatgatttgacaattgaacaaggcctcagccagctctcctagactgccccaaaactccctgagcagagagacccaggtggtgatggaagtatttttcctctaaaagactgtggagattctggcaaacctatattttgggtttagctttcaaggaagaggtggcatttgaaaagccaggggcctttgtagccattttattcactacctaatgtgaaggtggtggcagggaatggaaaagggaagattatttagtcgataaacacttaatggccactgcctgctgtgtggacagatctggatagagttaaaaagataataaagcaagtgtaggatgcctgtcttcatggtacttatatcatgggaagaaggcatgaacaaaccaattttacacataattattcaatcacaatcatgacacagtgtgataaaggaggacaggcttctaagacagcagaaaaggacctgaggtagtgttgtcatctggggaagctttcttgtagaagcagtatagaagctgtcctgtgcaggatgagatattagattgcaaaagaggacaagggccagtgttcccgccaaaggaaatagcctatgctgaggccctgctgtagggatcatactgtatcgcgttcctctggctttggactacgcattgatgctaaagtctggaagcataccatattcgaccaagtaaagtgaccagttaaggtccccacttaatgggctaaagataggtcattccaagagtgagcctcccattattatgactcatgacaaaggggtgtgggactggttggaaaagagtttccaaagctggactgcatcacatggtcatgtggaatgggctgcctgctctcccagtctgaaccctacctctgtgctatgccaaaggtgcagatccccttagtgaaaattggagacatgaatcatttaaggcaatgcctcacagacccatgtgcaaggttccatggaatgtgttaatatatcacactcatctcaattttgcacggtacatgaaactatgcttgctgatgagggaccatacacattgaacagatcatataatggttatggatgtaatgtcaataatgtcatggaacctatcatatgttgtaatatcaagaaaccttttagcatgtacatttgtctaggtttctggactttacagccttctggtatttcacttgcttgtgtctttcattgaacactaataaccagaaatcagcaacgtgaaaatttgattcttcttcctatttttctcatgccttactttggtctttctttctgcttggtggaaactgcggagttcagtggaagttttcctgcagtctaattagcccctctgtttaattttgtaataaaaacgctgaaccagaagctggagataatgtgcccaattcaattcacagatgtcaatttctttttaattgtaatccttttcttgagttcttcccactcttacttccctggcacagctgaggcttgggtgattacaaaactttcatgcctacgctggagattatgcctcctgctttaggattaaattcattcgttatcattgttgtaattattagtagtaacaatgggcatttccacccaaacctgatgaatagtagttttcacagtctttgcctccaaacttagcttatttcagttctttgcccagataagttcttcactctttaatggcagggagcattccgttttctgttgcatttaaatgctattttgagatcattcagaagacaaggctctttttcctttttagcaggttctcctgggtgtggagagatggcttctttccccagagtaggagtcaccacttagtgaatgctaatggggtcttttcttcgtgatgcgactgctgctttgaagatgcatttgaactggcaaggggcacctcttagctgcaatctcttccttagaagggtgccagctccaggccctaaaaagcacacatagctttgacttccatgctgactccaaaagaaccttttctctgcctttttgatggagtagtccctaccactaacagaacagcagtgtggcccaaccaacttgaaaatggaactggctcctcagcaacatgctaattctttcaaacttccttgtcagactcaaacctcgatgtgtcttttgttcttaaactgcatttgtagtaagatcttcaggaaaagcaatcagtgagagactgggtcaggcttttatttaattactttgcactttttttccccctctgaaccttctccaaatcaaaagaaagcaatgcagtttaattctgaatatatgaaatgtttgcactttaaattataaatgtctctcaacgataacaccttctgaaaataatgctccgtgggctctttagaagaatatttaggacagttcatctcaggtttaaggtgcccaagctactatagtgccctttcttatcttggttttatgtttttccactatggcttactgatataatttcctaatccttcttatctcaaatgtctcttagaccgttaaacctttgcctataaaatgaaggggtttgactttgaatctaaaggagtggaccatccctcaagcaccctagtctctcagcgcattcattccacaaacatttttttgggagagcagggtgattcctgctatggacccatcacccttgtagactctgaggctgcaatgaaaatacaataaaatcagtaattctagttcttatggaacatacattctgggagtgggggcagagactaccgataaataaattagcaagagaatataatatgcagggacaagtgctatcaagaaaataaacctgcgcaatgtcacacagaatgcctgatgggtgggtaggtagtttaggggaagttactctaaggaagaaacatttaacctgagattggaatgataaaacatgtcaggtctgtgaagtctgggggaagaacatttacagcagagggaacggttagtgtaaaggcctttaggctggaacatgttgagcagtgtttgaaagatgatgaatatggctgtagcagaagaaatctggtgtgaggtaagatctgagaagtggcagggactgaaacagacagggcctgtttggctgtggaaagcagtttaggttttataaaagtgcaatggcaaactattagaacgtactaagtaaaggagtgacatgatgtgacttatgttttttaaagattactctgccatgttgagaaaatattgtaaagcagcaagagaggaggcagagagacctaatacatggctattgctttaattctgatgaagtttgattgtggtttgaactagtatagcagccaggcccccactacaggcccacccagcttgatggcctcaccctgcatcttgtcctgtctctgaactgctaaatctcaaaactttaaagccctaatatcttgctgattaaccataatttccaaatcttatgcttaagtccaggcagtttttaatttttttttattttttggcttcagcaaatttttcatttgtctatatctataaagtacttctcatcatcaacccagattcctttttctctctgttgtgttcattctagatcattccaaatggtctctgttccttctgccttcaacctggtcttagaagacttctctgttttttatctctcccccattccacctccaactcttgatcagcacctatttcaaactctcaacttggtctcctttttcactttttacacacttggattttaaatgttaccttcttttagaaaacaatgctgaccagtcatgagtttctttgaattcctccatgcttatccacatcagtccttactttaggggaatcccttcgtccctttgtttgaaatcttatgctaattatctcttcactcgggtctcttcccaaggtttggacatcatttagtgttctcattttccactggtgccattaatatcatcccgtcatcatagacatatatgtgtgtgtgtgtgtgtgtgtgtgtacatatatatgtatgtatgtgtatatgtatgtgtatgtatacacgcgtgtgtatatatatgtatatatacacatatatgtgtattgtgtgtatgtgtatatatatgtgtgtgtatatatatgtgtgtatatatatatatatatacctttcccatttcaaaaacaaaatcaaaacaaaaaaggcaattatctatgaacctgatttctgtcccttctattagcacttactgtccccagatgaggacactctttcacttccccatatgctcaaatatcctgaattttatactctcactgattttactttctaaacaaggaatatatacgtattgtagaaaaaaatcactgtgaagtaaattccacccgtgatccaaccctccagagaaaatcgtgcataaaaggtcccgcagattcccacctgtctttctttccttccttatctaccaatattttttcacatgcatgcaacattctagtcataccttgttatactttcagacatgttctttctacttgagcacatacaacatacaacttgagcatgcttgtttatctataaaatgaagataatatgatcatttctgtaggagttttgagtcaaaaataaatttatgtatttcaaatgcttagaatagtgtctgttgcatagtgacctttcaataaaaattattattattattgctcttttgtccactttatctacctggaaaagtaataatccctcaagactaagttgaaatataacatccctggggagtgtattagtctgttctcacactgctaataaagacatacctgagactgggtaatttataaaggaaagaggtttaatagactcagagttccacatggctagggaggcctcacaatcatggtggaaggcaaaggggaagaaagacacgttttacatgtcagcaggcaagagtgtgtgtgcaggcgagctcccatttataaaaccatcagatctcttgagacttattcactactgtaagaacaatatgggggaaactgtccccatgattcagttatctcctccttaataatccccttgatgcatggggattattacaattccaggtgagatttgggcggggacacaaccaaaccatatcagggagttatccttctcctctgccatcctgtttcactctgccaggctccttttctcagtgcctccacaagtggtttacttgttgtgatgaacactatgcacagcagagagtttaaggaccttagtcatgtttcctaccaatcagcggttggcttcctattaaacctttctcgatgttctggacctctagagagccattctgtgctgctatgcaatctataatgactcttcaactaggtttctattcatttccaagtcttccctaccactgagatacttcaaggagatatgagtggatcatgaataaatatcctaaaactaaagacagttaagtcaattgcactctcaatattatcagactattttaactaatatgctatagacaaataattcttcagaatggtgtttgctttgtgtgtgtcataagagattcttgtctttagagaattagggaataatattaaaatgaataaatagtaaaggtgggaatatttttaatattattaaaataaataaatgattaaagtagggagcatgtttgaaggtccattttaaaaaatatatgtagacagaggaaacctaagagttaaaatactgagtgagttttgctctgcatcagtggaggctataaaatgcagtatttatctgtatatgagttctataccaatgtgatctatctctctaattagatagtcaactatttttaaagagctgcaaataagccttacaagaatgtcataaatgcattccatttagaaacatcttgcagataaattgtatttttattcttcctgcagcctcctgtagccttaaaagaataacaaaaaataaattcttactacctaattccagacacagatcattactaccagtagtatgttaatcatgcttgccattccttctccttcgatatcattatgctttaggatagaaaaggtgggtggtatgtgagcctccttggataaacaaaacgttggagtgcacaggcttctcaagaggtacaatgttattttcatgcaaaaaaatcccaagtattacaaaggggcttgaaaatgttgaaaacacattgtgaataagtagaattactaacaagagcactgtatcttttgcttcgataggctctttcaagatgtagacaaattggaggtaggccagacagaatctacgggaatgattaggggaattgaaggaatgacttcggaaaaaagattaaaagagctaaatacgtataggttggctaagtgccaactcagagaaaatgacattatgggctatagatatttgaaagtggctggctataagcaaagcaagggattacttaggtaattggattaaatcaagggggtaaacattttaaactcaatatctggatttattttgttgactataagaattattagattttagaactatcccataacctactgcttggattaaagcaagaggtagggtgtggtagcatgaagtctctaatagtttacccagttctgagcatcttgttgccaggaagcagatcttactcacttttaatccctaggatttagcacattaaaagaactccatagagagctaagtcatgtttagttcagcgagaagaaaatggtctgtggagtcagacattacagattttatatctctgctgttttattgttctataacagtcagcaagttacttaacctaagccttatccataaggtgcgtattaatatcaactttataggattgatgtgaagtttacatgagttgtcttgatctcttcttttacctatttaacagcggttaaatacacccctcctctccatcatcactgccattgtgttccttctgactttagtaatgtcttcaatggtttcctggattccaattttgcctatcttcaagtttccacaatatagtcaggaataactttttgcagcgcatgtatgagtaagcaagccctagcttaaaaactccaatggatcccattgcctgcaggataaaatcgaatatccttaggatgacaaacttcatgccatcatgcctgtctttctaattccaactcatattaccctacccttctcacataatgctctaactacattcacttgcttgagtttttcttttgtaccttgtacaaatgtataaacatgctggttcctctgctgagaacccactttccactccaatttgccatttctttgccactctttgtcttctgccttgcttcacactctttctaaaatgccaatctcagattttacctcttttgagattccaggtgcctctcccatgtgtttccacagtaaatggagcttatcattatcctgctattaattctactgtgttctaagtgtcttttcactctgcctctcctaatagatgttaggattcatttgggcagatacttagattagtgcctaccatttagtaggcattcaacatatttttagattcaaagaatgataaatggtagatggatagatggatggatgggtaggtaaaaagatatatggagtgtaacaaagtacctacaacataagaaattatcaattaatttcagttttctttccttggagttttgagattaagaaatgcacttcgttgtcccgaataagcatagtcttgagtgggctttagtcagagttatttgtgtgcatttatgtcgatactacccactccattctatcatattgggaaaataatgcaatctcgaaggaataggagtctaggaaacctaggatataagtgagcacataccggagaaaaatatgccaacatagtagcttggaggaaatacttggaaatatcttgcctttatagctagatatagaacttcattttttacaactagaagctttgtgacttctgagaccatgactgaagaaaaatggaaatgaagacaaaggggactgaaatgggagtggaagtaggaaaaggggatccatagacacaaaacaaacttttccttttacacactccatttccctctctggtgcttgcccatggcccagctatttaaccttaagacacatggccagcccccttgtctagagtttgccctaattgttgggcgcattgtagcgtcttagatgatcaattgctcatgccaaaagcagagtgttaagattcatgaaattcgagtctgtgctattaataacctgagcagggttttcatgcctccttcccctttgttttctcctttgccaagtctccattctcactcttttgtggatgtgtgtgttatggagacgaatgaaatttcagacacagcaatgaattgccacctaaaaggatacaccccagggtcttctgtgttcctttgcagctgtgtgataaattgccatctccaaaattaattgttaccttttcaggaagtgtttactcattttcatctcctcactggcatcagtgaacctctgagctagaaaaaccaactttcctttcccttctcaagcccttgatatgcagctagaacggcaatcagtggagctgacaagggcgagcagtggtacctccgtgttgttctctagcccatgaattcaatgaacatccaggctatgcctttcatctcaactgccttttaatagactaacccatttctctttacttttggctccacattaaaatgtctataaaattttactccaagctaggtcttccaggtttacggaagaaggaacatacattcagcaaaacagttttctctttttgttagatttctgctgttctcaagagctgaaaaaaagtgtgatacttcacatgtactctttaaaaaacttactaagcctgctcagcttttacacagggtacgccggcacacaagtgtgacctggtccttactccatcctcaaagataagttgtccccacagtctgccaaaaagatgtccctgatgcaatgagaatgagctggagtcctgactgtgctacatttttagtggtatcctaactctctattccacagacatcagaaaatgtcacaacatactctttgtaactagtccctttattatgtccatgaatgtaatatatacaatgattttcaaagagggtgatttttcacccctcttctctccctgccccacatacaaaggagactttgcctatgtctggaaacatttttggttgtcacaattgaaaaggaatgtatggaggtgttgctgttatccagtgagcagaggccacagatgctgctatacattttataatgcacatgaactctggaatatataaatcaagtaaatctcagtattctgccatgtactctgggagatacttaaaattataagccatgacttctattttccaagcattttggagaaaaacaaccaattttgtttttgatttctgactatatggtagagttcagctacacagtatatggtactttaacaaagctatacggtagctgcaagacaacaccatggctgggcccttcagagcctcataagtgtattggggacactgagaatctagtaatagactaacacatatgtaccaccattgagtggcatcaaacatgctttcatttagtgctgaaattgatgatataatggaggctagaaagatctaataatgaaaaaaagaggaatttaaccagtcttgaggtgatcaaatgaggaagcagaaaggtaggattgattgtaatgtgtgcacagaggagtgaagcctgattacctgtactactcattgccagaccttcaagaatcgcgtgccaagtgccaggtgcagaagttgcaaaactgtttgggagatcaaagagaaaatatcaacctggctttcaagtcttttcagggtgctttcttagaaaaactgtttttggtcttgaaacatgggcaaacattggctgcgggccaagaaatttatagttcctgaggaactttagattgatacatgtctgacaatttccattttgcaaaacaagagaaggcaaaagtgggcttggaaggcattcaatctttgatgttgtctttgcttcagctgagcagaagtgagaatttagacacactgagccattaccagagtttaagaaaacttaccatcagtgtggtttccccctttctctcagtcaagcacatgggtgtgtgtcattgtaaaaggactataggattggaagtggacacgtgaattccatttcttactctccactaactacctgagtgacattaggcaaacttgcaaatgtggaagttgggccgggctaggttatgttccgctctaaccttaaacactgatttccccattgactttcttgttccattcaaagagattaggaggaaaaaaaagtggtatatcccaggcacgttttgtgatatttcagtgaaatattgaaataagcaatgtcagcagcctcatgttctcgctaatggtctggtatactttatgaataaacaacactagctttatattactggatctcatttccagcagatttataaaattgtaactctacagtgttttctgacagagcttctggaaggggaaaaatgacagtgcagttgtttgctaacatctgggtgtactttttgcaacatggggagaattgttccaaggcagggagctaatctgattcatatctctacctagaagcacttaaagaagctgtcagatgattcccacagtgacaaatttgagtcccaaggagatgatggagtgaaatcagacacattttgggaagaaattcctactatcttttcaaaggataaactcccacagtatttgtgccaatctcttttacagcattcctatctcaaaaaccagagacttaggctaattttttttgtttctgttattctctaatatatttgtttaaaaaggaagttttaatgaaaagtcagtcatgtgacttagagaattaaatgtagggctctagcaaggatttgctttaaaatgtttctctccgatttagttgctgcacctgggtaataactaccttggaagtattagtgttgtttctctgtcataaaattgacatgcttggtgtggataagaatatttgattgtagaactgcttctacctaactgcattctgttatactaacaatttggctagcagaatttttttttaaaatcctccatttgcagctttttgtactctgatcacaatatattaaatcccccagaagaactactaccttgaatacaaagcacatagcggtgctcttttaattgatttgtaaaggttagttgctcagtactagtggaaagtttcatgattacttaattgaattacctgcttcccccagtagagtgcttactgggcaccatacagtaagctgagagttttacatgcctggtactattatttccccagtttacagattaggaaagcaagatgtagcttacaaaatatgctgaaagaccactggcataaaagccttttaattccttgctgaaaaactccctgggttttgaaatatgataaactacatttttgttgttctctgaagattcaggttcatatagtatgacagttttatttttgtgactctcaatcatatatgagataaatgatgggggaaagagaccgctttgaggtcaagcagacctatgtccaattctaacatcaaggagaagccacgtgctttggcaaagtttgtgtatttacactgttgggaaaactaaaagtaatttatataaagtacctagcatagtatctggcagggtaggtgttcagtaaatgttgctggtattatttttgctagtgataacattattcagccatataaacacatagcactaaggttaagcaaaatatgtattgacattacagcatgcctaggtatttattgcctaaaatatatttccgataagcttttcttagcatttgctgctttctactaagagttgagtgaaactacgatgaccacaatttagtctacttatttaaacctttaattggttggcttccggtaaattgcagtttgaatgactagcccaatcatgtatgagtagccgggaatattcgataggtatagaattcttcctgcctaatcaagtcagggataccgatgttaatttctgaaataaatactttctcctctcaagatctacccagtggttcgttgccccttgggatcacttctacttttcaacaaagagcaagggacagtaattgcaacttcagggtagaaggagagtttgcatgcctggcccagaatgaaataaatgtggaggaacagagcccaaatgacttgtatgtttcaggtacagctccatgtatgctgcagatgatttgggttaaaaaaaaaaattggccagcctaaactttgaggcaaagaaattgcatttcccaatgtctcatttctctttccttttactttacttcatctactgtgaatgacccttatttttttgttgttgctttatggcaataaataaacgaacccccattgtgcaaatattatgctcttctcattggcctggagggaaattgctacgagagaaatcctggacttttttcccctttttagaaggaaataccaggttacgaatggcccttctcagtctctagattgagactaggattcttctgtcacctcctcagagccctggatgcagaaagcaattcatttcacatgtgtgcaaatcagacacagaaattctgcaaggcacctcttggcagtaaaagtggactattaactctcaaattgctggcctctactgagaggcaacttctccctgaagccaggtgggagtgtccctttgaagccttacacaacccgacttctgttgctagggtagagtactttagagcaagagtagtcctgcggtatgttaactgagtaggtgtttcccagaaaattaaaagcaaaagtaactacctggaacagtctgatttttaaagcaaagcaggatctttgtacgtttaaaatttagtccagctacttgatagcctatagagcccccaactccttcttccagcccagggagagtctgcagtgagcaaggtaagaggtagctccagcattttcagcatggggttaggttggaagtcccagttgacagggacagtccttcctgctctcacctgccaaaatctctctcctcccaggagatagctcccttttctccctgattgcttcctctcatgaggagaaggtcattggcgctcaccacttccagggcaaccctttatgcaagcagtgggtgcctttgaaaggcaaaccgcagcaggaagactttgaaggcaagaagagactttttcatctttgcaggccccagccagaacattggttctcagtgcagtacaagcagtttcaaagttatctcccttgctgatatggatgtgataacatggagcggagaggtgccataatgatttcctttcaaatggctgcctcaccatttatctttgcacactgtcaaagactgatattgtcgggagttagcagtggcatggaataattaatctcgtacgggggaagtaagttcttcatttgtctcctgagaaattagcactgcattgacagcaaaagtagatgatatcatcggaaagggaaagggaggtgatctttgtaactccagatgccaaattgtaacattgattcagttctgtgaagttttgattgaacacctactatgtgccaggtgctagagatacagatacagattcctgtgctacagtagatcataatcccttgagggtcacagcttatttcaaaatccttgtcaccttgacaaaatgctcaagaccaccatggtgacatgtgtgccaccatcattattattatctaaagagttttaccaagtgtctgtatcattaatatttattgtaaaggctcaacttttataagaaagaatccttgtctcccacaccaccagtgcaaagtagattaacaaagttggcatttatttattttattttttctttaggggaaaatcaagaagttagtgatctagggctaatggggatattgtgttactcccaatatgtggttcccatatttggattcaagtttttcctattttccaatcagtgggaggagaaaaagaaaagcatgcctgcttatatcctattaaggccacacctgtctgcaaaacaggtgggatccatgtgaaccagaagcaagctattaaggatgcaagaaaatgtagtgactagttggatggccatataccttgcttaaaaccagttagggtcttttatttctgaaagaaagaagggaaactagatatttggggatgataagcaatctccccacagagattctgggtgaaatcctttttgcttctctgaatttccaataactcacctcttaaatgagagaattgaaggaggtgtgctgtgtagtccttttcaatttcaaagtcaaaataacaactctaggctcctcctccttcctcagcttctcccaggcagtaggcacagtgatgggctctgtgctgggaattttgttttgagcctgtttcttttatttggaaacatcaggtgctgaacctatcctggattcgagtgagtgcagggcatggctctaagaagcattttgtggaaagagtcaagcttgtcatcctcctcctttgaggcactaattgggctgactgggccaagcaaaacaatggtatgatccatgtgaaccaaaagcaaattattaggcttggagagtggtgggtagtcagagaagcacttctgttgtagacagaaaaacagcatcatgcttctcagaaagaaagggggctgctatctgggtggaaagcttagaatcaagggagaattatacatgtttttaatggaccgaggaagaagccagatttgtgtatgcggagtttgatagggaagggcttctcttctttttcctactaaaggaatagtgtttttgacaaggtgccaaaaatctaggccacagcatcccactttgtgccacagcatcccactttggtgagccataccaggttgcaggaaattaattgctttagactttgggctggctgagtggggcctgaagccaccgtagtccctgggcaagccccctcccactacacaggcctcctccatctccctcattttctctgtgtgctgtgatttggaaaaaattgacaagcacttgatagaggctaccaaccaattagaattggttcacacgagacacttgggaatgaactcagctggtcactatggtgatttaactaaattgtgttatccagacacattagtgaatcaagtctggcatttcaattttctctataagatgaattgtggaaagaagttcattataataattaaggaagatttatgcagtgagtacatttttatctctgtagcctgttataatgctggtattttgtgaccaaaaaaattgagttgtagatattaactatgtaattccacaaactgtgctcccgaacgagttatttatatagttagaatttaataaatggaaactttttgaatgcacctgcttaggaaaatattgaaagaaaacttactgtaagtttttcagcacagtgaacaatcatcccccagtgaacaaaatgctagccttaacccggtcagtaaattatttggccataggcagatatctcatctccctgtaaaggaaagccagtttcctccactgtaaaatgagtcttagtaggaaagggggcattagcaaagtaatccctgtgcctacccaatcgttctaatgtgatgtttcctttggaaaaaacctacaactcagaaatatattgaatgaaaatctccctattacaggaagacactgcgggttgctaaggagtgtggtttctgtggttggagtagagaaaaatagtggtgttttctgagatctcaactcaactgtgcagggtagatcgaatgaacacagcacaagccacagccactgttctgcttctgcctgatttgcttctccagaaatttcccagattacaacaatgccgaagtgcccattggctaccacggagataacttcataaattgttaaacaggcagagctcaggtttaaagaactgcctttattttgagctgtgattttacttgtgtttcagacattccctcagatattttatttaaaagatttcacaggagcatcatgcaaaatggtaaataataaaacattctataaaccacacatcccatctaggactaatcattatattttccaatttaacattcattccttccagatatgttcttactcgttctttaaaactatcataaatggaaagctaccatttaagcacaaataaaactcttaagaaagctaagaaaatctgaactcattaaatatttctaactagtgaactccttggttctccaaatgacctattttttcccttccttcttttttttttttttgtatttttagtagaaacagggtttcaacatgttagccagcctggtcttgaacacctgacctcgtgatccacctgcctcagcctctcaaagtgctgggattacaggcgtgagccactgagcccaccctccttccttccttttttaaattagaattttttattttttatttttttttttaattttttttttggttgcttttagccacctcagttaccttgaccatccgatttcacttactgtagccagatttctaaagtatgtgtttctgtggcttttccatagtttttttccccaatattttggcagtggttgaatagaatccttttattcctccctccctcacccctcccaatcagctccacctatagatatagaaatacaaagtgaacaaatgtgccatgcaacttctatttttgtgcccgttcttcctctttgtctctatttttgcctctagcacatagtatcctggtaaactggatttttttttaagagacatggagaacacagtgcagtgctcattctctctcagcctctctgtttttactgtaatgaatctattctacataccatgttctcaggatcccactgtatgtctgataaactaagtcaagctaaggtcattattaccaataagtaatcaataaactcaatgtttaccctaagtttgatacggtaacttagttattttaagaggaaattttaagttcttgtgtgtgtgagtaagaaggagcatgagaatagggaaagggccgtttcacagaagcggtcctatctggttggcctcaattgtgcctctcaggcttgtatctcatctgcttagctgtaaggccagtcctgttaggcaagaaaaaatttaatttgcaacctagtttatgaaaggataaattaagggaccttgtgggaatttaaatcatctaaggtaatagaacatgaaacttgcctagattaaaaactgggtcttttgtgaggtttcattcattatggccccataataatagctacatgtctatgcacttttgagcttgggtctgtttaaaatacttatttgttatttcacttaattcccacaataactgtacaaatatggttctcttgcctccatcttatatatgagaaaaattaggaacaaaaaaacttaagaaatttctttcactttctatagctgataaactttggagatcagtttgaacccatatactcttaaacactatttatacagtattaatgtgatttgacaaaagtggcataaagagcaatgactctttaagactcaaaagaagatgttcagatttatattttgatattaatattaatatcagcaagataagctgttaaataagcattacatgtaagaatcctgaccttggataaaattaaatctttgtcataaatctactactgtgacaaaactgcaaaatatgcagtgaataattaaatccagatgtctcttccggcaacagcagcagcaaaaactggaggtgggggtgaagggaagatggaagtgacagactccatattcataaaagctctgatgataaatttttttaaaaaaatgtgtttgttttaaataccagtcttccatgaatcctaagaattgcacagtaaaaaataaaatctgcctaccatttaacagcccgcaatacaaaaatcttactgtgtcaaatgtaatatgcatacctggcttcccaatttggttttcttaaggaggagtaatttagttgtcattaaactctttgggaaaccgttttaataatgttctttggttatcaggggtatcctttttttccttaaggcaaagaagagaaaacgtgccgctaaaacctttactgtgtgtggtaatgaagttggtccatttctgtgcaggattgcaacaattctttatcacttaacacgatcggaggtgtgagagcagacagtttctcaaactgcaggaaaatgctgaattcaccgattgctatcttgacacaatgaagggaccatacattatatgaagcccacatttggtttgctgttgttgttttttttttttttataactgtgattattttttgatggaataataatcacagaaaaaagaaaaacctgtaagagaagacaccactgtatcatctttttatggcaatatgcaagagggtagaaaaaatgagagtgtctaaatttatcttattttcctgtgggattttcagcacagacatattcctaccactacaaggaccaaggacattcacttgcctgcttgctctgataatggccagtagctggtcccaatgttgatacaattaattaaaatgataaacatgactctagctagcttcagcacagtaagagtaccacagcattttctggatcatttattcaagattcactgacttggagtcactgatggtaccaatcattttatgaaataccttccactagagacagaaaaacgttgttttgacaaattcatggtctgcacctcccccaaaccagtgcatttctaaacagacttgtttttcctctaaatagctttgccaatccggccaacaccccaatatttctttatattttgaaaagtaggtctttcacctgctgataatggaggatccaattctgtgtaaactctggaattctatttaaaattgcagattttaaatgtagggaccaagacaggatgtaggttgtgtcaacttgggaatgctgaatgactgaactgtcatgacatttacaatccagatgtcatggcaagctgggagacaagacagcttggttgataattagatggcagatgtccatgcagtctcacgtgatacacgttactttttgtatattcaagatttgggactttagccctgaaagataggtgatacatcatcttctctatacaataaaaaatagtttcaataattgtatattattttgttttgctttttttctcatttatttggaagtagcaaatacaagaaacaaaaattactcataacccctatttttggtgtatctctatgcaggcaaatatactgatgatgattattttcattttttgaaaatttagattctcacactcaattaaaaaaagaaagcctgaggaaattaaatgatttctaaaatcacccagctaattagtggcagaaatgagaccagattccagtctcttgctttcccgaataccttattctggaattcaattataagtacaaggcatcccactcttggcttcctttctgaataaatgcttgcaccaaatccccagtggcttcttgagaaagctggctacaaatcttcaaagcctcagttgaagaattcttattaagcctactaggtaccaaagcaatagcctgaagtttggaaaaattctagttggtgaagctagaattttattcaatttaaagaatacttggtaggggggaatgtaatgaattcactccctagcctttcttgaactctacctatttaacaccctatttctaatacagcagcttctcactatagaatgttaggtttatcaaatctctcttccaccctgttatacggcattttccatcccttggatgtttcaagtccaggaccttgggcttaaaggcaaaagtaaaatctattacacatttgtagctttgtacaccaatcagggaaaagtagtaaagtgggctattatgtacattattttacaatgcagtatgttagttgtcaattgttacgcaagactaattttttccacagcaaaaaataaagctattttaaaatattttggaagcaagtcatggttgaagagaagcatcccttgaaaaattagacttaaagctgcaaacttcccggggttgacattagcttgaacttgatgaaaaaggaaaaattttaggaggatttgttcagctgtcttctgagttatgaaagcaggaagaaatgagttttacatattgcctggaggtaatttgtgtacatataagtcaaaaacaattaaacttcaaacttcacacacagccactgtcctgtaaagggtggtagtgtataagcagaagaaaaatgactagaagagaacagggttataaagcatccagacatttcccatgtgaggatcttgaaaaacttctgcagccctgtgactggattctttctcctgatctaatagggctgtttggaggaagtatttctactgctcttgagttgttgctagttttcctttgaatatcctgctcagttccctgccccagttcaagcttccttccaaaatgtgtttaaaataattagctcttcctgttggtataggaaaaaattagtcacacataattggtaattcacatattgtattataaaataatgtacaaaattaccacccttacttctttttggagggcctgtggcttgtaccaatggatttatcttgttccagggcattgagaaattttgccttactgatggcatcaccacttacatttctcaacatctttgcctcccatcagaccaggatttcagttactaggtatcctaccttgttccattgatctgagaccctcattaataccctagctgacagtcttaactcagcactgtcttctattttctaccaaatagaatacaataatcagatacattttactctctcttctgaataaagatattaacaaaatttccatgagtacttataagggtgagtttccagaccaacctagatgagttaccaggatatatagtttgaaatattaactttaaacatttcttgatttttctgaccccatcaggtattttttggaaactggtattaggcttgtagaaatggacaaggagctctaccatgcttgaagatggtttaagccttcagcaaaataattgagagcttcctcttctgaatattccgaatacacaggtctatcagttagtgtatcatgttatgtgtagatgtgtgttggggtgatcagatccaacaccaggtcgtgggggtgacaaaggccggcaattcaaaggaatgagaaaaagacagtttgagagagaaagtgggaccagggggccatcgcgagtgtggaggctgtgaaggccccaagttctgggagcccatgttatttatgggtgctcaaacaggtggtgaggatgtcgagtgaatgagaaacatatggctgtttgacataatgggagtactagaagcaagaagccagcaagtctagcagacatgcaagccctgcctcagcttctctcccaacactcagcttttctccaacagatgtgtatgaataaggcttattaataacaaagcctggctccacaggtgagagggaagatgtaacttaatctactggaagtcaccaacatagccctctaaaatgagtcattattttgactcaaaaatgaacagattaaaaaatgtttcagctaatcctcttagctatttgatgtacatcaagcatccagatgttcacaacatccaagctgcaattttttgtgtgttatttaaaagttttacacttgcatatattattcctttcctcaaagacaaagtatagaacccaaactggactttttaaattcactccttaaaagtgtggtaacttaccattccagagctggtgggtccccgattattggcccatgggttgtccactttgtggttttgctgttaggaaatgttggctgatggcttccttaaccactcagcagttaaccaacaataacttggaatgtgtctaataagtgcagcctaatcttaattttattgggagttatctcagctaaataatggaaaatttgacaaacctaattaatgaattatccactgttaaatcttctgtgccactgagtcctctttttagtaaaatgattaaaaacattaactatagtggtatataattactattaacaactattatgccaatatatattgttattcctgcctaagatactatgtctcagcacggagtttatattaggtattttattttaacagttttctaattgctgccactttttcgtcagattgcatattttgacccacaacattgatttcaccttaatgtcaccagtgggaattaattatctgaagcttggcataatattaattaaatccatatgtcacatcatggtgtggcattcttttctttctttcttttttttttttaagtcagggtctccctatattgccatgctggtctcaaactcctgagctcaagcagtcctccctggttggcctctcaaagtgctgggattacaggtgtgagccaccatgcccagcccattgtgcagtgttcttacaaaagtattctaacaatccaaaatcaagactacttccaaaagtggcaggcttcatatagaatccaacattctgttgcaatgagattgggatgagtgggtttagaccaacattgatatcaaaggccagtttccctttaaatcaaaatcacctgtaaactagcatcttgacattcaagatcccaccagggggatctagctgggaatgtcaccatgcatgtcttgagagagtgcattagcccacctgcagtaggttgaaaaatatcttccaaggataatttcttaagctgtatattttaccttatttagaaaaagggtctttgtgagtgtgattaagttaaggaccttgagatgaggaaataatcctggattatctgagtgggccctaaatatcctcaaaagtgtccttataagagtgaggcagagggggcatttcccccgccacacacacacacacacacacacacacacacacacacacagaggagaaggtgatggaggcagatactggagtgaagcagccacaagccaaggaatgctgacagctgccagaacagtcaagaaacagattctcttttagggtcttcagagagaatgtggccctgctgatgtcttggtttcagctcaatgatactaatttcaaatttctggcctccagaactatgagaaaataaatgtgtttttgttttgttttgtttttttgagacagagtttcactcttgtcacccaggctggagtgcagtggtgcgatcttggctcactgcaacctccgcctcccgtcttcaagtgtttctcctgcctcagcctcccaagtagctgggattacaggtgctcaccaccacgcccagctaatttttgtatttttaatagagacagggtttcaccatgttggtcaggctgatctagaactcctgaccccaagtgatccatctgcctcggcctccccaagtgctgggattacagacatgagccactgcgcccagccaaatgtgttcattttaagtcactcactttgtgccaatttgttatagcagccacaggaaactaatacaatacttgtgccaacttaagtaacagcaccagccaaagtacataaagtggaaataaaggtatttttagaaagtctcattactataaaatatggtgtaaataaaaacagatctgaatatgcaaattgaagtttcaaaataagtctcctgccatcccatttcaaagacactggaaatcttaagctcttttctttacaaattctgaaactatcattgcctgtgggttgggttgaaatgaaggcacgtgggtgtttcaagggtatgttctgtgacaaagagacagaatagaaaaatccaaagtcatagcctggagctaatacagtaatatgaatacataaaacaggaaggacaagaatataaaagtgaatttggggacctgagaaagtcaagaaaatgattggagaaatacaatttgggagaccactttagaacccagccctcactgggcatggtggctcacgcctgtaatctcagcattttgggaggctgaggcaggtggatcacctgaggtcaggagtttgagaccagcctggccaacatggtgaaacccgtctctactaaaagtacaaaaattagccaggcatggtggtgggcatctgtaacgccagctactcaggaggctgaggcaggagaatcactggaacccaggaggcggaggttgcagtgagctgagatcatgccactgcactgcactgcagcctgggtgacagaacgagactctgcctcaaaaaaaaaaaaaaaaaaaaaaaaaaaaagaacccaggcctccaatggtgcgatcaggtgccaggtactcttgtctactgtgctgaccatatgctgttgaggtcatcaccagctacgggaaagggcattctcataggggcaagcccaactctatgtatcttacgttatttaccactatttcccaaataaacctgtttcaaagaataccatctttaatgtctttcacaggtacctatcctccactctgcatccttttccatgctatcacttgcagtgaaggtctgttcaccccttttttaacctgtcttccatcttgagttccaatttccagctgccctctgaatatgtccagaggatgctggctgctgcctcagactcactggatgaaacagtttcctgttttctttactaaaactgccaaccttccttttccttgtttgagttagtgtatcactgtcctctagcccctgagctgaaaccttggaatcatctttcactcctccctccccctttatattcagtcaactgacagtaccaatatttcttctcttctccttttatttcttttgccactgtcctactttgggcactaatctctcttctgaagtataacaatagcctcccaactggccactctgctttagctgctccatggtccaatctcccttgtcacatgtgttatctttcccaaacactgtcacaacttgtcagtctactgcaaaactttccgtgactcctggggggcctgcaggagagagtttcagatttctgagtctgccttcctggctcttcacaatgcagcctgagtccatcttttcaaccgtctctctggatacataccaacacttgccctttgtctcaatgaatgtgcctgccacttttgtatctccttacctttactcatattgtggtttaactatgtggttgtcttctccaccctgacaatagatacatctattgtccatcagcccaatttacaacttttgcatctcttctgatttctatcctctgctaatgacacttattaactactgcctttccactggactttgcatttagttttttatatatatatatatatatatatatatatatatatatatatatatatatatatataaccttacttctgcttttaaacatagatcattatttccatgtctaccttccactttctccaacactagattgcaaatttctacagggtgaagcttatgttttcatcccttaacacccagcttaaatgtcacctcacatactgactaatgctttttatctcagttctaaaacattattaatgtacatcacataatttaactccattttgaaaattagttcttgttccagtatcttatctcttaaaatagactggaaccatctcaaggttagagaggatccactatattaaattcttatatatccctcagtagatggcactttgttggatgatttaattgacgtatcttcttaaaaaataaaaatatctggctcttcaaataattagctttgtgacctgaggcaaatcatttatcctctaggacatttagtttactacatggtgaaataaatgataccttcattccttaaatatatagatccagtgacatgttgctttgaatcacagaatttggtttcgtgctaaatctaagaccaaaaacagagcacaaacaattcagaatcaacagcatgctttctggaagcaatatgaaaggtgttattaatagaattcagcattattctaatttcctcttaaaatttcaagaaatatatctgacatttgtcctgtcattgtaagttgaaatatgtgtgtgtgtgtgtgtgtgtgcatgtatatataattttttgttgttgtttttgagacagtcttgctctgtcacccaggctggagtgcagtggcatgatcttggcttactgcaacctccgtcccccaggttcaagtgactctcatgcctcagcttcccgagtagctgggattacaggtgtgcatcaccacactcagctaagtttttgtatttttagtagagatggggttttgctatgttggccaggctggtctcaaactcctggcctcaagtgatctgcccacctcagcctcccacagtgctggtattacaggtgtgagccaccatacctggccaaaatgtgtatacattacacacacacacacacacacacacacacagagtatgtatacgtatatatctgtatataggtaagtgtgcttatatgtatatacacagacatatacacacacaacatatacatatagatttgttgtctagatattataagagtattgcactaatgtttctataaaacaccagttcacaggcttctgtcttctaacaatatccttatacatatttgtcagccactatttaccttaaaatgaaacagaggggagcctgatatataattacggtcactgtgctttgttctattttgtttatccctttgcaatatagtgtggcagacagaaaaatgtatgaaattaattcttttggtttagaatgacattcctatcattgttagaacaagggattacattatacactacctctaaactcaaattttctgagcactttaactattaaatagcaataacagaaagcattgtaaatcttttggagttttgcatgataatgtacctcttgttaattgaattgagagatgattgccctatgattacctcgattcatttgctgcataatttaccataatgataattaactccttgtactgaatgaggtaagatgtgtgttagttagacaccccctccctcccttcttgcctttccttctttccctccctattttagtgtttaaccattttacacacaatttgagacttgtttcagaatctctccacctatattatcatgtcaatccaagtatttctaaataaaagtagaagttgggccatgtttttaaaatttctagctaattgcctgctacttggcttattgttgtgatctaattatgttctggtttttgaaaaaaggactattgcctggcccactgtatgacatttgatttatgtagtctcacctctccctaaatagcccatagttcacaatgcagcagagcctatattaccgcaatttcttctgcactgaaattagacaattatgaagttagtagattattaaactaacgtatgctttataaatacttcttcattctaggataagggagaaggaagtatactgtaattcccaatatgtaaatgccctcacacatttgatagttgatggttccattttttagatgaaaaaactaaagcacaaagaagataaacaatattttgttctgccctataataaaataagcaggcaaatatttatggatatgattctgggttgcctcaaaactttcagggtcagggtaggcaggcagttggagatatgagataatgttagccatgaattgtggctatttttgtggcacctgggtgatgagtccacggaggttcatcacatgattttatttacttttgtatgtttcatattttctataataaaggtattttaaaggaatatatttaggtatccacagtgtgtgacacctgtcaaggagcacatgctagaggcctggctctgccagtgacataggctacgtgactgtcggtgggtcacaacttcctagacttcatttttccctcattaaaatcaaagtattagaagagatcagtggttcccaaggaggtggagttgcttagggaactgtctaaaatttcactgacaactcagaaatctatttggatttagaagctggaggggaatgtatatttcaaaataacttctcaagtgactgtactgtgaccattccttacacacaaacttgggctaacaatgagaatgacttaaccccccaccccacaacactttaataggtttaggatgggttctgagaaataaagatttttaaaacattccccaagtgattctaataggtggtcgacatgccatactttgagaaacacttttttagctcatctcagggtcccttccaactctgacacctcatgatattacttgagcattcttggttctctgcttctatgatgtactattccatgagcaactggagatttagttacaggtgtatacaagtgtacaggagtcaagaaaatgatgctaagtttcttgcactgactgaggaagcaaggtagaagcagactctggcttaattggaattcatgtttgaggcctctgggccctcactaggaaaaatattcaatttatatgtaagcatatgtataatacacatatctcaccagcattctttttgggaaaagagaatttccaaattaaatttaacctatcaattttatactgactaagatgaacacattattttaatatattgtttcctcttgcttcctaatacttacattgtatagagtttcattctttatgctaatcctaatgcatagattggtaaattgagattaatgagattcttcctttactaccacctgtttttaaccaaatgcctacatgctgcatgagcaggaaatgaggtgactactgttgttggccacagagcttcaatatgtcgtgaacaagggttagatgtgaatgtcagaaaaaatgttatgatcaatttctgcctccaacaaggaactacaaatatgggtcacaaaagttctactagtagccccaaatacattttttgaaaggagacaatataaataaagctgaaaagcagtcacaacgctttaatgtgtcattctcttcttcacctttctatccacttagatgtttcctaccccccaaaaatgaacttatgtcacatcacacttgtgactcccactgacatctaaagtagtgtgagccacacagatagaagcacaggtaaatgcctcaaaacctagttattatatttgaaggaatttctgattcagtagtgtttctgtaattgttactaacatcaacgcttcgcttgcttctaggaagacaggatggtaaattcctaacaatggaattgcaaagttcacagtgtgctttaaggagtccctttctccataaacacagctcttgtgatggctttgcagattttgtttctgcatttagtgtagataagttgaacaatcctaattcctgagttctaactagtgatagagcacattatattgttaagaataatggatgttggagaaagtcaggacaaaagtaggtatgaggtgtccctggtatgtggccaataggaaccacggtcctgaagtatccggagcagtccggacatcctcaagtagacccaaatcagccctatcaggagccaacagaaaagcttgctagggcaaggtcagaagataaatttattagccaggaccagtttaagtcaaaagttgaatataagtcatatctttagaaaaaaaaaaaaaaagcaggtagaaaggcacattgtttttagctaactctacaaaaagttcagagcgaaaagaaaaacagtgatgcagaactaggggagaaattaaggagcaaacattccaaaaatagaatgagttgtacacttggttaatttcattgctcagtgatgcctccatagaccagattcttctctctgccatcctcagaaataggctctagggatgctcttagataggctattctgtatgcaagaccttctgtagctgttctagatgccagatcctgaaatgacaacattcagtgaacaataatagctcttcttctacgtcatttccttagatgtgaagaaaccatttccagcaaactcccctcatgtccacaacacctcattaatcaggattaaatcatatgttcatttctaaaccaataagagaaaaagaagtatcgtggctatattatactgaaatgcaattgattttggagagttaaaaacaaatccaaaccagcagcagagcctggggagaatccacgtctccttctcaatccacaagacatgatgggtctgctgcagtgtggtactaaatttggggttacaagaaatttttggcttattagtttcctagggcttctgtaattaagtaccacacactgagtgccttaaaacaactgaaatgtattatctcatagttacaaagtctagaagtctcaaaacaaggtgtcagcagagccatgctcccccctgcaatctgcaggggaataatttcctcttcctagtgtctggtggtttgcccagcaatctttggccttttttggcttgtagttgcttaactccaacctctttcttcctcatcacatggtgttctccctgtgtgcccctttcttcatatggctatcttcttgtaagacactagttatattggcttagggtctcactcaactccagtatgatctcatctaacttaacaaattacatctgcaaccttcctatattcaaataacttcacattctgaggtagcggggattagaacttcaacatatgtatttttgggtggaacaaaattcaagccataacaggcttctatagacctctctagttttactcagtctagatcccaatccatggagtttgaccaaatgagttagggtgctattccctaaacttgctgaaacataataattgctagaggcccttagtaaaatacagattcctggccctcacaacagatgtactgaatcagtctctctaggggacatgcctagaaatctgctttttgacaactgcccagttcaattttatgatgaagcaagtttggaaagcatagagtcagggtgctgagcactttttgagcatctttgagcactttttgaccatgttattcctggctgtgaaagaattctttttgtatgaaatctcatctacccataacaagtcttggaagctgctcttgtcatcctcatcacagacctgcagaaatggaggttaggtaagagtggggctggaaatggagctaggtccaatctcaaaatacatactttttcaatcatactaactcatcatgttagtagtaagttaaagaatcttgaatcatatggtccactgtagtttacttttcttgccttattcccaggagttttgtttttatttgttcttgtccttggagggaacaaaagacagctggtagctgttccctgtttggttttgcatgtattcaaaaggcatcatcttctactgctctcttactcctttactttgtggtcatttgttttgcagctatttagacagttacttcttaaagaacccctaaaactatttagacagttacttcttaaagaacccctaaaactatttagacagttacttcttaaagaactcctaaaactaccatttgttcctctagaaaggattaaagatttgctgaagcaaagttctcctgacactttacctagagcaaggctgaaacaaaagctacctacacctgtattttccttctcttatccctcaagtacacaatagggcatttggctctcagcagttgatgccaagttctgctagggaagaaatgagacttcagagctccctacaagttgaaatggagtcagaaaagctacatatataaatgtcagaaaagctacatatataagctacatacataagctacttataaagtttctgcaaaactacctcaaagggcaggtagttttgcagaaactggagggacactgttttctggagcactctgccactaggattttacttttagtgtaatgaaggatcactgaagacttttaaaccagacggtgacatgataaaatttcatttcagaaatttcatttctgaaaattatgatggctgttggaaaaaagtagattggaagaagcaagaaaatgctaggttacttcacaacttctccaggaaaatagtgcagtgggagaaccctgaactcaggaaatatggcccatttcctgcactatgtttcccaattcaaaatatcctattgtggaattctacagctcaagtcaagagccccttctgaactacaaaggacaaggactgatctactaaagccgtgtagtaaatgtgaggaatttgcctaactcagccaattgatgtgtcaaaatctaaccaatgtgtctaataatctaacatatattgttattgatttcaggttttaagaaccagttttctaaaaatgaaaaacaaaatcaaagcactctagaggaagtaatcatatgtttaatgtcataagtcactgattgtatacttaatagtaaatggtggatatgaacttgggccctggagtcaaacttaggtggctcggtcatgcccttgatgtgtgtctttgggtgggctactgaaactctgtcttagtttcatctataaaatagaatgctaacatcgactttatagggttattgtgaactctaaataagacaacaaatggaaacccaacacatgttctcactcaaaagtgggagctgaacacgtagacatggggaggggaataacacacattggggcctgtcggggagggggagggagagcatcaggataaacagctaatgcatgtggggcttaatacctaggtgatgggttgatagctgcaacaaatcaccatggcacttgtttacctacgtaacaaaccttcacgtcctgcacatgtagcctggaacttaaaattaaattaagtcaaaaaaagctaaaagcaagctttatgccaaaaaaaattttaaaaacttaaaaaaaagcgcctcttaaagttataagggagggtacacagtaagcacttagtgagtgagtgttgtggttgctgtttttcttaataaacatatttttatccaaattattaagcagaaatattggactggaaaagggtaaagtgtggattattaacggttgacattggaagagcaaagagatagagatgttccatgtggttcctttgccaagccatccagatactcacctccatccttttggtcatttcccctaatacacagtatatttatgatccccttctgacaaccccttgaagagttgcttgcctcctgcacagtgctgagttatggacgatgcatttgaagccatatattcactctgtcttccccacatgtgcctagtaactatggcagagctcaataaagaagaggccagtggcgggtttactcatttttaaaaaaatttccttgttgttcttttctgtgattgtaatggctagcactggtactctttccctctctctccccttcttttgccatagagctattgtcaaatgtacaaatacatagtgaattgcgatggtttctgggactgacagagagaaggaacctgttttccccataaatgctgtagaatgaagggtttgcaaacattgtgattgtggcagattaaaaaaaaaaagtcaagcaggctaaattgaaagggaggcatgagaaaagctggtgcaacctgtcagctcctggtccgaaagaagctgatggtattttttttaatattgtgaagagaaggaaaattttttatagtaagtctatggatctgctttaggaggcttttctcttgatctaattgagctgtttgaagtgtgcttgaaagttctcacccagcctgtgtcagccacctgcctgctacaagctgtgagaagttaatcgtcttgggcattgttaggaggagactgtctggtatctgatggctttccattctgaacaagggtgtacggatatggaaaatgtgtgtgctcacatttgtctttggggtgtggggctgcttcactatgcatgagagcacatccacacctccatccagatggtgcctgctcatagtggcagtgctagataaattcatgtcaaacaggcagataatccaaaaaagcaactgtaagtatccacattgctgttttctgcttccaagcttcagtgttgtttttttttttgtagtgacagggtattactatgttgcccaggcttgtctcaaactcctgggttcaagtgatcctccagccttggcctcccaaaaatctgggattataggagtgagccaccgtgcagtgcctggttttttaacatgctattcccttgcctgaaacaaccttgccatttgccatcaacactggcttcatcttccaatctctttgcctgttgcctcacattggatgtcaccaatctgggaagcctttgtcacccctcaccacattgaggtgaggggtacctcatattctctccctgttccttgatttcccattcaaagcacttaatgcaccaaacatttttttttattgcatgtctgaatacattccttagtagttcaacattctttgaggttatatcatgttcatcacagaatttaaagcaatctcctgtgtatagcagattgacaataaattagctatgaaaacaaatgaataactatggtttgggaagaaagacattgtctgagcacacagaattctaactcatgacttgtgcactgtcaagaatcacttgctttcagataattttgatgagtctgattttacgcttttcagtttgtatgtctcatgatttgtccttaatagactgaagaagtcctagcccttataattgaccagtgcctggtaggggaagggcagcagagaaggactggattagaaccatctcaaatgcttctattctgattagtacttagggttggttggagagtaagaatagggactcagcctagttgaaggaaagcctgtatagtggtgagtctgagtgacaaaccagggagaagtaataagacaatttatttctatttttttatcctacacctgaaatgtaaacaaggacacattaaatttttactggttagcattttttaagtaattatgtgctcaactatgtccttatatttgcattcttaccaatgtagactctgttatggaagtaacccatgctgctgctgcctttggacctgaatctctttttgcccttgtcccatttgtgaatttagactttcagcaagttgtctttatgattctctattctatgacatactttgtgaattcatctgtaatcaaatctgtttgatgaaggtcacaaaagctaagtcaacatgagacctgaaagtagaacctgggggtactgattttcctacccattaggaaacagcctccccacccaatcagggcaggttatagtattcaatgccatcttgtcttattgactgagtcatacatctctcattccgcaaagtcagggtcctaaaatacttctgtggagtcgcaaggactcttcctcattagccatctttgactttgtcattgatactattttctacctgtttctgataattaaaaccccccaaaaagtaaaatgtcagggtgaccagagagaaccttagataggacagctaatctcttgcttctagagaaaggtatgaaaatatactgtgcttattatggggatgatggtatgctctctgaattgaaccttaccttttaacatgaaatttctaattgaaacaaagctgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtatcctcttttatttcattgagcagtggtttgtagttctccttgaagaggtccttcacatcccttgtaagttggattcctaagtattttattctctttgaagcaattgtgactgggagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaataccctttatttccttctcctgcctaattgccctggctagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacattgattgatttgcatatattgaaccagccttgcatcccagggatgaagcccactcgatcatggtggataagctttttgatgcgctgctggattcggtttgccagtattttattgaggatttttgcatcaatgttcatcaaggatattggtctaaaattctcttttttggttgtgtctctgtccagctttggtatcaggatgatgctggcctcataaaacgagttagggaggatttcctctttttctattgattggaatagtttcagaaggaatggtaccagttccgccttgtacctctggtagaattcggctgtgaatccatctggtcctggactctttttgcttggtaagctattgattattgccacaatttcagatcctgttattggtctattcagagattcaaattcttcctggtttagtctgttttggttactgcagcctatactacaaggctacagtaaccaaaacagcatggtactggtaccaaaacagagatatagatcaatggaacagaacagagccctcagaaataacgctgcatatctacaactatctgatctttgacaaacctgagaaagacaagcaatggggaaaggattccctatttaataaatggtgctgggaaaactggctagccatatgcagaaagcagaaactggatcccttccttacaccttatacaaaaattaattcaagatggattaaagacttaaatgttagacctaaaaccataaaaaccctagaagaaaaccaaggcattaccattcaggacataggcatgggcaaggacttcatgtctaaaacaccaaaagcaatggcaacaaaagccaaaattgacaaatgggatctaattaaactaaagagcttctgcacagcagaagaaactaccatcagagtgaacaggcaacctacaaaatgggagaaaattttcacaacctactcatctgacaaagggctaatatccagaatctacaatgaactcaaacaaatttacaggaaaaaaaacaaacaaccccatggaaaagtgggcaaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggaccaagaactagaaataccatttgacccagccatcccattactgggtatatacccaaaggactataaatcatgctgctataaagacacatgcacacgtatgtttattgcggcactattcacaatagcaaagacttggaactaacccaaatgtccaacaatgatagacaggattaagaaaatgtggcacatatataccatggaatactatgcagccataaaaaatgatgagttcatgtcctttgtagggacatggatgaaattggaaatcatctttctcagcaaactatcgcaaggacaaaaaacaaaacaccgcatgttctcactcatagatgggaattgaacaatgaaaacacatggacacaggaaggggaacatcacactctggggactgttgtggggtggggggaggggggagggatagcattaggaaatataactaatgctaaatgacgagttaatgggtgcagcacaccagcatggcacatgtatacatatataactaacctgcacattgtgcatatgtaccctaaaacttaaagtataataataataataataataaaaagaaatttctaattgagttgcctaagcctgcccacctgtcattctcatatgcctaacacgatgtgagattttatatatacagtcctctgtatatatattcacaggttccccatccacagattcaaccacccatggattcaaaaagcaaagcaaacaaacaaaataacaacaacaaaaatacaaattttaaaacacagtataacagccatttacacagcagttatattgttttaggtattatacctaatttagagatgatttaaagtacatgggagagtactttaaaaaaaaagtacacaggcatgggggcagtggctcatgcctgtaatcccagcactttgggaggccgaggcaggtggatcacgtaaggttgggagttcaagaccagcctggccaacatggtgaaacccctgtctctactaaaagaagaaaaaacaaaaacaaaaacaaaaattattcaggtgtggtggcacatggctgtaatcccagctgctcgggaggctgaggcataagaatcacttaaaccagggagaggcagaatttgcagtgagttgagattgcatcacttcactctggcctggacgacagagcgagactccatctcaaaaacataaataaataaagtacagggaggatgtgtatagattatatgcaaatactgtgccattagggacttgaacatctccagattttgtatccacaggggtcctggaatcaatccccttgatggatacagagggaagactcactctcactctctcttgatatatatatatatatatatatatatatatatatatatatatatatatatatatatatatgcacacatacacacacacacacacacatatatatacacacacatacacacacacgtatgtatatttacatgtatttataaactgatattttattcaaatgtttcaactggcccctaggaagaaagatccactctgatgtgttctggctctgtgtgcccacccaaatctcatcttgaattatcatctgaattgtaatccctgtttgttgtgggagggacctctcgggaggtgattggattatggaacggtttccgcatgctgttcttgtggtagtgggtgagttctcacaagatctgatggtttcataagaggctcttcccccttcgctctgctcttcccttctttaagctgccatgcgaagaaggtctttgctttcccttcatcttctgccataattgtaagtttcctgaggccttcccagccatgcagaactgtgagtcaattatgcctttttcctttataaattactcagtctcaggtatatctttatagaagtgtgagaatggtttaatacactctgtaaaagcaaaataatcactcttcagaagcagaaaaaaactttttataagtgactcaaagtcaagatgacccatttctcatttatatgatataaacctatacatatcctctcacgtactttaaatcatctctagattagttataatacctaaaacaatgtaaatgctatgtaaatgcctgttatactatgttttaaaatttgtatattttgttgtattatttatatttttgttttttgaatctacggtttatatgaatatcattctctctccctctgcatctatctgtatctacatatgtatatttgtttttttcttagaacataacctagattcctctacagtgtaaatcccttgctttctggttttctgcctaataaaaggctctcatttctatcttggtctggaaatacccccacttccattttttatgaagtaaaaataccgaagatttttttttttttttgctagaagtagtttactgtctttctctacaactcattctaatatttttcttttcaactccctaccattcttattgtcttccagcaatgtctctatgatcatagagagacaaactgcagccacacttagccaggatcatttacatttacttgcatggctctgtgtagcttgctttttatgctaggcaggttcctgaatagtcagataggaattgaattcttggaaatcatgccattgtttaaggatgaggaagaacttactattttaatgaactttattataaaccttttttctaagcaaataatcaccccttactttatcttatctcctatgcaaatcctgattttcacatttaagctttacttaacagtgtcaatttgtatagttatctttaaacaatggtcagtccccactcttataattgaaaagtaagtaattttcatttactttctggcttctacctccagaaaatctcttacctctatctttattttggtaattctcttgtagggactttaatagcccctggaaaatcatcatagctctgcttcaatctgaaaacataactggcaggcatgagtctggaacacatacgagggaacgaagtacccagagccaagttaaatgaactgttgatgacttttctgaaaatcatagtaaaccatgatttcctcacaaaatatagaagtgtctgatttttggcatttaattctcaaacatactcagatacactttccttcttcctctcccactctgggttcatatcatcatataaatcagaaatgggtcatcttgcctttgagtcatttataaaaagtttttcttttctagctctgaagcgtgattattttgcttttagagaggatctttctttctggggccagttgaaacatctgaacaaaataaaaatcaattgaatatggatatgaaacttaacttgtctttttaccattaaatatatatttgaaaaatgtgctcttcttttatagcttttgtcacatcagcatgtaccaattccaaccagagaacgaaatattaatattctgccccaaagtgctgttttccagcctgtgccaaagcagataatgccagtaacagggagttttccaatctaactttcttataccagtcaaattatccatttcaaaaaagcatccagtcaaagtgctcccaataagtgaatattttgcctagagaattttgggcttgagttatccatccctctgaccaaaatctataagcccactcacccaggagatctgagaatgaaactaaatataaaaactggctttactactgggaacccgaaagttcagctagtgagggaaggaaaacaaagaatagaatgttttccgacaatccttgcttttgtgagtggtcagcagatgttttgtgcctctgctgtattccttagctaagggttcacatgaaatgtaccctctgaaggctgtggccttgttggaacgccaaattagtagttattcctcatgctctgaggtctagcttcaccttcagaaccaggtgagcttggtccccacaaagccctactggtacttaagcttcccatttcaagaggacatttgggttcactacacctctccaagccgtctgattaattgcagctgtgtgcaaattagttttcttcaggggctctctcctgctctcagattagcaacaacgtattcagatggaaagcaaataaagatagttgtaaaatgaggacacaaaagagatgcaacatgtttgctcttgatgggtgcattgatgtcagaacaactagggggaaataagaccaccttggtactgttatcatcgtcctgatgatggtcccgtcttgcagaaaagcccaaacagaagcagggcgttgtctaatcactgatgggtttcctgatattattgagaagaccaagcaaaattaatggtgatattatatctggtgaaattattataaattctccctgcagttttaattagctctgctctttttctcctcctgttttaatccaaagcatatgtgtatgtttgtatcagcaatttcaaaattctgtgaagcatttggtgtcatccatctagtttcaaaataggtacagcatgatgcagtgggaagaatgctagcctagaagttaggactcctgagttcctgcctaggtctgccgctaagctgtagtatgaccttggacatgacctttcaggaccttgatttcttcttatgtgagatgaaggattaaaatccaacagtttgttaaatcactctcaactttttagatactattaagtttaggatcccgtggagaggcctatcatccgagagaccatcctatcatcaaaaggtgaatatcaggtcaaagcaaaagaaaccacattaatttttttctgttgtcagctcacaaagctattttaagcctttggacaataagaaatatactttttttcccctccaataaatatacattatccattaaagtagagtgtgttgtgaactgaccttaagggaatttgctagtttttttgtttatttttgttttttacaggaaactaagtcctgtggaacaaaatagaattaccttcatggagcaagtttaacaaattgtcttcatttttggtcagcaggttgatttctaattccctcttattccctttatatgtatttttggcttcctgtctttgttttgcgttgctataaagaaacatgtgagactgagtaatttacaaagaaaagaggtttattagggctcatagttttgcagcctgtgcaagaagcatggcaccagcatctccttctggtgctgcccctaggaagctttcactcatggcagaaggggaaggagagctatgtgtagagatctcatggagagagagggagagcaagagagaggataggaggttcaggcagtttttaacaatcagatttcatgaaaataaaagaactcactcattacctcgaggaaggcaccaagccattcatgcgggatctgccccatgaccaaacacctcctactaggccctacctccaacattggggatcacatttcaacatgggatctggaggggacaaatatccaaactattaaattcctaaaggacataaaagggtgaactgcacaaggatactatatctccaaacaaatgcccagttaggtccaggacgtgttcaacagtgtccaaaatccaaagagaaccagagatagtgtggcttagtagaaggtaaactgattatacacactcagcattgcaagaaaccttaacgggactgttgtccaaccacacaagcattattcaaaaacctttttacctctcaaggtttggttttctagcatgggttgccaagctacaactgcccagagaagtcatttaaactgcaagagactcagctttctcatccttggaagagagaaattggacaaaattatctttaattttttgtttgccttaatatcctcttattctactaaacattttcagtattacagaaatcagctcttggaggaaaagacattgcagggggtgggagacaaagttggtgataccatgtaataagatttttttagatagtggcaagataaaatgttttgaggtttggcaaaaccatctagtagtttcagttctccctgacagtaagaagttaaggaggccaatttctctttcaagtcagaacttcttgttataactgggtagtaaacatactttttaataagaagtggctaaggcttaagaagaccaactgctgatacccagaaatagccaaagaatacttcattactgacagtgcacactttgatagacctgtcttttactattgacagtattctttctctgctgtttttacaagaaaaaaagcccaatgaaatgtaaaccttgttttcttcagttattggtcctaggagtattcagagtaaataaaaaaaaaataccttacgtatacttctataaaatcttttatttgagcaattaaaaaaagctatcttctttcagtcttatcaaggagagcaaattcctcctagaagtcttatttctacttctaatgacaattgctttattatgtgacattcaaaggaaaaacttgaagtcatatttctagtaaagtatttaatttcagaaataatttaaactgttacttcaaagcaaatatctgctattcctgacataaagtttttacccaagcttggtaataaagttatcataagaataatatggattattctcaggatggaatagaatgtcttgattaggaagaaacacacataagaaattcatttttttggaagaaagaaaatctgtgctgtttatctggcaatggaagtcagatcaaaatatatctatatgacatttgaatggggtcacgtgggaagacaagatctgtctgtatgaatatttttagcttctgaatttgacataagaataggatcaggaaaatgaattctgtgttacatgactaagatgcatattagaactcaggcaagatgattcctgtagttggtctactgggaaattaccctctgcctacagctttcaaatacatatatatactatgtgtgtgcatgtgtgtaaatttccaactgagtacatcagcacataaaatacacttgtccaaggtaaaaaagacaaacagttattaatagggcaaaaataaaatggggttatatccaaccatggcataatacttctcattagaaaaaagtgtggcgagctaattaagacccagtgatagttagaaagtctgagaacatttatctttaaaaatggagtggtaactaactaaaagaaggacccagaacctcctaatacaaatatcagttatattccctgagatttaaaaatataataattcttatttctaattcaaaggcctagagtgtaagtagggataacttaacctttttttttttttttaagcctctgtgagaaataacgcagctgtttggcccgtggtattctctttaaaggaaagaagttacaaagacaagaagaaaaaagtggaagagaaaaataaggagaaaaaatattcaaacagtacataactaaaaaaaaaatttttcacaaacagcaaggggaatcttgaaacaaaatagatttgttttaaaatgcaaagaaagagccttacccgggatgaattgctcagttctcttttgttggttgagttcacttccttccatttctgctaactttgaccagctgctaacaagcaaaagagcttcatagaggccatctacacgtgttctcttctgggttatcgcgatgctgacaaagtgcacctaccgcaaattagaagagcacaaagatttctgtgggtatgcctgcaaaactctggctgcgaggcatcacctcagctcagtagccttggatttacatgtgcctgcccccctgcccatggttactgagggtggcctgaggatggattcacttcataacccttttccataattatgtgaataacaaatgagctctatccaatagagaaaaagaacacattttaatactttgtgaagtgatcatgaggaaggggacagaggagttgagatggccaagagagatcccgccctctggagatgtaatagaacagtgacagataatgcaaaaaaagatttaatatatttttatatatttaatatttgtcttctgttgttgaccttagcttttgagtcaacagtaactaagaagcattttgtcatccgacggctcctcttcctttggccttctgtattgtattatctgataaggaagcagcgaacttaaagctcagttcaacgcaatgatccttcatcatagctgggtgtgaagaatgttgttccctcaaatatgacacaaattgtttggtcaatagagaagagaactgcattctatttttttccaaacatctgttatactccaaaacctttctccttaggccatggctgtctgaccaacagtaggtggatttctttgaaatcttatcttctgtagaactggatctcatcctggccaacatggtgaacccagtatctactaaaaatacaaaaattagctgggcgtggtggcaggcgcctgtagtctcagctactcgggaggctgaggcaggagaatggcgtgaacccgggaggcggagcttgccaagatggcaccactgcactccagcctggcaacaaagcgagactctgtctcaaaaaaaaaaaaaaaaaaaaaaaaatagatctcactagaagtattctcaattcagcagtagtgtccagttttgaatcaaataatttatattttgattatgtgtattaagaagctaaatctactcatatacaaaaggaaaatctttagcttttcatgtgttctggctaaaggccagaattaaaaggaagaggatgtcttatctatcagacatttttgtgcctttgaagccataaacttgagagaaacattagcttgttcctgaccctgcactcagcataagcatttgcttgtagcagtcactcttgggtgactataaattcacaaagtcaagaatttgcatcctgaattgatttgtgtaagatgtctaggggaatgctgattttatattggaaacaaggttagggggaagcctcaaaactgcctttatggagttctgtatctcagcatattataattcttacttctaccatactccagaggaatcagtctgggtgacttcataaaacagtattagaaaaattgctagcactacgaaatcaagcaggttatggcagtatattccttgtaagaaaattagtgcattaactctttccaataagtgattgaattagttttgcacataatctgatttatgaaatgctgcactcgcatgctcaagtagttagaaagtgtgtcgaagcagatgttgaactgaagaaagaaggttgcttgaaatgtaaaggtattataaaatggctaatctgtgggtatgacccaaagctttcagagatttcctggcttcactttttttttttcaatttaataaattttttttcttaaaaggtaaaattgccaatgagttaaatgttgatgctctgatgttagcaagactgagttcatatgtccatcgcttattaactccattttcttatcaatatgtttggcttctgtaagtcttattttcttgtttgtgaaaggaagatctaataatagaactggccttatagaattgttgtgaggattaaatgtggcaacccatggttattggtttcgtgcgatgcctgtcacaaagaaaaaacccaataagttgtagtggctatttttcatcttctcattatcaccattacttaagagagaggcaaagtgatagtatcatacaaacattttcatggagagttaaatgaacatctgttttttcttttcttcaattttttaaaaattatactttaagtcctgggggacatgtgcagaatatgcaggtttgttacataggtatacacgtgccatggtagtttgctgcactcaccaacctgtcatctacattaggtatttttcctaatgctatccctcccctagcctcccaccccctgacaggccctggtatgtgatgttcccccctccctgtgtccatgcgttctcattgttcaactcccacttatgagtgagaacatacggtgtttggttttctgttcctgtgttagtttgctgaaaatgatggtttccagcttcatccatgtccctgcaaaggatatgaactcatccttttttatggttgcatagtattccatggtgtatacgtgccacattttctttatccagtctatcactgattggcatttggattggttccaagtctttgctgttgtgaatagtgctgcaatagacatacatgtgcatgtgtctttatagcagaatgatttatacatacgtgtgcatgtgtctttatagtagaatgatttataatcctttgggtatacacccagtaatgggattgctggatcaattgtttttaaggacaggttgcataaaactgactaatgccattcatgacagtgagtttcaaaggcagatagctatcttagtccatttagggtgctctaacaaaatgccacaaagttaggtacattataaacaacagaaatgtatttgtcacggatctggaggctggggagtctgagatcaagaccctggcagatgtgatgtctggtgagagcttcttcctggttcatagatggcgacttccagttatgtccttacatggtggaaaggacaaggggtctttctgcgaccagtttttcaagagaattaatcccacttatgaggtctctgccatcatgacctaatcacttccccaaaactccacctcctgataccattacactggtgattagctttcaatatataaatttgggtggcggggtggggcacacacattcagatcatagcaatggcagctaggaggaagtaaattttgaatcctcatttccatgtaaagacttcatttgctttaaacaatttatttaacttttattgtgctttttctgaaaatgaaataacatttagctacacacagggagggtatgttgtttctaaagtaaaaattaactcttttgtaaatgtggcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgcagccatgttataatctttgttttcatccaggtaaagctgagggaagggaaggagaatccactgagaaaaagattttccccaaagagtgactcagcctttgaaaagaaaatcagctatatgaaaagggaagagtatttaatcattcggagcaataattgcattgtaaatattagctcagctgataaggagtagagaaccaagagaatgagggagccgttacattgttttatcttgtttgatgcctttactcagtgctctagcatgggggccatgtctagggagggaatccactgcagctacatttaaggtcacctaataaaccgtgctgttttctttcttttcttctagactctattccttcattttttttttctgaactttaagcaaggaaactgccagtcatagagcatttccttatacacttccatgttactgttatgcagagaaatctgactggcaggctgatggccaggctgctctggaggaaagtaattagctatgtgactttatctaggccaaaaaaatgggataaaaaacatgcaaaaccattcacctatacagacctgttctcaaggcagtgtttaccctagtgcatctgctaattcctttcaagtctggaaaactgttttgtttgacatttttggaatgctgtgatctgaaccattagactatttttttctcctttaaggtactaatattctgatttttaaacaattaaatatgctctaaatttgtctcgcccacttctacatcttcttccaacatttacatagacatccatgcacattcatgcacaccacacaactacaagtcatttcagacaaatggtcttatctaattctttttagtgtttccattttattatttgtcaaattgaatggaacttccatgttttgccctgctgacatttaggcagacttgcataaaatacaagattatttctagctggataagaagctcagctatcagatagtgttgctgatttatacagtaggaggaaggagaaaagaccaatgggtgagtataataaatagaaacgtcctgaagcaattcacttgtagcctatccaaatcttgcaaactctgcataaaacatcctcccagttctctttcaatggaacaatttttcttttctttttctactcttcactgaacatttcctgtattctacatgcaacagtgcaccttttacattcgtttggcttatgtgctcttgcaataaccctttgctgtgtggtaatatctcatttgtgggaacttctgtgacactattaggggacagatacaatggctatgtgcctagcaatgccttcaccgtgctctatttaaatagattgctcatttatttgctactttgctcatcaccctgtctctcattcactataatatctttagcaaatcacatagtgccaggtaaataaatggtactcattcaatattgaccatatggatgaatctctgcttatgaaatatgagagccccgtgcagggtcattctgtccaggaactcatcttctctggcggtgtgagaccatatgtttaacatgaccagtaaggaagtagaaggaatcttccactactttttacattcttttttctttcaaaaagttttgtaaacttcaagtatgtaaaaaaacagttcttatatgttcatacagtttgctttcaacaataactccacacatgtgcattgacatgtaaagatgtttccagtataaagtagaaaaaaatgggttttaaacatcatatataaaattaatcaattttttaacatatagcatacctgtattcaggaacatgttctttggttattctcatttaaacagtcccctattgttgaatacttgatctgtttctattgtttcattttatatataatatatcctataccaaatatcctaatataacttctctgtgtgcttgtctaattattttgtttagataaaaggtttcatatggtgtccacttcatgccattatgtgatatgatttgcctctcagcctctaggaatgggtttttctctaaggatagtggctgccactctatctagtggctgaagtaatatggcttcatgtcatgtggctaacgattcatgccaaaggttgtccgcatcttatgtatcagtgagttatctgacacccctaatagacgcttatttcttttttcaaaaagcttgttcctgagctgaatttccatgatcagatggtggcaagagccaagtcttctcacataaagagaaatcacattgaatctgctacctacgaccactggccaaggggtcttgtcatcattgcattctggggaattggattcaatttaaaaagttgaagctgcttgctggcttccttcctggtagttttgaatgtgtaatctcacaaagatcttcttagctctggcaaagctgagcctgtctaaaacatttatgttagaatttacatgagttcatttgtgctggcgtcaaacatttcttgagtatttaccatgttattggctgatcttaaagccaagctacaaaggactagtaggggttagcaggcaggcaggaagaagaagggcatggttggcagagattgccacatgcacagaatatagtggtgaacctacatggtgcatttggaattgcaagtagtctggctttgctggaagtgggtttgcaagctgaggagtaacaagaaataaggccgaatagcataccaggaagtggtagatggcagagacccctggatcaccgtgatacttatgacactacttgctcacttgttttttggtttatttcctgataagctttgagccagaacattaatgcaaattcttgttcttgtgtaaaaattactgcaatgacttcccattgctcttggagaagacaaaatccttaatatggcctacaaggtccagtacaatctgtctcctgcctctgtagtcttattcttcactaggtctgccttcttcctcccagccctactggggcccattctctgggcttcaatattacagaccttactttaatttcactaatgggaaatgttgctgccttccaacaaagggcttttgcatgtgctgtttatatgaaatcctcttttcttcctgccactcttgcctattaatgttcttatttctcagcactcacgttatttttttactcagagaaatcttccctgagttccctgaccatgtcagatttttcacttatatgctgtcataacctcatgcatttctcttttacagtgctataaattgtcagtgacacatttgtgtaattaagtgatgaatgttcctttcttcctaataagtaacatcatctataccatcattattaaatcagccagcatcagctggggtacttatcatatgtcctatactgttctaaacacattatatgtattaattcacttaattctcataacagtccctattaaatggataacactgaggaataaaaaaagtaagtcacccaaagttacacagctgataggtgatgaagttagaattagaaatcaggggggaggagccaagatggctgaacaggaacagctctggtctacagctcccagcgggagcaacgcagaagatgggtgatttctgcatttccatctgaggtaccgagttcatctcactagggagtgcaagacagtgggcgcaggtcactgggtgcatgcaccgtgcgcgagccaaagcagggtgaggaattgcctcactcgggaagcgcaaggggtcagggagttccctttcctagtcaaagaaagtggtgacagacggcacctggaaaattgggtcactcccacctgaatactgtgcttttccgacgggcttaaaaaatggcgcaccaggagattatatccctcacctggctcggagggtcctacgcccacggagtctccctgattgctagcacagcagtctgagatcaaactgcaaggcagcagccagactgggggaggggcgcctgccattgcccaggcttgcttaggtaaacaaagcagccaggaagctccaactgggtggagcccaccacagctcaaggaggcctgcctgcctctgtaggctccacctctgggggcagggcacacacaaacaaaaagacagcagtaacctctgcagacttaagtatccctgtctgacagctttgaagagagcagtggttctcccagcacgcagctggagatctgagaacgggcagactgcctcctcaagtgggtccctgacccctgacccccgagcagcctaactgggaggcaccccccagcaggggcagactgacacctcacatggcagggtactccaacggacctgccgctgagggtcctgtctgttagatggaaaactaacaaacagaaaggacatccacaccaaaaacccatctgtacatcaccatcatcaaagaccaaaagtagataaaaccacaaagatggggaaaatacagagcagaaaaactggaaactcttaaaagcagagcgcctctcctcctccaaaggaatgcagttcctcaccagcaacggaacaaagctggacagagaatgactttgacgagctgagagaagaaagcttcagacaatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgatgcgatcaactggaagaaagggtatcagcaatggaagatgaaatgaatgaaatgaagtgagaagggaagtttagagaaaaaagaataaaaggaaacgagcaaagcctccaagaaatatgggactatgtgaaaagaccaaatctacgtctgattggtgtacctgaaagtgaccgggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcagcagaaactctacaagccagaagagagtgggggccaatattcaacattcttaaagaaaagaactttcaacccagaatctcatatccagccaaactaagcttcataagtgaattagaaataaaatactttacagacaagcaaatgctgagagattttgtcaccaccaggcctgccctataagagctcctgaaggaagcgcttaacatggaaaggaacaaccgataccagccgctgcaaaatcatgccaaaaggtaaagaccatcgagactaggaagaaactgcatcaactaacgagcaaaataaccagctaacatcataacgacaggatcacattcacacataacaatattaactttaaatgtaaatggattaaattctccaattaaaagacacagactggcaaattggttaaagagtcaagacccatcagtgtgctgtattcaggaaacccatctcacatgcagagacacacataggctcaaaataaaaggatggaggaagatctaccaagcaaatggaaaacaaaaaaaggcaagggttgcaatcctagtctctgataaaagagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagattttaacaccccactgttaacattagacagatcaatgagacagaaagtcaacaaggatacccaggaattgaactcagctctgcaccaagcggacctaatagacatctccagaactctccaccccaaatcaacagactatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacatactagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctaccagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagagaaaaagagagaagaatcaaatagatgcaataaaaaatgataaagaagatatcaccaccgatcccacagaaatacaaactaccatcagagaatactacaaacacctctactcaaataaactagaaaatctagaagaaatggataaattccttgaaacatacactctcccaagactaaaccaggaagaaattgagtctctgaatagacgaataagaggagctgaaattgtggcaataatcaatagcttgccaaccaaaaagagtccaggaccagatggattcacagccgaattctaccagaggtacaaggaggaactggtaccattccttctgaaactattccaatcaatagaaaaagagggaatcctccctaactcattatatgaggacagcatcatcctgataccaaagccgggcagagacacaaccaaaaaagagaattttagaccagtatccttgatgaacattgatgcaagaatcctcagtaaaatactggcaaaccgactccagcagcacatcaaaaagcttatccaccatgatcaagtgggcttcatccctgggatgcaaggctggttcaatatacgcaaatcaatcaatgtaatccagcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttcagctgataagcaacttcagcaaagtctcaggatacaaaatcaatgtacaaaaatcacaagcattcttatacaccaacaacagacaaacagagagccaaatcatgagtgaactcccagtcacaattgcttcaaagagaataaaatacctaggaatccaccttacaagggatgtgaaggacctcttcaaggagaactacaaaccactgctcaagggaataaaagaggatacaaacaaatggaagaacattccatgctcatgggtaggaagaatcaatatcatgaaaatggccatactgcccaaggtaatttacagattcaatgccatccccatcaagttaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaagcaaaacagcatggtactggtaccaaaacagagatatagatcaatggaacagaacagagccctcagaaataatgccgcatatctacaactacctgatctttgacaaacctgagaaaaacaagtaatggggaaaggattccctatttaataaatggtgctgggaaaactggctagccatatgtagaaagctcaaactggatcccttccttacaccttatacaaaaatcaattcaatatggattagagtcttaaacgttagacctaaaaccataaaaaccctggaagaaaacctaggcattaccattcaggacataggcatgggcaaggacttcatgtctaaaacaccaaaagcaatggcaaccaaagccaaaattgacaaatgggatctaattaaactaaagagcttctgcacagcagaagaaactaccatcagagtgaacaggcaacctacaaaatgggagaaaattttcacaacctacttatctgacaaagggctaatatccagaatctacaatgaactcaaacaaatttacaagaaaaaaacatacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcaggaaacaacaggtgctggagaagatgtggagaaataggaacacttttacactgttggtgggactgtaaactagttcaaccattgtggaagtcagtgtggcgattcctcagggatcaagaactagaaataccatttgacccagccatcccattactgggtatatacccaaaggactataaatcatgctgctataaagacacatgcacacgtatgtttattgcggcattattcacaacagcaaagacttggaaccaacccaaatgtccaccaatgatcgaccagattaagaaaatgtggcacatatacaccatggaatactatgcagccataaaaaaggatgagttcatgtcctttgtaggcacatggatgaaattggaaatcatcattctcagtaaactatcgcaagaacaaacaaccaaacaccgcatattctcactcataggtgggaattgaacaatgagaacacatggacacaggaaggggaacatcacactctggggactgttttggggtggggggaggggggagggatagcattgggatatatacctaatgctagacgatgagttagtgggcacagcacaccagcatggcacatgtatacatacgtaactaacctgcacaatgtgcacatgtaccctaaaacttagagtataataatgataaataaaataaaaataaataaaaataaaaaataaaaataaaaatacaaaaaaaaaaaaagaaatcaggcagactggatctggaatctgttctcttaacctctctctctgctcaccggtaggttatagacctaacataaagtagttgctcaataaatatttgttgaaagtataaatgaataaactaattaataaatactttatatgtgtcccactcttaactggggaaaattgggtgggtagatacaaaagaaccctagtagactgttcgctggcaggaatgtgttctagaggattggggaaagagaaacccccgaataactgtacgtgatttatgatgaaaatctttcaagtagtggaaagttataaaatgctaaccaaaagattagttatttggtttatatgttgatcactgtgatctttcccaatattgactggggtttgttgagtgtctgtaatcccacaggtggatgttcatgatctgaagtgacaatggtatatttgctcagcatttcctgtacctgaaacaacccttgaaaactgaaatagaaagagcaagtcaatggtaatatcatccagcactctgccaggcttatggcgaccttgcttacccgaaagcaaattacttccctctcatttctatataataagtactttacggctttgtgttttcatgcattgagatttccctaggagtctgagaagatgtccaggaataaaagagggaagaacaatgattaaactatttctaggactttagacattggattatattcagaaacccataatcagaccgttaatgaatgtcttcgcattcattatcagactctgaaaaagcatatccagtctctccatggactggccttcacatatgctttgctatctggtagaaatatctgcccaaaagattattttttatggaaataatagtgcacatgcagattctagatattattttctatttatcaactgcattcaggcagtgctaagtagatgactgatgctgaaattttactagatgatctttgctctctattttgttatatgacacatggggcaaatacgtgagatgagcaattagtgaaattctggaagggacagatttatgtcatactattgaaagggacaggaagtggattaagtatgatatatatatagtatgtgtgtgtgtgtaggtgtgtgtgtgtacgtataacaagttagtttccttttcctaccactgaaattgttaaatggaatggtgacgtagacactttacttctctactcctggacttactagtaaagaagaaatatataaaagagcaagatagtattgatctggggtggtactatggtatgtattaataccataccgtaattctatgatctattaatgtcacaaccagctacatttagctggcttttatatacgaatgtgcatagtactgttttgtattaaatatcaccagaagatatttgtcacataaaaacagtgagattaatgtttatatattttggcactcatgctagagttgaatgaggttctgtctgtggggataattctaggtatcctggaaaacctccacatatacaccaaacccagaatcaattcagataggcattactgttcgcagtcatctaatttcaagttagggtagtaggatatggattggggggcgtgattcttagtgccagagaaagattaaattattcatagggaaagatattcagcctaagatggataagactgaaatcaggtgcctggactctagaggattgggctctaaccgaaaaaaaaaaaaaaaaaaaaggagaatccagtaggaattcattgagtaagccaaggttacaatctgctggacttcagaggtagagttctagatgcccattttaccaccctaggtcagaagtggggagcagagagacagaaggctataagtgaggagacagtactgagacactaagtagacattctagccaactctgtagaggattctcatgttatgagctgaagtagaaaggctatgtttgaagattctgtctgattttgggcatcttggttctagatctatcataggtgcagattaaattgtttccaggctgtacttgatagttggtaaggatcaaacaataccctcacataacttgtcctagaactggttgtgctatggcatcattgtagtcccacatcctagcatggagcctaaaaaaaagtaggttcttcataaatagccaaggaatgaattaatgagtgatgggatgagtgtgagtggagaaataagcaaaattcctagaaatatggggtgggagtatggcagacaaacgttggcatcatccttcaaggaccagatcaaaatgccacatttccactacagctttctctgagttaattacttctctccactgttactatggtgatgtatttattctgctttaatagcatttatcaatcattttgtggttatattttatgatttctctcttcctcctagactatgaaatccttgactgtagaattgttggtttgtacctacattactgcagatagtatctggcaagggctgggctctcaataaatattgaccaaattgaggctgtaaagattccaatggaccaatatggcttgtgacccatgcttcatttacctaaatgaggccacaaggctctgtgatcacgtggcagtcaaataacaaaactctccaaaatcaggatttcttcttccattccttcaggttccctcccccatgggcatggttatctcatcctttacctcctggaaattatatattggaggttgtcagtgtgtgctgttctgtattgccctatagttaatgcacttctctgacgtagaggactgagctctctatagaactatgcagtgtcaaggaccctctgccttgacatagatgcttggaccacactgttaggtaactgagaagacaaagaatgtggctagaggctaaaagggacagagcaggaaaagcatgaagggcatgaaggaaggagcttgaatttttttcccaatgtactggggagcccaggagtggcatcactttgtactccagcagtgacattttaatttacaagccaagaatgcactgatcgccaactgcaaaaattgatttggttgttcatctgattcaacccatgtcagagtttgaaagtaattatgatagtggggctgataggcaggcaattacatttttgttctcttgctttctggctccttctccctctctttcccttcccacacctccacctgcaaggttgttcttgtcaggaaggcaatgtaagcaggagacgagagagtaatctttggagatgtggtatatggactcttgtggcagaggctataataaataatagtatggctggttctttatcctaatttttgttagcctcttatgaactctaaccagataaaagatgcaaactattttgtctccttctttaaagtacaaaatagaaaaagcacatgtactgtaaggcagtttctgtttctgatttaaatttgagttgtctttgcaacatctatagattcggtgtctttctaaaaaggtttgctccaaatcataatacaaaaggaacctgggatagggagagatttaggcaaagctaaaatccatctgagttggggagcagattccatgggagactgaaaatgtgtttcaaactgtagtgcaagaaattgaacaaagtattggaatttttctaaaaaaaaaaaaaggttcctttgctgaaagtagtacctggcatgtaaacctaaagtaatatagaagatgaagtggaaaagtatatcacaaggcaaaaattactttttagactgatgaagagatggatggatggatgtgaattttttttatctatttcttattttgaaggttatttatttattcacaaacactggaaaattcagtgtttttcactgagcaaaatagcttgtctggtccaaagccagtaaaataagaattttgtgggtggggtatctactccattagtatagcaaatgttgagatatataaattattttaatatatttattttattgacaatataaaaaaaaatttaacaggctccacaccaaggtcaatagaattcagaagcacatctgtcctcccaggaaacttgtggtttaactatttactatagctacctcaagattttacagaaaaaaaaaaaaatgagaccttctcttgaaaactaccatatcccagatctaggcttttctatgcactgtaacttctctataaacctcctttctactgactgccccacttcaatttggcacatacaccctttaaccagtaagcatgtgcatgtagtcagtgtgtcagacaggtttggctgaattgatataagactggtagcataggctgggcgtggtggctcacgcctgtaatcccaacactttgggaggccgaggcaggtggatcacgaggtcaggagtttgagaccagcccggccagcatggtgaaaccctgtctctactaaaaatacaaaaaattcactgggcatggtggtgcgcgcctgtaatcccaactactcaggaggctgaggcaggagaatcacttgaacccaggaggcggaggttgcagtgagctgagatcatgccactgcactccagcctgggcaatagagtgagactctgtctcaaaacaaaaaaacaaaacaaaacaaaacaaaaaaagatgagcagcatggaacatgatgttggcatgaggccctactacccggcagcagactatcagggaataaactagataaacctggaaaatgttttaacttcagtttattttattcacattaagtaatggagtagcatgttgtttgtttgtttgtttgttttacctctaaacctcctgtatagcccccttttaaaagaagggcaggggaagaggcttaaaatatggtagtattgactcccaggcctgttcagtctatacgaattttcaggctgtatagtttaaaaaaaacattgttcaatttcttatacgtttttactagtgatattactttagaaatgggcctcgaaagactcaggttacttttagatttgttcagggtttaaagcttcttttaggcacttcttgggcttcttctacctttcactgtaatatagtggtgaagagaaagactttggaatctgatagatttgggtcagaattgtagttttgccactcattacctttgggtaaccaagctctgtgaacctcagtctcttctgcaaaacagaaatggtgacatatttcctaagtctcttggcaggattaaatggaatacagtgcacaaaatactcagcacagtgcttggcacatagtaaatgccgaattaatggcaatgaattgttgttgttgttgttttctttttgagacagagttttgcttttgttgcccaggctagagtgcaatggctcaatcttggctcaccgcaacctctacctcctgggttcaagtgattctcctgcctcagcctctcgagtagctgggattacaaacatgggccacccatgcccggcttttttgtatttttagtagagacagggtttctccatgttggtcaggctggtctcgaactcccgacctcaggtgatccgcccacctcggcctcccaaagtgctgggattacaggcgtgagccaccatgcccggccaatcaattgttattgatttattactgagattgctttaaataaattcatccttatttctgttgtagtctttaccttgtctccagatctttggaagtctcaggttcatttgtctggactttgggggttttgtttaaaactgcctagtctctgcagccacatcctccaccactgtagcacatgatcaaaaaacttttctctgaggatactgagtatttcttagacctatgtcactagctccctgggaactctctctacccccatcccatcaactctctgaccacaagttttcaaggaatcttcctcattatactcatctatcattcttgcagttttctgtctcatcttgagctgttggtcaagagtagaccagagtatccatttctcaactcatttcttaataaggcaacaccatgttcaatgggcattcattgggccagttgaggctcctctgtaattttattttattttttgagacagagtcttgctctgttgtccaggctggagtgcagtggtgcaatctcagcttacagcaacttccgcctcctaggctcaagcaattctcctgcctcagcctcccaaagttctgggattacatgtgtgagccaccacgcccacccttctctataatttaaatgttatctctctttataacattttcataagaggatccacaattctattttcccattcacttataaagaacaaaaatatatccctaaggttccacaagtacctctggcctttggggaaaaaaaaaaaattcacagatgcttttttgaggaggtaattatttgtttgttgtgtccttgctattcattttgagatagatactcaagctctacacctcttagcttatataccagtttcaaatttatgtctttattatttattataaaatcttttaccagctgggcatggtggctcatgcctgtaatcccagcactttgagaggccgaggcaggcagatcacaaggtcaggagatcgagaccatcctggctaacacagtgaaacccggtctctactaaaaatacaaaaaaaaaacaaaattagccaggcgtggtggtgggtgcctgtaatcccagctacttaggaggctgaggcaggagaatggtgtgaacccgggaggcggagcttgcagtgagtcgagactgcgccactgcactccagcctgggcgacagagcgagactctgtccctaaataaataaataaataatctttaccttgaatattgagatgggttcaatacaatctcaatttagaatacttaaaagatgaaaagttccataaaataaattttctaatcaacagaaaacattttgttaagatgttgctgatgcaaataattctagcatgtatcactgttagttttctatctttgaaaactatcattcaactaccatcgtagttactagacttccattcaggatcttgcatgcctaagagtcatttcactgccaaaaatgaggaaatatagaaaactgagctgtgtttttatcatctaccatttcaaaaaaccctgtggaaaaaatatttcttttagcaaatctcagacattatcttgacttatatgtaagatgtacctctctctttaaatccaagtgcattgaaacttctggctcataaggtaatttttttttttaaataattaactaaacccttaaaactacatagaagtctactttgttttataaattaaccccattattttaggaattaatatagctttgtcttgtgagatgctgaagttatttttcctggttcttaatattcagtctttccgcttatctatttaattcctgatcactagccaaactatatactacagtttggttcatccaatttaaatagctggcctgtaactaagaaaagaaaaatatattttgtgaagaataggtatgaggtagagaaattagtggtagtatgatacgggaaaagagtaatgtcaaaatgcatggtaatttatgtgatatgccgaggactgcaagaagtcaagaaagaaacataacaagctaacagctgtcaccaacaaatagcaattaatttcagcattcattcccttgctcatgcttcatgaaagtatataggtaaacaggattcgtatcatgttctattttcttctctgggcctcaggcttccagccctctgagctactgtcttataacattctgaggatgtaagaaagaacttgatcctgttttctttttcagtctggagcagagacacggtgaagttcagtaaggtctgacacccattagcattttgtgtgactcaggatacgaatcaaacctactgttgtggaagcagctttccatataaatctaattcccaccaactcctgccaccaccaaagctaatagtcaagtgcttgtattgctgatagcaaaggtccaagattattcttattgttttactggggctacttatcaaaatctatttacttgtctattctatggatggggaggtggtaaagaaaaggcttaagtgtcctacagagattcattctatgctgcctcaaatgctttgaagcagtacaatttctcttttaactgcctcgatgtaggtgaagagtcttgcaggatatgttcactgctgaagagcaagcctgcctcattcataaccactagtagctgacaacctttggattctttccacagcttgaaaattcctccattccttgaaagcaccctgcactaatgctcgaagtattaagtgtgtttttatttcctagaaggatgcattttacacaagtcacttaaaagcttctggaagctttaattacaggttgactaatatttagaagaattgaaatacccctctctctcctctgtggtatgcatgagccagattctggttcattaaccagaagtctattacttttcccctatagtttcatggagtaaaatggtagatgcaaaccaagagaggtcaagggacctgagcttggttctgtctttgtcacaactaagagtctgaccttggatgagtcatggtaagactctgtgtcatatataaagagtattctgagagtaaaacacgcatacaaatgaaaagtatggttattatggtctcttgaatattcttagatcaatttcacccattggatggggctagtatatggttgatggatggtatttgtttcatttatctggcatgcatttaaatcttcaggtgcattaaacgaacaacacaaatttggtatatgattttcatgctctcttgcatgatagatataaaatcttaatcagtgattgtctggaaaccacagtctccaaaatgctgcctaggagtgctaaagagctgtcagatctaacttatatgagttgacaacatagagaagagaaagaagttgaattcagttaaacctggaaggagaaacccatagggtggaattatctgaatttgaatttttctgagttttattcccccctacattatgacacactaataagtggtctaccttgacccagagatacgaattttggcctcatttgtagaatagcacctggattcaggaataactccttgaagtgtcccccttaaatctctatgtggcattcaatgttcacttactcatagaccaaggagataaggacatttatcttctcaggtaaggtccctctgttgaacactgaaacaaaggggttacattaccactgcctatctttcagaaaaatgactgctgtgatagcataaatgtcccgagagctttgctttgatagaagtgtgtttttaatgatatgattttggtgtctggccctctgtggatagcttggcatgtgtcttgttctatttaaacagcactgactgataaagtggacgttaattggcagttagtgacgaggctgcaggtctttgttacccagcctttcagctaactgatcattaactaggaggaaatgtgtgacccagaaggtcattactgttattacgtgggaaaatacatttaaatgttacagattgcttttttatgaatcaggtgagcatttttagaaaagagagagcttgatttacaatggagtctgttttcagtcctgctcttttcctgtccctttgaagactaaacggtatatttctagattcccattgctgtattgcctagaacctcacaatgttgatattgactaaaaaacagaaatttcttcaactccattaagagcttttccaaaatcttaaaatttccaaataaaatcctttcgtctggatgccactcactttaacaagctttgagtaactttttttaatgaaaatgtgatagaaagtaatgtaactgcatatgttttattatgtaaaattctgatagtatcatgtatgtctttagaatttccgttgtcacacattgtctgtgctttgtaggattttgcagattaagccttagcactcattttgtgaggacagtgaatcctaattcctcttcttcattctttctgtgacctttttgattttgcctctttagtaatctcctcactgcccttgtaatgcaaaaaataagaataaaaatggtctgtttgggtgctgtgagtcttggcaattaaaacttcacatgaaatttgtctcctgagagaaaatattattctcccttttaataaaaggatacaattaaatactccctgaaacctctctccttcaaatatattgtcttatgtaaaagatggaaatggagccttgtttagctgaaaaactgaagagccaaaaacatttctaactataaattagtttatgcatattaaatatcccagccttagctctaataaaaacaaaaaaaatgtgaagcatggtgtgctctgtggttattaacctgttgttgaaaccctgacttcagttctaggcccttagcatgattacttctttccttctttgggttgcatgatgcttcaaggtctagaaatgccaatgtctttcccaaggggttttaccttttacctctgaagattgaagaaagcaactgagttgttcagaaatctctttaaattagatttaaaaggtactgggtttatttttgcatgtcttctttattttttcctccaaagattaagattgtattttagaaggctcttttggctcctttaaaaagaaagtttatccttgtatcatataggactgaaggagataggctgcagtttgaaggcaagagcatctgatctccaaagaatcagaaaatctcttcttttgttgcatttgtaggtactttttgttgtgttgcttttttttttttttttttttttttaatacaggtaaagttcaaacgagcacagcatggtccaaatggtgtttaaagctgtctaagtttcctttatgtaactttcacttcaacaagtatgttccagctgggagtctatcgggctgttaaaattaactttattcttcttttgttattctcatgcacacacacatacacacatgcctacatgcacatgtgcacacagacacacaggtgtgaacatgaccatttaatcacatccagcagggctgaatgtcactctgcggggctttattgactgttgtacaggctaaacatttcattcagttgcaagacagaaaaactctgcaggatgaatttcaaaacagagagcagaattgttacccacagataagaattctttgtaaggctttcaccttctcataaaagtgttagttaagaagaggtgaaaacaggtattccattcatctctgaagtgtatgcagtaatggcctcattcggctgagatttcccagcagcaaaaaatgtgcttggcagaacagttgctctaaatacctgggacatacattctttctaggattaaacaaataatacttgctgccctttgtataaaaagatcacttttctggtgcaccattagtgtacatttgatttgatttgtttgttaagcagcaaaggtgggtttccctggagccacttacacctcctctcggtcctctttgcctctggctgtatatgcatgttcattctaccacctgatgacttcatgcttactctgtgttctaactaaatcgaatgagtctcttattcccattccttcctttttactttcctgcctctaggcattaatttgtgccatttacctggactatctgctcccacctttgactattaatatcctatttattattctatcaaagccaaagaccatcatccccatgaattcctctgacatcccactcagaatctatctctctttcctcagagcacagttttttttctttttactatcatttaaggacagttaggccaaacacttacctacttaattataagcttcttgaggatttgggccacttcatatggcttttggttttccccaaagcattagctccaaaaagaaaggttgaatgaatgattggtgagtcatcaaccttggcatagttgggactaccctttgagaccactaaccagaatttttctcaatgaaatgaaatttattccccgacaaattgactgcaccatgttagtctccttaacatcatctgctgaaccatctcttaagaaacactttgatactagatggtaaataaccactgtgtcaagacctccaagtgccctttacctccaggtcacctgtgttcctgcagcaagacacacctctgtccccaccatgaggcagaatgaggcttgggacagataagacttccagaacccagctccagcactgtggccactgtctgattaatcagttcttcttctgcactgataattaaatactcactgttaaattttatattacccttgctagtatcattgttataaccaatgtgacagccacaaaagagaattaaagctatagactgtttatggactgtcttcacttcagcacagcagggaagaaaccagggatctgaataagtactagggatccttgctcattttcccaatttggctacaaaagttaatgaaattggggccaacgcttaaaatgcagatattgttatggatacattttatgatataaatagagatacacttgtttcatggaggggtaactagggacttagatttcatttggacctatgtgtgccgagcaattggaagcatattaaaactgttttatgtgtaagcatttattgcttttgcctataagatgttgcttatgtgggaaattaagagtccagtccaatgtattcctgggtatacagcttatgaaggcatttaaaacctaaagcatatttattctgcatttaaaagtgtttagagactgccttgtgtgttaatgtgtgctgtgcgactagcactatttaaatcctatccccctgcatgcattaatgtgtgcgtcgaagggaagaagagcaagggatgataaactctgttaactgcccaatgttcaactaagatttatgtaagaaagaacagtctagtgcattaatgtgaatattctaagatagatgtttatcttaatggactcagaggtacttacaaacagcataattgctgaagtcattttacagggcatttattcagagtgattacactactcttacttttctttacataaagaattccacttaagggtttaagtgagacaggctagtgtggccaaagaatcataggttcctcctatctgctgctcagcgctaaggctatttgaaaggaggagaagcaaaaccccaaatctccattttggcactttgcaagaaattggtccaaatgttcaatcactccagttttcagatctacatgatatttgacttactttaaacctatagtcctgcaaataagaaatttatctctctggtacatggttgtagaattcaaacattagttgtttatggacttttatggaccactgaggcattttctgtcttgaaagcaaatgtactcttccagagaaactcctgttctttttttaaagttttatttttaactgacaaattaataattgtatatataggtacgacgtgatgtttcaatgtctatattcattgtggaatgatcaacccaggataattaacatactcatcacctcaaattctttgtagcaagaacatttacaatttattcttttacatgaatgaattttaaaatatataattttgaaataggcaattcattattaactctagtcaccatgctgtgtaatagatcagaatctacttctcctgtctgaaactttgtagtcttcaaccaacatctcctcattccccattgacctttcctttctcagcctctgataaccaccactctactctctatttctgtgagtttgactttttagatttctacatacaggtgagatcatacgggatttgtctctctgtgcctggcttatttcacttagcataatgtcctttagctccatccacattgttccaagtagcagaatttcctgctttttaaaggctgaatattattccattgtgtgtgtgtatatatatatcacatttaaaaaattttattcatccattaatggaaaaccttcattcttgaaaaaatagcttataaagctatttatgtccctgatacctccaaagatcagaatgagtaataatctcacaaggatgggaaatacttcctctcttccaccttttgcatgtccatcctttgaacatgactcctggtgtgttagtctagtctgttctcatgctgctaataaagacatacctgagactggctaatttataaaggaaagaggtttaatggacttcacagctccacatgactgggggggcctcacaatcatggtggaagacagaagaagagcaaaggcacatcttacatggtggcaggcaagggagcatgttcaggggaactcccctttataaaaccatccgatctcatgaaacttattcactaccacaagaacagcatgggaaaaacccacccccatgattcaattacttcccaccgggttccctcccatgacacgtggggattatcgcaattcaaggtgagatttgggcaggacacagagccaaaccatatcacccgtcttacccaattctgttgaaataaacagacatttcctgagtacctgctatccattcaagttttttctatgagctaggctctggtccaggagtatagtaaccctacgggtgatttcagaccaataataagtaacactattaagaacacatcacagaagagtaacatctctgactcgctgatatccatttcaaaccacataacaatagcatgaagtagatgtcactgactcaaattaacagaagagaaaactagggtgcagtgtttgtgattaccttggactctcaccataatagactgagctcatgttttctgactcaaaacacaaaacttttcccttgatatagttgcctctagaagaagtcccttgtctccctcaaatagcaatcaagtagaagggaaaatagtgtaagtcaatatatattaagtactttcagtgtgattccaagaaactattgagttgcgatgctaaagggagcattttatttttcagccttgggatcagaaaaacattacataaagaagtgtttgggttggaccttaaaaaaaggtataccatttcagcaggtataaatggaatgaaatgcaaatagagttgggtaaggagcagtataagccaaaacataaagttatgaacttaatacccttgttcagagaattgaaaacatttaatagtcagtatgtggaggcatttatagggacaaatggtaatggaagatgatactacaaaattacactggagtccagaggtggaggatcttgaattttaattttttttaagtctagacttttgatagtgagataaatttgaaccaacagagtgaaacatgaaaactatatttttatcctggaagtactttctagagttcattaacaggaggaggtaagggtagacagggagtctgggtagggaattttaggattcatccacataagcaaccagggaagtaggaatgaaaactggagtaacattttagagatggctttgcaggacttggtgcctggaggtgtgacggggagcaggaaggatttgttacaggaaagaggtcccgacttagaccccaagagagggttcttggatctcacgcaagaaagaattcagggtgagttcacagggtacagtgaaagcaagtttcttaagaaagtaaaggaataaaagattggctacttcatagacagagcatccccaagggctgctagttgctcatttgtatggttcttgatgatatgctaaacaaggggtggattactcatgcctcccctttttagaccttatagggtaactactcttgtcccttgatgatatgctaaacaggccatggcatttgtgaactgttatgtcgctaatgagagtgtagcagtgaggatgaccagaggtcactctcatcgccatcttggttttgatagattttggctagcttctttactgcaacccgctttatcagcagggtctttatgacctgcatcttgtgctgacctcctatctcatcctgtgactcagaataccttaactatctgggaatgcagcccagtaggtctcagcctcattttacccagctcctattcaagatggagttgctctggttcaagcacctctgacagatttaaagatgaccctgagagtttgggcttgttcctagagagtaaggacaccatagacagaggccaggaaggcagcagagggaggagttaatcaattcagtctgggatatgctgactgctcatgtttccaagatatttaatcaaaaatattgtcccttatgtgttagtctatgttctattactataaaataaacttctgagactaaataatttatagagaaaagaggtttatttggctcacagtctgtaggctgtacaagcagtgccagcatctgcttggcttctggtaaggcctcaagaagctttcactcatggtgaatggcaaacagggagcaggcatgtcacatggtgagagagggagagagggagcaagggagacaggaggaggaggcgccacccttttttttattatttaattttttgagagggtggcacgatcatggctcactggagcctcaacctcccatgctcgagcaatcctgctgccttagcttcctgagtggctgggactacgggcctgcaccaccacacctaatgtttaatttttttttaattttttgttgagatgggatttcattattttccccaggctggtctcaaacttctgagttcaagtaatcctccctccttcatccccaaaagttctgtaattacaggcgtgggccactgtgtctggcccaggctctttttttttttttttttttttttgagacagagtctcgctctgtcacctaggctagagtgcagtggtgtgatctcagctcactgcaacctccgcctcccaggttcaagcgattctcctgcctcagccacccgagtatctgggattatagatgcatgccaccacacctggctaatttttgtgtttttagtagaggcagggtttcaccatcttggccaggtgggtcttgaactcctgacctcatgatccacccgccttggcctcccgatcttgtgatccacccgccttgacctcccaaagtgctgggattacaggcatgagccacctcacccggtccagctcagactcttttaaacaaccagatctcatgtgaactcattactatggggagggcaccaagccattcatgagggatccacccctctgagccaaacacctcccaccagccccacctccaacattagggattatatttcaatatgagatttggaggggacacacatccaagctgtggtgggcattgtaatcacggtggagctttcctcatcaggctgatacccaagtcccacccctgggtattgctagaatgtcacctggtgactaatgagtgccaaaggaggagaccaatcccgtggcgcccttgcatcctctctgcttgtggttgctctctctgtattgttctctctgttatgattggctctaacttccattaagagaaaacttgacctgcagtgactgaagacaggatacattttcttaaacaagaattccgaagtttagagaacataaaactgcttaatttggctcctataataggagccaaatttttattttataataaataattataataataattatatattgtaataattataattaattatatattgtaattataattaattatatattataataattataattaattatatataataaattattttattctaatttattttataattgtcaagtttaatatttgacaatatctgagtcagcttcccagttcttttcttggctttccccccaacttgccaccttatgggcacaagctgattgctgcagctccacatgtcccgtgcaaacccaaggaagaagggaaagcagtcagaccagccaagtctttttcgttttatcaagaatagaacaagcatttctagagcctctagaggatttccttgtttagctctttgtccagagctaccacatggccacttttagttgcaaaggaggcttggttaggccggtcacattgccagctctcgcaaggaggaagaggggaatggatattgacaatgtctgcaatagtcatcttccctgctacgctgaaagcactttaaaggcaaggaccaagctccgtcaggccatacttatgtccgtgctatgccacacttctcacctggcactttgctggacatatgaagacctgagatgagaagggtttgaggagacacttcctgcccactgtgctaagcactttcttgtgtcttttgggttctctgagcagctgtaggagtatagaagcctccagatatacgttaaactctttttcagcacctctcaaaacagaaaaaaaaagcaagaaaaagactacaagctgggaggaaatctatgctgctgtaaaaatagaatagggctggagtgcattcttcagtaatgaatgcatgaaaagcagcctcttcaattataaatgtggcttctcttgtttgttgcccagtaattctgttttattgatttctgtttacttccaatcacctcaaatgagactgtgttgcttagagatcttgatccctaaaagtttgtcattaaagctactctgctgtatttagttattttttgctcaaagcatttgaatcaatatgtatacaaacgaaacactttttcctttgctccctagaagactacaagaaaaaagaatctagaaaaactaaataaagatgcttagatttttttaaaaaaagtcccagcaaatgacatattgatttctttcaaagaggcagagtgtaaattaaaaatatttttctgacacagtttttaaagatgccactgactcagcagagtttgtgcttattgactttctcttcctagagggccagggtggaaaggccgcccacttttcctaagatcagctggctttcaaaatcctttgagggaagttagccttaaagccaatgcgagcaaaggttcttgattccctgtgatcaggtctgagttccggttttgtcatctaccacatcacttctgtgtataaaaaggtgttgtaatttttttttccagaaaattatatggtcatcattctttttcaaagtggttgcattaaaacccagaattctcagaggtggaaataaacaaaagctgcgcccttattagagaatactctctggaatgttattaaatgggtctgggcagatagagaggggagttagagtgggagcatgtgcattaaaagagccacaccaatacaggaatactagtgctgtttcctcctggtacctttgagagaataaagctagtttagacccacagtcggccgggcgcggtggctcaagcctgtaatcccagcactttgggaggccgaggcgggcggatcacgaggtcaggagatcgagaccatcctggctaacccggtgaaacaccatctctactaaaaatacaaaaaaaaatcagccgggcgccccagctattcgggagcctgaggcaggagaatggcgtgaacccgggaggcggagcttgcagtgagccgagatcaagccactgctctccagcctgggcgacagagcgagactccgtctcaaaaaaacaaaaacaaaaacaaaaacaaagacccacagtcatgaggctaggagggaagcacgagggacctggtttcaggaacataatctatttgtcataatttgagtttctgaaaccatgtcacactcctttggcctgttcaaaatcatttttcagaactgttctcagggttagctatataatttgtggaaaccaatgcaaaataaaactaagggcccccttgcccaaaaatccagaaaaaaaagtgttaaaagtgctagaatagaatttcttttctctttcttcaatagtctatttgttatgttttttatttgctattgaatgacatttaagtaaataaaaatgtaaattagcatgaatattaccattcgtccttatattgtgtgcaatgccagttttaaatccagatataagagcattcagctcaaatgcagaatcattgaaataacacaatttgtatgtcatagcccatatatgcatgtgtcttttgttcttattggaagagtggaaatgccatccaaaagtaacttactgctttttgtttcacttcttgatgcatgcacattctaccaacgctttttaacttcagcctaccgatgcatcaggtagaaccaaaaacaagaggtctcttgccctgtgcaagccaagcctttctgattagcaatcctagagagaacaggtggctcacgcctgtaatcccagcactttgggaggatgaggcaggtgaattacgaggtcaggagtttgagaccagcctagccaacatggtgaaaccccgtctctacaaaaaatacaaaaaattagcagggcgtggtggcaggcacctgtaatcccagctacttgggaggctgaggcagaagaattgcttgaacctgggaggcggaggttgcagtgagccaagatggtaccgctgcactccagcctgggcgacagagtgagactctgtctcaaaaacaaaaacaaacaaacaaacaaaaaaacaaaaaaaaaacaagaagaggtctccgggttgccctatctttccctttcatgtcatcgtctttactgtaaatggttggttgatacagagacttaagaaaggatgtgataggttctcctgaatgccattgccttctctctgtcttctaagcaacttctggttcaaagggagagcatgagctcctggggatgtcagtgttcctactcagcctgtagatataacatccttacctattatacagaggacacgatatagaatccggagagaggaaaagcaaaggaggccagctttggcctgagaacttaccctagtcactcttgcctagaagacagtaccaacctcccaaggagaaacattgggggataaattcaaataaagctgtttgattcagattactcctatatgtaagtgaatccacaggatcctgtgccattggggcatcaggaacactatatgaggatgagcagcaaggaatggaagtggacacacacattgcatgtatctcctctgcttgctttcatgccgcactgttccactgaacttcacttacaaaacacaagtgcaaagataaatgattaggaatttcaagatggtaagagcagagcatacaacctaacaaagggtctttgtgagcaaaaaaccctgtggatgacctcatggatctcatgcctgtgattacacctgctacatttccaacacccattttgacagcaaatgagtgttgctgtttatgaactggaacggggaaaattattagcctcactgtctatcagaaatgagaaacaattcatctcatctctttccacatagaagttctgttgtgtttgcttttgtaaattattttgaatcaatatctaagatgggtttatctatttactactaattgcagcctgggaataaggatgtgacttctggggttgagtgggcccatctgggtttctgaacttctcaatttaatagcacctgaagacattccctacctagagattttttatataaatcatagagctttatgggaacccatcctcccacatttctctgtgggaggttggtatttccttctaggcatgaatagggataaattctcaatcgaaagctgacctcctctgcatttttcctctactgggacttcataccatgttctcaaattgactctcatttttccttcatagttctgtctcaaacttactggccacagatcacttgtaactccctattttattaagtccagtttcaaataccaaaacttgctttaacttctgctattgctgtaacacctgtctctgacttttctaacattatattacatggctgagtgggatatactttttttttcacagtgtaataaggaaaagatagccttgtatttctagaagttgtattttatattcacttcattgcatttgattgttctggataagttttctgtgccacatactaagttttgggatgtactaacatgcactcttttcttgtgtttacatcttcttgagcttgcatctctttcttagagggaaggcatgagggaggaaaataagaagaaagaaagggaaaaagggagggaaaaaagtagatttggtctttggagcttcagttaaatttcccttataatggttagaccctaaatactcaaaatgagtatttgtggtgaaaacaaaagagctgacagtggaaacacagccaagcctttctaattagcaatcctagagaggacagcaccaataagaaagaagagcagccatcaaagccaggcctttatatgtatgtaatcaacaggcatctgatctagattcttaaagatggtgtggtttgggtgggtgattttatttattttatttttctgtctcctaaataatatgtaatttcttcaggccaagaaataaattgaaaggatttagagggatttgcttatcagtggaacaccacgtagcattacattcctcctgcttttgggaaggtacattgaagtttggttaatcttctgtggttcaatactcctcttccctctgtcagcctgccttgaacaacagattaatcccttttccacccactctcttctccttcctccctcccctctctcttgatctacccttccctttttgagcaaatagaagaaaaatcttaaaagtggggggaaaaaaaaattaaactgctgcactacatttatttatataatcctagaagacctcaagggtagaaataaaggatcccaatcctcggcacaaaatttggccaagcttagcttggtttttctactgttaattaaatcttgagtctgcaaagggatttccttaaagactaattcattagcaaaagttattataagtcacgtcattctttatcctgctctagtatatgcattgtggaaaagaagaaaaagaatatgctggctattgaggatgggtagaggttttagggagtgggtgatacgatttgcttgaattcctatgtagtctgctgtctttagtgacaatgaataattactgttgggtgacgcttatgagcccaacactaattttaagattttatagctaatgatttggcaactaatcagtgttttctggtttgacttggcttaaatctcagtagtctataaagtccatgaggacaaggaccaggtcagcctggtcccaagcacagtgattgactggcacatcataggcaattaataaacacttgtcaaggaaattagtgagtgaatgagtcaatgcaaatgtcagtacaaatgtaaataaaatcatatattcagaatatttttttaattcagttttagagagctctgttccaataacctaattttggtcagacagaatgcaatatctttagctcagggtgattctctttaaagctatctcatttcatggctatatgagcaagtaagttatgcatgtagtcatatcttggcaagtgattatcttcaggagtaggtagagggaagaggggaaagtaatagctggaagaacccatggcataaaccttgtaagacagttttaaaattcacagggtgttgttccaatcgaaatacttaagctcatagacataggatacaagggtcaccttagatagtatcttaacaagactagaattctgtcccttcacctccaacattcaggacctgcttcatgagatgcccccatctttcacacctgagtatgacaagttagagtcatttatgtttcatttgatcataacaatgtcagtggctttcaaaggtaactataaatgggatgtttaatcagaataaaataagagtataggtatgacagtcatacaatcttaccacactgtgaggttgtttctgtattgggcttaaattgagtgagtgagagggatgggggagagagggagataatggcttctaacaagcttgcccaagctctatgttttttctagttttgattacatataaaaatcattggcaagacatagtggctcatgcctgtagtcccagcactttgggagcccaaggtgggtgactcgcttcagcccaggggttagagaccagcctcggcaacatggcaaaaccctgtctctacaaaaaaataaaaataaataaattattcaggtgtggtggcgtgtacctatagtcctagatacctaggaggctgaggcaagaggatcacttaagcccaaggaggtcaaggctgcagtgagccatgattacgcccctgcactccagcctaggtgactgagagagaccctgtctcaaggaaaaaaaaaaaaaatcatccagttgtatgtgtgggtattagcactgatcaaagatgagactgtgatggccacaatttagtaaagaaaatcttaatagatacatttaaaaaaaaggtcaaacttttcaaatctcattaaaggttataggtttacttagagtcaataggtattaggtaattgaaaaactcaggcagcttgtatttaaatagagaatgaacattcataatgaagctagatgggtcctctctcatctgagatattcagagctccaactccatctcagaatgaaggtatagaggggaaagaactaaaacagcaaacatttaaaggaatttaattctttttagcgtggagcagctgcagagatgtatggctgttttctgtggggcttcagaatatttatgggcctttcccttttcctttttcaccggaagaaaggagatcatcattcttgagtgtgttatttataatttcataaagctgttctgtggcaggacttattttatctcatactaaatctcaaataactgtgcttccaaggagatgggtggggaaaattgattatccctcaaaatgattagcctattaccagtgtaagataaagagctgaagggtggaatttgaagttacaaaaggcagttgggcagtaaggaggggacagagtgaaacggtcttgagcagttctgatcacagctcacagcagtagacacttttctcatgcccaataatggattaataacgaagaacagtgtagaaccattgccaagaaagggtaaaacccttctgagtacataattagaagccaatgattatagaagcaataactcactggaggaaaatacgtcagatttgtgaaacttagggaattggaaggtaaatatacccataaatttacttgggtggacagagttctgagctttcttctgtcccagctttattctaaggtaatttcaataaacaatgttaggaggaaaaaaagaacataaatgcaataaaaaatcttccaggaaaggaatacatagggctcctgccagacagatattttattgaaagttattataatacctatctttagttttatgagtcctaacacagaacaaagtaatttcaacacgtggattaaaaatatgaaatacatattttaacatgtagtagtatgaattattgttttaaatataggacttggctaatatataggggcagaggaatatttttctccccttgagaaagcaagttaaggtgcttaatatgcattgtgaaactgcattgcagtcatactcatgcactatgttctataaaccatgtgtagtagcttccaaccaaatgggacagatgacactggtgagatgcagggagtggagaaaggagagaagtctgatagggcaggacatgaaattcatgctcagtatctaagttttcaagaacaacatagctcaagtagtggtcacactgtcattctagtccatcccttccctccagtcatcctctactactagtgggtgtataaataaaccgtgttttagacctctaagcctttgcaaatactatttcacctgaaatgcccttctccttctccagcccacccgtcctcacttccttcccctgtctcaccactgcctgtccctgagggctcatttcccacatgctctctgccttcttgctatttccttccttcacacattaatgcttcctcttgtcagagcattcggtttactacatcaagtttgcctgtttacttgcctgtctcatcagactgtgaattcccagagcagaggaactgtgtcttatctatagctttatcccttataactgttaaagtgcttgacatataggtgtttgaaaaagattcattaaagtaatgaatgaatgaaaaaagcaccttgatgacatataccactgacagtaaatctaacagcccagccactgtgaaaattatttggtgggtggtcatagagtttttaaaaaatgcttccttgaataacttatagagaatattggtatttgacataggggaaccatcatacgtcagcactttaagcatagccattgaaagttatgagagctttagacaatcattgtgaggggaaaaaatgtgaagatgacattgaacgcaacttgataaacattcccaacgtaactatgaatagaagagtttcctaaagcaacactgtttcctggaggagcgtggatggtggacagttaaaaataacaattcactacaagtgtttatacccttggttacagtgaatactaaattaatgtgaattaacagctcagcacaaagcctaaatgtagccagtgtttattaagtggtaaatgttattagtaggcatgagtctagatagtctagatatccatttctttgcaggcatactaactgctctttcttctaagtaattaaaagtaattacagacaatggttgtgattataggaaaatacacagacatgcagcctaaggctaccacattttattaaaaggcagagatccaccaatttgttctacttatagcaattctattctgagtctgagtctatctgcaacatgaaacctgttttacaagccatggaaagcaatcaaagaagtgtgccttttctttcaaggttcaacatcagatcctgcatttgcttacatctgaaaaagaacacagactgaaaaagccaaaacaacaacaacaacaaaaaactgctaaaagaaagccctgggttttctgaaagtatctttgaatccaattgccattaatttaggatatgatcttaagccgctcatatcatccaaaagccttggtttgtaatgtttggattttctagatgttagggacaaaagtagtttcaaaaaagtctaagtgtagcattcctaattctaagcctttttgcaaattaaggcctctggcagaggaagtctttccatactacacagtgttctgtggcaggtgtggccaatgttgcatgccaggttcttgaggaaaacattggttaccaaaacaggcaaagagggactgagatgtttgtaactgctttgggagtttcagttggctgtacctctaagtggtaacgatgaggtctgaaagacacaaaggaaggaactgaattcatataagacccacacagattgtctagattcacagccactgagaacagatcacctttgaatgattgtttaagctctttatgagtacatttttctttatcactcctcatggcaggtgcaaccagaaatagtatgtgtaccataaaatggaagtaatgaattgtcagcaacaaagaacacttctaatgtggggtaaatcgtaacaaatagagcacataggcagataccaaatttatttaaattaggagtggctatcaggcttggaattactttgattgagaggctgatgttgattaattgtgaagttaaactatgatgttgattaatagtgaagtaactaagtgacgtgtgtgcacgcacacacacacatcccaggtcactttctgaatctacgtagaggagttgggattcacagttgtgctatgtctagggccaggcccattcttacgacacactgctggatcatttccccttcaaactcctttgagtctgggcaccattgctaggagctactggtaaaatgtggttctgttgcctgggaagaacactgtattcacatgtactcatatagaagatcaacagaaaacaaatctttgggcaaagtggagcgcagagagggttaaaggtggaaaaagggggtcagaaggtgaaagatgatgtgtggggtctgcaatggggattaggggcccattcatgggatggaattggaggtagagaaggggtgggagagtggggctggggatggtgtcacctaaaccacaggggagagaaacttagtagtatgagaggaagccaaggaagctgagaggaagacagtatcttttcaacctcagagtctactcctttttctgaaaaaaaaaaaaaaaattacatttcttcttttggcccatgcaaatgaagaagtctcctctgagttaaagattcaactaatattatgttaatgtatgttttggtttctactgaagttatgcattgttttttaaacatttgttcaatggcctttaaactttattgccaggctttcagttcttgaaaggagctcattagattttcattaactcaccagctttcactcaatactagggaccaaagtcctaccgggccattctgcaaggcccttacagtcaaatcattaataatttccagttgaacacacttcagcagtgtattctcagcctctttattaccaccatcctaaggagttttttcagataagttttccccctaattgcccttttcccacaacatttcaattccaaagatatactacatattcatttatgtaactgtggccttttggagggtcacaaaccattgtaatatttaagattgtccctcagcccaaaccaaactttcctgcctttggtgggagacattgcccctataaagaatgcatgcttaaaaactactaaacaatgattgtggtccttccaaaatagtgttttcctcttataattgccgtatttatttcaacagttaactcttttcccacttaccagctcctttccctaagtaactagaagtagagctattatagggccccctctcagcaggaaacaccaagggaatatgcttaccatgtctctaacacaaataacagccccccaggatgtaactaccagtttcagttgctggaactgaaatgaacaattcagtagtgtgtgttttttttaagtatgtttaaaaattcttttttcggtgtggagaaggagagcatcaggataaacagctgatacacgcggggcttaatacctaggtgatgggctgataggcgcagcaaaccaccatcgcacccatttacctatgtaacaaacctgcacgttttgcacatgtatcctggaactttaataaaattaaaaaaataaaaattctttttttctgctagccttgaggagcaaggtttgaattatacccctttcagatgtagaataaagatcaatattgttgtgtagggcacttctctgccattgttaattaaatcaatgaattatctaatgtggtttttccagttctttgctgtgtccagtaattccatacctaggatgtctatttaaaaaaaggatgttttctggaactcctaagtagaaaggctgtcatatatattcatttattagggttgtcataacaaaatatcccagaccaggtggcttagacaatagaaatttatttcctcgaaattctggaggctagaagcctgaaatcaaggtgtcagcagaattagtgtcttctgagaactctccccttggcttgcagatgactatctgccagcgtctttatatggccttcctcccactgggtatgtctgcgtcctactgtcctctttttagagggacacaagtcatattggattagggctcatcctaatgcttcattttaacttcattacctctttaaggctttgtatcaaatacagtcacattctgaggggctggggagtaggacttcaacatatgaattttgaggggacataattctgtccataatgtaagaccaggtataaagaagcctattgcaagccacaaacacagaatttgactaagatgtatttattcaaattcccactatgtgttttactagctgtatgtctttcagcagctcacttaacctaactgcaattctaattagtcatgtaatagtcatccctgtcccaaaagacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtatgtatgtatatgtatgtctaggacagcatctggcttgtagtaattgctcaatagaaggggagtggtttattacctcttcctcttgaatttggatccagactttagtacatttgggaattggaagatcaacaagtcagtaaatattggtcacatgaagaaggggaaataaatgagcattattgaactataatatattgagtcttcttatgcacatagtaggccaaaagttttgttttttgcataagatctgtagattcattcattcaatatttattgtgcatgcaatatgtaccaaatacagaaagcagtcatctcacctactgtatggagggctcttctcacagctgatactcagtctcctatatttcttgtaatagattccctgggactggggagtttctgcgagactcagaatttaaaaggtgcctcaagtcgaactactattattgcagtcagaactgtttttgctctcttcaggaacagccttacctgtgttcagggactattgtgtggtatcatgctactggtctacattaccaattcagctattgcagcaattacatgaaggaattcttgctaatgataaaagccattatgcagttcctaaagagaatgcattccacagcattcattaattatgccagcctgtagatgcacaactaccacggcatacacttgagaccacacaccataaggattgaaactctctcaaagccacaatgtatgtctgtgttgctttgcactcttacattgcccatcctttacaacagcccttctcctgtccttctgattcctaaaactcaaaaccagaatgaagtaaggctacaaaatgtcatttatggggatgggtgaggcttaagtctcctggaaccatcttgggtcactcagctctacggaagacccccctaagacggtctagacccagagtcattctcagtcacacagtagttaagaattcttcatcctacggtatgccctctctagaaaaataatcgtaatgatgggagatgggacacagtgataaatctttgatgtctttgttcattagtttccttatctctctctcttctctctcttcccctaccccattattttctctttgacataaacagccaacatcagatgatcttgtttcatctgctgaatgttcaagtgatgatgaagactttgttgaatgtgagccgagtacaggtaggtcaggtcagtcttattttgcttgctttcttttttcttttgcaaaaaacaatacatacatatatgtgattatacatgtgttttatatatagattatagtgtgttaatgtgtgtatatttttatatctatatatgtataagtatacatatataaatattatatcaatgaaagcatcaaatcccatggaaagagcaataagatcctacaaaaattaagtcagtctcttgatagctaacaaaaaatcatggtatatgacttaacattgggcaagcagatgcccagacttaccactggagcagcaaatgtgtaggagccagtggcagctatgaaattcacagagggtgggaacatgaggaaatatatgttggaatgacatcaagaaaggatgaacccatggaggagcttaaagattggtaagtggagccataaagattggtaaatgacttaaaactcatgaattattctgagctaagagaaccaaaaatatatgtatatatatattttccatgggatttcaacagcagttaacatggtattatctttgtactaattttgttaactgtgtgtctagaaaacttgtgcaacaatatagtaaacacaaaattagtgctgtaccatgccgtgtcaacagctgtgatgcttcaaaatgtatctactgtgctgaagttgagaagactttagcaatcagaagcttcaatgtgttccccatttggacccagatacattttgatgttttatggtctttctttatagtgagctacatatgacctaatgtccagcaggcaattgcagtccctgattatttcctatcaacttttcccagttgtctgttttgagacttactataagttaaacgtttatatgtatataatagagaacagatatcatcgaatttctgtgtatgtttaatagaattaatagctggagttgggccaggatcttatttctgtgaagactaaaataaatagaattttctagttattttttgcattgctttcagatttttttccttttaagaaaaggaaagccattaaaaattctcttttgctaattctagaaaatttaagcttcatgaaaaaataatctaataaaaataaaaaccttccatttctgacccctaaatgatttacaagatttcaaatctgttgaagcctgactgctttggtttcttgcaagtggaattggatccaggaagttctgtgggttcatacccttagtatgacacagggacacatcattaatatgatagggcttccattctggagtgtaatctgttccattgggagctcagctgtgtggagggaaagtaaatgtgatctggtcagggctttctttttcatatttttaggtaataatctgtatgtgctatgtgaggttttaaccctaaaagggcagatacatccgaactataccagaacttgggtgccatgttttcattaatttattcattcattcattcaataaatatttttgagcactcaggcaggatacaatatatctctagatttgagtccttcctattctgttttttttttttaagaaattagctgtcagagaatagaatagttttgctatctaactcctcgcgtaattcaattcaacagatatttttgagagtcaactgtatatgttaagcatgtgctagatattaagggttcatatattaataggtcacaatcctcaatacgtacattaaattagcttgttttgtggcaaaccctttaagaaatctaggctttaattttatatatatatatatatatatatatttttttttttttttttttttttttttttttttgagatagggtctcactctgtcacctaggctggagtgcagtggcgtgtttatagctcgctgcagccttaaactcccgggctcaagtggtcctcctgcctgagcttcccaagtagctagaactacatgcaccactatgccagctaatttgttttattttgtgtacaaatgcggttctcaccatgttgctcaggctggtctcgagttccaggcctcaagaaatcctctcgctttgacctcccaaatgtttttcttcctttcttagcagtgatatctctatatgcagcaatgtttatcaaatctgtagattttaaggcttatcaaaattgaggcttggtcattctgaaatattatcaccatctttcctcaactactcaccctgcctcagaaagtcatctccacagcaacattcataataaggcagtgggcttttccagatctcagcttcagattctctagctctgtagctccccagtttatgggtatatattgctatttgttatgagacttgaatagcgtaaacctgaatggccccaaactaaatccatttgttttctagaggccacgcaggtattttctctgattcagaagcagaggacagaaattcaacaccaacatttcttgaataacatggggtgggtggggagatacagtttttagaacaatctgttgtgttctgtaagggagcatgagaggagataaagtgagtgacagaacccctacctttaaagagtgaacatgtagctctaggaggctgatattgatttcctccacctgtgattattcaactcatcacatttgaagaatgagcattgcatttttctaattttatttactccataaagtattcctggtgagtgatttggatatacagggaaatacgtcagtggtatatttaatacaagaagtaggtagatattcctagtaatgcagagagagaagaggtttgcccagaggacctgatttccactaatggggattacctgcttagagctatcaagccctctttttcattacataagaaatatctcctcagaagttcaagaccagcctggccaagagggtgaaaccccgtctctactaataatacaaaaaattagccaggcgtggtggcaggcgcctgtagtcccagctactcgggaggctgaggtagagaagtgcttgaacccgggaggcagaggttgcagggagccaagatcatgccactgctctccagcttgggcaacagagtgagactctctctcaattaaaaaaaaaaaaaaaatatatatatatatatatatgtatgtatgtatgtatgtatctcaggcttcacattttccaaaaacaatacagattaaaatcagaaatcagtttcttgggcaagatttgcactgcctaaagagaagggacctactgcccatgcagcaacagataatggtgacatttacacatctttgacataaattgccaatcttgcaattctacattaccactaagattaaaattctggttttgaacaccctaattcactgcctccatttctaaaacatttttccaggccttttgcttgatggaaatacactaaatttggctaacttccttggccttgttctatcatacttactactttatcttctttcactttgccagcgagtttattattttctagctgtctccgtttatgaggcatttaacttctacaggttatttcctgattaatttacatccatttgaagctctcacttttcataaatttgggtagtttagtgtgtgctataattcaatttttattttcatatgagcatcaaattttaaatgaaataatttattttttcttcaaatcacattggatttttaaactgctggttttgagttagttataagcaatcgcctttcactctcagaacttacttttgtgcttaagggtcaccacggtttggtatagcttaatcttattatatttaggaacaaggtaaatatttttggagtttggtcaataggagtctagaaaccttgcaaatccaatggaagtcaagttttcacggtatatttttgctggtaaatatgtagagaaatttaaagaaatcccaaatcatgagagcaaggcataaagtaaaagctcaattaggatttgtcgactaaattagtttgaaacagaactttatatctctaacttcatttcccctttaacagctaaaattaaacctattgactcatttaaaatttatgatttcatataatagggctgccctgacaaaatctatatttttaacaaatttgttttagaatttttatttctttattttgagactgggtaacaagactggctaacttttgtatttttggtagagacagggtttcgccatgttggccaggctggtctcaaactcctgggctcaagtgatccatccacttcagtctcccaaagtgctgggattacaagcataagccactgtgcctggccaaaacctacatttttttttaacaaagttattctctgctttttcctatccctacctttttctgggaactagattattttataagtcacagatacaatcacattttctgaatatttgcttcaagaacccagaattgaacctttaaacaataaagttataataaaaccatctgcatcaaatgaagatattcagaagtgtatctgaatagctatctagaggcgagggtctggattttaactcgatttgtaaatgttaattgtgttcttcacaaaacaaatcagtatctaatactttagattcgttctttgcatataaactgtttcattcccaactgcacttctattaatcttaaattgtgcagtaaattcatatttcattgtcctttttctctttgaatccaagaagaaaaacggatgagctggagagcattcaaataacccctaggaaaaggataccctcatgagattatggaagccaaatagcaattaagatcattagtaaattcacatttgtaatctaaaatgtgggaatgaattctgaaattcagagaaaataatacaattcacttcccatttcttctctttcccttacccctgctgctatccctagaattcccatctttggaaatagagtaatagtgaaaacaaatgtattcttggatgagcttttgtataattagatatgatcaacttcctggattttacatttttatagtttcaagattctaaaagtcttgggggcaggaggccacagagcagagcgaaaaaaaaaagtaatacttttatacctaataagtgggcatggcaatacttaaccacattgattcatccagtcgttatccaggggtatatttttcagtttgtcaagtagctagtttttctgccttcacttttcttaaatgtcctttgatcaaatctcaagggacagcacttccaccagagggcagacagtaaaaggaagtgaagatgaaacacatccatccatcaataagactgtgctaagcagctttcataatggttgggaaggagatgtttaaactaatggcagtaatatgagatgacaaaataattgctattcccagagtggttctcaggtatatttttactcctcaaatctacaatattcacatttgcatttcggtgttactgctacttagttcctctttgttagccctactataatatacaacccaagctgagtgaaatttaaatttggcataacaccaagatcacatctagtattttccaggtggaactggattcttaatctttatcagtctgagatgcctcgggaaagtatcatctgaaaatctggcactgagttactaaaagctcaccaaatcattttactttttatttgctggaacatggtagaaaatgcagctgaaatgttaatagataataataattttccagtgaaggatcaagagaagtttataccagaatttatagataacaagtaaatgtgctgattgttggccttaaatatgatgtttgaaatcttatagagatacgttttgtcatttgtgtctttgtcaagtttgaagttagcaacctgtatgtttttattacaaataagtcaattttatttaactatttattcactttagatttttctatatgaaaactcattagcaaatagaatcatgttaaaatttcattagtcaatggctattcagaatatagtacaaaaataaatgtccaagtaaaatctcataggaatgttggagtatgacagatctataaattcaatggtctgtaaatgctataaattctgataaaaggctcagatccacttaaacactttgaccaaagagataatggaaataatctaagataagcattttagctttggaaagagaactgtatatcgatagaaaattacttaatttaattcattattattggctgtggacatcagtcattttaaaatttgagttacaatacatgtctaatgctcacaaaagcaaatagttgttcacatacttaggtctaggctaaatcatatccatttttcaaccgccttcattgatctataaatgaatatagtatgttcatgggagtataatgttccagattaatgatacagtttttgtctttgttaacccaccaagttatttcactttcttttcttttttcttttttcttttttttttttttttttgagatggagtgtcactctgtcgcccaggctggagtgcaatggcatgatctcggctcactgcaagctccgcctcgtgggttcacgccattgtcctgcctcagtctcctgagtagctgggactacagacgcccgccaccacgcccggctaatttttttctatttttagtagagacgggttttcaccatgttagccaggatggtctcaatctcctgacctcgtgatccacccacctcagcctcccacagtgctgggattacagccgtgagccaccgcgcccggccagttatgtcacttttttataacagccccaacccaacccaagttattttttaaaccattgcagtaactatgtgcttttaaaatccttaatggtgaaatgctttgaaaattagggtaagaacagaaatataagaataggaaagatctactaattagctcttgcactttaggctgaggaatagtgtgcataatatatgtggcccatagatcgactattgtggatttcataacaaatatatttaataataaaaaaatgaaaaaaattctatccaactccattacccaagattttttagtaggttggagagcgaggcaggggaatccataaaatcaatgtatgagtgtatatacttctatctgaaagtttgataaatctcttctatatgtaacacttttgagtaactattacatgtaggcactagaataggtgctgggaaaacaaaagtattttgcttcagaaatatcgcttccagaagttcagtttattaggaaaggcagatataataagaggaataaaaggaagggaagaaacaatgaggacaatgaatggaaatgcccacgatattatcagcaccctaaggatgttggagcactccaattcagtgaacagcataccttatcagggatatgcaagaaaaaaaaaatcacacaagatgatgccaagcagtgacagattcaactaaccccaaggagcattcttctgtattttagtttggtgacacagaattctcatttattacgattgaagaattagtacagttcagtaaagtaaaaaagcaacactcttttggaattagtacagctcagtaaagaaaaaaagcaacactcttttggggacttcacatatacagtatggtcaaaggccacaccgtttttaggtaatagggtaaaggatggacatgttgaagggagaatttcaatctgaactcatgagaacttcctgattccaaatgccaatgcaagtggtacataaggagtgagcttaatgacatcattaagcaagtcccccaaaaataaataaagagggattgggttttaaaagagaagtttttatgggatttattctttttattctacatttttcttccataagccccaagtatatgtactgtgtgtatatatatatatatgatatgcacatatgcaaataatatactgcctgtcactccatatatatgtagacacagtataagtgatattagactaatgtaaccagagattaacagcccctaccatcagtcatgtgtttacacagaaattcacaccatcattcttaaccagcatcagccaacatagacatgcatgatactgttttaacttggcaaacaaagcatgttgatttttctttaagatttctttatcataattataatgctgactccataattcagttatccttgggaggggtggaaagaaaaaattatacagatatatctatccgtatatgcacattcctgtgtatatatataaatagatatataccttgtatatatttgaagaacattttgttgtttcacctcatcttgtgccgcatgaatttttggtggttcaatttattttgttttcatatttactattttgatcattatggctatttttaactcattgctatacttttatgagtaactataatcattattttcaaatactgagagatatatagatatacaaatcaaacaaggcaaaaaaatcttttcttgccatcctaatctcaaattcctcccctttcagcatatccctccagtatttatctcaaaacaaaacaaaccccaacgaaatccaagaaagttgtgtacaaaagaatgaatactgtgttttcctcttcctccttctatgcatatttttccttttaatttccgtttctttccttttgatttacccccatatctgcatggaccacttgcctttactttcccctttatgacaatgtaattaattgaaaagataagagtcagaaaaaaataaaagaaaaacacatagaaatgacagagaaacacacccctctccacaaatttcagatggcataaaaagaattttattgcagatatagaatatttgttgtatcttttatttctgtctggacaagcccaggatcattgtgtggcatgccgtgacaagttttgtagcgcatcaactaaccatggcctccatcacaagtgcatgacaccatcttgtgtttcatccaagtgacacatctaggctaacccagcaagtccagtgtatgagttgtgggaattacattcttttgtagttataatttcatgggtccttgtttttattattatttccattggatcatgacagccctaagagctgctctcgcagcatctctgtatggttttgttcttgtgttttcttttcttggcacagcagtcaagcatgtgtctcttgtttggcacatctgtcttgccatcttgtcttgtccactgtcgtggtgttgttctgtgattctgttctctgtaagatgtgatttgaaatcctctgcctttatttctcactctcctattgtctctacttttaaccttacccctagggaacttcacaaagaagcaaaacaaactttcagtcacattataaggctgatcactggtttgcatctggaagtcataagttgtactttttacctgacttaaggaggaaaaacttacagtgggaaactactgataattatactcaaacagcaaactgatcaacgacaataagaaacccttgttgattatttttggtatgattaaatgggcttactgttaaagggacttcatgtaagatcttatttccaaagagtttttttcataaattatcagtcttctagtcagaaacttttcttcaggagcagatcaacggaagatgtttttcgggaattgttagtgagggagcatcatttctgctgtgtagaacagtgcctgttcctgaattggggaggaactttatggaaatctgcaaatgttttattacaaaatgcatttatgtttatgtattaaaatataaatgtgttcagcaaggcatctgaggatgggaaaaaaaaactttttaactcactggttccacctcatgcatattttgaggtaagattatcttttgatctttctgagtcaactgatatacattttacttttttattttttaattcatggaagcattagagagccaacacttcaactttgacctaaattcattcttttcccattccagagaacacgacatacataatagctttagttctgagaatagagtctgaatttgagacaaacgtagaaggaagtgcccagttaattatccaaatgttggactctacctgtgattatccaggcgatttgatgctttacttggaaggatttgattagttggatacgaacagcatgaaaatgacactttgtaacaactttccctctttaagggttgagcacgagaatatcaaataggtataaaaatgagtaataggtgatatattaatagattaaagattattcaataggcctaaagatttcagatgaaaaatctgtatttgtaatctgaaaaagagaaagcatatccagacctgtggttttctgatgagatctttcagtcaggccagggtagctattggtttttcttaagggtaaggggaaaaaggccaaggatgaggaactggatggctctgtggactaagaacaactttctgatgaaagaaggaagggaaacaagaaaggcgaagaaagaggaggagggaaatgtaaaagaaaggaaggaggaaaggaagagatattgattatgagccaggtaaagctgcttgctgataaatattttaaaaccagcacacacacagagctctaatttgcagttttccagtttctgtatggtgtaaaatattcccaccatggctgatttctagctaccaatatgacagccctaaactcagaattgggaagtgtccttgctcgtacacaattatatggctttttcatcatacgtacactatagacgtcaagaacctcatagataatagtaaaatttagtaaaataattaggaagtaccgagttttaagtttttaattacctgtttttaatatacttgtaactttatatatatattaacttttgaaaatggccatgttttaacaaccagcttacaaatttcctagaaattttgcaatcagttgtcataaactggctcaagcacaccactagcccaggtactatactgggtacatgaaaacatagtattttatttaaatctcattttaagttattgtgagataaaaactagcttggtcatcttacagttgagaaaattgggattttaagtttgcttgttcaaggtcacatacctgcacataaatggtagaggtaatattcaagtccaaatctgtttgaaaatagacattttctttatattacagtgtgccagtcattctttcaacacttctcaaagtactaagttatcgaattttgacacgctcctttgtggagcttagcatgactcgggtttccctattgcctcaaggaggtccttggctttaactgtcttagataaaatggagtttaaatgtattatggttgtgtcaatggcaaaatgaagacagtgaagcaaaattagaactcctgattactctgtttgtaaatgccaccaaagttatgaccatgtcttcatgagaatgtccactttgactaattttgtttcctccaaatattcctcttttactaacattgacaatgaacaggatatttcttaggttttcatattctgtcccttgagctttggaaagactatcccagatacattttctgagcacatagaatctatagcatgatcccattacatagttaggttttataacttttaaactctaatgaattttatttagttacagtatgtaatgcatgttaattaaccaactgcacagtgaaatatgtcaatgtcctttgcttccacattttctaatagagtaagctagtatattaacatttaaaacagcatgagaaccatagtactgcagaaagcaactgcagtttttaaaaagatgattttattgtaagatacttaatcattgctctgtaaaagagtttgagaggcctgggaattaaaaaggaaagtgttgcagctttttagtccttctaatttgacaagatagataatttgattgggtttctgatagtgcagtattttgctttaatttggtgtgaagtttagttgcccccataattattattatttttttttggtcactctgtcacccatgctggaatttagtggcatgatctcagctcactacaacctccacctcccggattcaagcaattctcctgcctcagcctcctgagtatctgggactacaggcgtgtgccaccatacccagctaatttttgtatttttagtagagacggggttttaccatgttggccaggctggtcttgaactcctggcctcaagtgatctgcctgccttggcctcccgaagttctgggattacaggtatgagccaccgttccgggcctccctatatagtaaactttcgatggcagcatacacaacattgaataaagtcctttgaagtgacttctaggctttctcctataggtttgccactgctacaactttgtttcatcattcagtgaatattagcacttcctttagtgaaatatagtcttaagtacttcacattgttaactactttaatcctcacagcaatcatgtgagagtctattcttattatctccattttaaagataagtaaatggaggcacagaggagctaagcaaattatcaaggtcacacagcaaggaagtagaagaaatgggatctgaacccaagccaactgcccccagcgtggacacccatcactatgctatcctgtctcttacgtagcgcttattttccattaacctaaatatacgaaatagctgccggcctccttgataataaaagaaagtctgtgtattgaatgtattacatggttgggaagtagttgataaatgggttagttattatgtatcaaaaaggctttaacaatcttggttgatgggggttataaaattgttccattatgatttattcaaataaccgtggttaaaacaagttaccctggtttcccataaggaggaatgactccaatattggagagaaataccaacacttatgtgaggtgagtctcccttgatgtcacctatgcaataatatgtgcacttgggtttttttttttttttttttttttttttgagacggagtctcgctgtcacccaggctggagtgcagtggcgcgatctcggctcactgcaagctccgcctcccgggttcacgccattctcctgcctcagcctcccgagtagctgggactacaggtgcccgccaccacgcctggctaattttttgtgtttttagtagagacggggtttcaccgtggtagccaggatggtcatgatctcctgacctcgtgatccgcccgcctcggcctcccaaagtgctgggattacaggcgtgagccaccgcgcccggccgcacttggggtttctagctcattattcatgatcaattctgttcaaaacatatgcccagacaacagccacctttaactgatgttaggaatctaaggatagaggctcttagcgagagcttgggttaagatactgcattttctttatttcagaaataaatatgttccttagaacacagtgatttaggtgttacagctaaaagaaagcaaaaaacaacaacaacaacaaaacgaacttgtatttcttatcttagaccctttctgacacccacatgctcttgacatctcttaaagttgtaactatttgtttatcctccctttttcctcacttccttgcattatgcatccaaaactattttaaaagccaaaacacacacacactttttgtgggtctttgagtttcctatgcaagaaaagaatcttaaaatgagttataaagaactaaaaatcacaattaaaaaggaaacataattttaaaactgtgtttgcttgtattataatccttattccaaggcaagtatggcctgcacaaacatctgaggattccattacaaattatatcagtctcaacccatcccgaatccagatcataaactcataaactggaaaatgtgtatagttgaaaatgtttgcataccctctgtcctagagcagtgcttccatcttagctttgaagcacagagacctcctcttactaaaagatcatgaaaactggcaatactgtattgcccagtgttaaaatttgtcagattaattacccagagccaaagttagcaaactttttttctgtaagggctggggtgtaagtattttacactttgagcgtcttacagtccctgccctatctcctcaatcagctcttataatgacacatagcagccatggaaacaaataaatgagcagggctgtgttttcatgaaagttgatttccaaaagcagagatggagctggatttggctcagaggtcatagtttaccccaatctagagaagtcccataggttaaaaatgtgtagtctttttttttgtttttaatagataagaccttcttgcccattttatagtcgttcccaacatttgttgagttctccactaagtacatgagaccacataggatacaacaggacattaaaagcttttttttttttttttttttgagacggagtctttttctgtcacccaagctggagggcagtggcacaatctcggctcactacaacctccgcctcccaggttcaggcaattctcctgcctcaaccgcctgagtagctgggactaaaggcgtgagccaccacgcccagctaatttttgtgtttttagtagagacggggtttcaccatgttggccagactggtctcgaactcctgacctcgtgatttgcccccctcggcctcccaaagtgctgggattacaggcatcagccaccgcacccggccctaaaagttcatctttaaggacatttcccacctttgttttagatatgccactatctcagacatgaaacacaataacaaactaaaccagggtcatctccacccagcttgtacactacatatttgggtaggagcttaacgtcttgcccttcgctttgccagtgtgtcttctgagctccccacctctgctaggtgtgggctgcattcacccccaattttagacctctttggcagtagcttccttgatctcccgcccacatactgtgtcatatcccagtaattcttccccaaaccttggctatgggttattgagctgacaaatgtctaaatgactgagatacgatttcacaacctgctgagagcctcttctttccctgtactctttgatttgtagctttgtaagttttgtgaggaaagtgggaaaaacattcttggtgacacaggcagtgaatgaggaggacacaatggagtgggcaccatatctaggactcctgcctgcattgcgagcaaaagcatgtatttatatcttagccctctgaatgttagaggtagcagattatacagtatggtgcaggaaggagcatcctatgtcctgaggtgaataacgtgttctaccacctggcagcagattagaccagatcaggctatgagaatacaggttcacagccagatttagtactaccagccagatttagtactactgcaaaaatggcttttccttaagaagtttttgtttctaacttttattttaggtttatgggtacatgtgaaggtttgttacctatgtaaacatatcatgcggttttgttgtacatatcatttgatcatctaggtattaagcccagtatcaaaaaattatcttttctgctccctccatcctctcaccctccctgctcaagtagactccattgtctgtcgtttccttgtgttcctaagtcatcatttagctccaacttgttgagaacatgcagtataagttaatgcttactctctttaacatctttcacattagaaatctatggagaagaaatatgaaagactcatatataaacatggggcaaaccatgaagctaaatcttaatgtatcccaaaccccagagggagcataaggttaactttgggtggccagggtgcttagtgataacattatgagctttctacattagcagggccccctggtgtggttttgtgcctggagatgtaaggttctgaactacaaaggaagcaaacaaaatgaagagatgatgcaaggaggcaaaaaagatggaggcattaggaaaggctttgagggcaggaggcacggggtcatcttctaaaataacctattggaatgcatgttttaataagctttgaagatcaaagagattaacaagaacaagaggaaaacaagggtaaattaggcactattgatggcctgacaaggacttttttctccctttctgcttacaataacctctcattttaccatgtggctagttggtttgtttacttgtttgtttacacttactcattactagctttccctataaagcaagggaaaacactctgtccccaggggccagctgcataacatgaatagatgaaatagaccagaccagatgcaatctgcagtcatgggaactctgaactgaagagaacatgccctcatttaaaggcatccaaatgaaacattttaaaaacactaaaataaagagaccccatgaaggtcaaacaaggcataatgagacacacagtgttttttattcttttgtttcttaaattcctttaaatatagccctttcataaatttggcaggatgtgctctcagtaaaatttctggtttagtaaactcttggtgacattatcaaattaaacagcaatcccttccaaattcccctaaagctaagacctttttttttttttttttgcatgtctttttttctctgataatcccagagtttatataacctcaaactataagcttgatgaattttagagttcattgtaatgcttttggtttaggtgacaaaactgatgcctacaaagataaactgatttgctgaaggtcatggacctagtctttattggagttgtaattcaatcccaggtgtcctaaatctttaatccatgccattttattgatattatatattaagattttttttattgtatatccaaagatttctattttaaactgagataacatccaacagagaattcagaagtagtatgaaattgattatcttccctctactggacattgttgccatacaagacgatatcattgacccacttagggctcaaatatacaactctgtattattttagtcacaaagggaactaagagattatagacaagttgtgaagcagttagtggggactggaagtctcctgtggcacagactcaaatatatgctctagtgatgtgttctcagtcatgttatctgcccacacagaggacagattaagcaacctagagtactggttcccaagctcgaatttaaaactagtaccagtctatgccaaagctttcagtgacccatagtgaaatgagaaaagcaaggacaatatggtgagtctgcacaaagtcaaacttacagaactgccctatatttggatactgtatcatgtttttttggatggctaaaatcaatgtcttttacaaaagcagcattttgttactatgtatagcattcttaatcagcaaaataaaggttggcaatggtatgtcagtccttccctacagtttttctttgaagtttttttctcaggcattgaaaacaaacatccgaaaaagcaaaaaaacaagagttttaaagttttaaagtgttctctatgttgccacattagattgagtagatttcaaagactgaaggcctttttacatgtaaagttttattgtgaactaataatgatgatgttaagacccatctattttattgaggtcccaggaagttactagtttaagcatccgtcacttagataacaagcattaaggtaatttttaatttcagttaaaaaaatagattaaaggcacaaaatagatttccaaacaaacaaacaaacaaacaaacaaaaaaaccaaaaaagccaccctaggataaatataactagaaggccaagatcagtttagaagtctacttaaagaaagacagaaacttctaaggactgtgtggaaagataattcatgcctataaaaaagtctctgtgctaactctagatttttttcactgtaagccttgtaacaaaggagagagagctattttggaaagctgaattagcctacatttgagctaacatgatccatctttgtgtcaagagaaagtcaaatattatagtccccagccaaaataaggcatgtgatctacatcaaaggcaattcctgaatgtgtatctacgtcctcatcccctctcctcttttttgtctcttgggtaatctataccaataacctcctgattcatgaaatttattatctaaatattgaaaatattacactaaatttagcctaataaaaattcatgccaaatttactgagtatttattggaaatcagagacttaaggtcctgaatcaggtgtaagaattgtattatcaataacagacttaacagtgattatctctaggtggtgaccgatattttgataatcatactccaaaacatctatgtagaaattgggcatggtggcgcatgcctatagttccagctacttgggatgctgaggtgggaggattgcttgagcctgggaggtcaagggtgcagtgagccatgatcacaccactgcactccagcctgggcaacagagcaagaccctgtctcaaaaaatgaaacagaacaacaacaaaaatcgatgcagagcatgtattacatttgtaatcagagagaagggatatctgttatttcttaaaatatagaagagtatactaggagaccagcaagggaaatgttttaatatttagatacggaagcttcgccagacccgtaattttttaaaaatagtgaatcctttttcctgggttgaattatgatgtatggccctgcaaggaaagctgctggaggaattcaaagatgatgatgatgatgatatgcagggctctatatagcttaacacattagttccataaggtcagttctgttcatcaagtgacaaattgtccatggatacaccaggtggtaatgcagcagcagtgggcacaagctatcctgtaaatgacccattaccagaaagtttaaaatttctgcttggaacccaggaacacagatggaacacgaagtggctttcaccagagtcttgggaatatgcttgatcctttaaccccagcttcaggtgttgtgtacatacttaatgcctgaacagttctcatctgtacatctgctggttagatgaaaagatgcagttgcagacaagtaatttaaaactttacattcatgtctctctacctccctcttcctcttctgtctctccctcgataggatgtccagaaaattaaatcagctgcagattaattgagactctcttccatgtagggaacatctgtcactgcagctacaaagattatattaatgaattaaaacatttgattacctttaatccaagagaatgcagcagtctctttagtcatttagtttatcagggttttttgatggtttttttttccacgtgcatcttacgactatagtccacccctgaagctgtgagatctttcagcagatgttgttttccatatctttaccctttccgttgtggaagggggaaaaagccctcagaaaagcaattttggaggaggcagaaaaggtttccatcatgaacatacttttagaaacagctggtaaaacaaatggtccaagtgcaatgcctggagcatatctattcaaacaaggttgtttaaagataaaagcacccacttctaaatatcagcattagtagtgatttcctcacgtatatttaagagatggaagagcttgtgaagactttttgatttctattttgttttctgagacttctttaactcttttggttttgttagtatttgaatttatcagaagctgctcaaattgttaaaactgtatcatcatatgtaaaatatataaatttacatataacggatgcataaagatttgctttcttattctaagaatgttcttatttgataacatctatgcatagtccagaagattgacatgaaaaactgataatgtacttaggtattaccaatcctataacccaatttgtgaaaaggtcaggcactcctactaaagaacaaacgtttgtatttgtagcatttaaaaatctgattttattttgtatttgctacatttggagtcaaccttatcccttcccttctaatgacttcatttgtttaccaggctgttttgttctgcatcctctgccaaatgccattacgtaacttcctttgtcagaccaattggtgaaataattctttgtgtgcttttttttttttttttttttacggccgtccaattttcaaattatatgtggattttctgagtcaggcattgcacaaatgctgatttgttagcttgaactcgataaatgtgtgttcaccctatcagttgtcattcatgctgacttcttcctctactctcttcactctgattctgttttcatttaagaaaatttcagaagtagtgaagctaggagagttaatgagtagccacgttgaccctagtaggatcttacccattggagaaaagccctgttttaaaacgatgcacaaagaataagcttcaatgtcttcctctcctcaaccccagcatggagcacaatgcttatgtgatacacggaagtgagaaatttaagaagtgcttcactttaacttttctcaataagtaaataaaactgtcttttctagagtccaacacatcccaaagtgtgtgactttgctattttaccttaaactgactactctctgaatagattttcatgttatatagtctgagacttttctttccatcctgctggtgctggaagacatgatcataactactcacaacccagatcttaaaatatatatattgttacacttttatatacttgtattaaagcatcagttagtaagtttcatggttgtttcttctgatgtaaaagtaactgtagttatagatcctccagcacatgtcacactgaaaacctaatcacaaagtcaaaatatgtgcataaatattagcttgattatgtgtcacatgtaccccaaattacacatatatataccttcctcaaagattttttttttgtggggggacagtctcactctgtaatccaggctagagtgcagtggtgcgatctcggctcactgcaacctctgcctcctgggttcaagcaattttcctgcctcaggctcctgagtagctgagattacaggcacctgctaccatgcccagctagtttttatatttttagtagaggggtttcgccatagtggccaggctggtctcaaactcctggcctcaggtgatctgcctgccttgacctcccaaagtgctgagattacaggcatgagccgctgtgcccaacctgagattttttttttaaaccttggattttcaaataactttatagttggagaaaagttgcaagaatagtatatggaattcgttatgtccttactcaggttcaccagttgttaacatttgccacatttgctttaccattctctatatgtgtgagtgtacatgcacacatgagccatttgagagtatgcatacaaaacatatttatgtagatatgtatttcccctgaaccatttgaaactcagttgtagtcatcattccttttttaaataattcagtgtgtatttcctaacaaggactttctcttacaaaatcagagtacagtgatcaaaatcagtaaatgtaatcttgacacaaaatctcacctagagtacatattcacattgcaccagcgtctgcataatgggctttgggattatttttttcccagtctgtgatccaatccaagatcacacattgcatttagttgtcaagctcaccaacttttgaagcatcttcctgatacgttattttatttccccatttgtttactggtcacagaccagtaagagcaagtaaacttcttaaagtcctgccaggtgtgttggtgtagaagcgggaagatagagcctgtgcttcagcacaggaggaagatttcaatttttagaattaaaattatggcaaggaaggacctgtgtttcatctagtattcattccttagagagcacggatataatagtctgacaatgctttttattagtgttttcacttagctgcagattgagcatttactgtgtgctaagcactgaggatgcaagagtaagcaagaacagagatggcccttgtgggcctagtgggggacactgtcatgtaattaagtgacctccaaataaatgtgtgatgacaaacgttgatgaaggctatgaagcaaaggcacttggtgccatgagcataccatggtaggacaggtaacaaggcaggggtgggtgctaggaatgtagagaaggatgaggaaaccttctctgaaaaaaatgatatttgagcagaagagtgtgaaataagtgacagctaagaggaagaaaaaatgcattagagcttgcaaaaaattctgaacattagaaaaagtcagccatttctgggagagagttatctgggagcagcaactgtctcacaggattttgtccaaagtataaaataaggaagtgtgttaggctattcttgcattgctataaagaaatacccgagactgggtaatttataaagaaaagacgtttaattcgctcagagttctgcaggctatataagaagcatggtgctagcatctggggagcctcggggaaactacaatcatggcaaaaggtgaagggggaacaggtatgtcatatggccagagcaggaacaagcaggggtggagatgccacaaacttttttttttttttttttttgagatggattctcactcttgtcgcccaggctggagtgcaaagtcgtgatctcggctcactgcaacttccacctcctgggttccagcaattctcctgcctcagcctccccagtagctgggattacaggctcatgccaccacacccaggctaatttttctatttttagtagagacgaggtttcaccatgttggacaggctggtctcaaactcctgacctcaagtgatttgcccgccttggtcaattaaagtgttgggattacaggcgtgagccacagcacctggccgccacaaacttttatatgaccggatctcactgtcatgaggacagcaccaagccacaagagatccaccttcatgacccaaacacctcccaccaggccccacctccagctttggggattacagttcaacaagagattcaggcagagacaaatattccaaactatatcaggaattaagtaggctttgctgtccttttgcagctttgagtcaacccatatgagagtgaattctccgatcctgtactgctcctgggaggaaagggagtgggctttgtgaaaaatggagatttagtgagtaaagtgatgagttcactggaggaaggttggctagaaaaaaagtgacatggctgggcatggtggctcacgcctgtaatcccagcactttgggaggctgaggtgggcggatcacctgaggtcagaagttcaagactagcctggcaaacatggtgaaaccccatctctgctaaaaattcaaaaattagccaggcatggtggcaggcacctgtaatcccagctactcgggaggctgagccaggagaattgcttgaacccgggaggtggaggttacagtgagccgagatcacgctctgcactccagcctgggcaacagaggaagactccatctcaaaaaaaaaaaaaaaaaaaaaagtaaaattgtctttttttttttttttgcgtaccaaatcctatcaatgaaagagacaggaatagatttgactggaatagtcatgggagccatttccaggctctcatagtcttagagatgacacttggtagttcagtgtcttattgtgcttcttcaagcacatacagcctgattgagagagactcaagacagcatacaaattctaggcatttttacatctgcctagctgtagtgaattagtcatacaataattatttaaagaaagaaatgtttcctccatgttgtgctggagatacaatggtggagaggaagtggagatcaactattgatcgatttataatttacacaattccacactttggagaaaacacattccttcttcctcaccatcaccctcaccattataattattatcaattaacttgttcaatatgtaattttgaagttgccaatcatttaccagtgtgattcatcatgttaaaaggaaatggcttttacattattaatattctgcaataaaagtttgggtttgtgtgcttacagttagaataaaagaaaaatgctttgtactaagactatgttaataataatgataataataaagaaataacactttctccagaaaggaaatttcaggaaatctgtttcagaatacctgtctctaccacaagagctttctaagtcatgttttgattgctaacagcattccagtactgggttggaacatatgtattccttctatcaactgaggaacagcaggttttctgttattgcccatgcatggtcactctctgcttataaaaattcatcacttctgctgattgcattgtgtaggattcctactgattaccatttagatttgttaagtgacatagcacattttatggagtcaggagccagtaaccatcaaggtcaatagcagcaacctgaatcagttataaatgaattgtttaattacccacgcatgatcaatgtgtgcactgccataaaagattagttctagtccctgaatgtgtgtgtgtgcctgtgtgtagttctaagggattacagacttctctgaagtcttcttcattgaaagagattgcaagtgagtatcttttcagtggaatagaactgagttatggtaacaacatcatctatacatccagtctaccgtggccactgaatccaatgacttttttttttattaatatgaaggtgcctgcctatccaaagcactgcttactgtatttcattacaatgtattgcttcactcaacacactctgaatagagaagatatgctctacagcttcaaattcaggcacttcctccaagcagagcttgtttatctgtctgcaacacacttggagcatttgaaagactagtgatgaaatccattcatgctgtgaaaatgtgttgagcatcatggccgcttcctttacaatggcctggcatggaaggttggagaaggccattgttaccatataaatgactgtctatttgcctctggcatgacttgtccagacaagttgcatcattttaaaatgaatgaagttctagggagcatttttaactatagtaccttagttgtaactttgagagtttttaataagcttgcaaggaataaatttggaatctagagtagtttgttctatttctggaaaaaaaggaatgctttgtacatatgtaggatcctttacctggccacagagtttggtttgagaagtggacttgactctggatagtgaacaaaatgctttttcaatttttaaaatggaggcacctttttttctgagagcatagtcagtaactccccaaatgtgtgtctcttgtgtgatagaggaaccaagtaagagaatagcttggtgtgtgcctggttttcttccacaagtacccaattagtaaagggggcttttgctttttacaaagcatgaaaattaggggttgcctataggcctgagagccctgccagacagttgcctaatgccaccagccaggattatggaaaagaagccttggcatactattcaatggcaccgattcacccaaattgcaactgaggaaaacgtgttcatttttcaaatagagtttgagtaaccatagacacaggcaaagtaatctctccatttggtcacaatggactaaactaccttgttctattgtctaccttctctctcactgactccatcaaggcagacttgttcggtaaactattcaggtgactttgtgaacttttatttggtgcaaggctctgttaatagctgtaagtcagctgtttttggtcctccctctcattctcttcacactgattgatgaaatgggaaacaggttgaagaagctcacttttttagatgacaagtattaagttgacagataaacctttaggaggttccagttcatttcaggaacgtgttgacatgaggtctttaaagatcgacagtcctattagagatagagaccaccaggaaatcataaggaaaagaaaaatgaaggaaatatctagattcagtaggaaattgggggtgatgagagaattttaagaaaaacgcttgctttatcaccagctgtgtcattttgttcaaagggacaggaaacataatactctctctgaagcttaacagaactgcagacctattgccacagttttctcttttgcataatcttgtttagtcacttaagagctagtgagtgacagatttcacatgagaattggtcacgtacaagaatgttaatgcagaactaggtcagattatggcatttcacacatgcaagatgggaacacgcttcctctggttagacaaaggcttgacgattgcccatgcatctggtcctgctttaaaggaagctcatgtaatcatgagaactcacaatgtatccatagatttcttagatatcaagtttctatgagccttggcattgtgtatggttttattgttattttgccaaacgagggttttctagcttcacttagtatgcctggagaaagctattttggttcggcccagctccatcactctaagaaatgatgaggatgagcgctctcagtttgtaccgactactcatgagagactaagaactgatcatctggctgctggcaacattccactgcaacagctaatacagtgttttggaaagatgccgacaacaaccagattgcattaagcactttaccgtttaagatcagttttgcagttcagaacttgaagtcagcagcagatctaccttttagtttgcagtttactttgctccgagtttttcatgtcttctgtgagccccccacgtttatctcagggtggattctaacacacatatgcttatgtgaaaatttcataatactttagtatttaacaggcacttttatataagtcaattgatttcaggacaccccctcgccgccctgataccaaaatctgcagacgctcaaatctcttacataaaatggtgcagtgtgtacatataacttacacacatacttctatataatttaaataatttctagagtacttataatacccaatccaacatagttgttatactgtattgtttttgtgtttttaattgtaatattttcatttacctgcagttgttgaatgagtcgagggcaggtagatatggaaagctgactgttactacttcccttttacttatattacaatattatctatgttagtgatgttcatagttcaagagacacactaaaggaattacagtatggagtgtctcctaagttgcattgtggaactaaacactagagacaagagtcgagccctggctcaatagagccagtaataactcagtgtctttatgaccctgagccggtgccttaaattctctgcagcgtagtttctttaaacggtggttctaaactaaggggacttttgtccccaggggacatattgtcaattgtctggagatgtttttgattgccacaactgggaagatgctaacggcatctagtgggtagaggtcaggggtgttgccaaatagcctacagtgctcagacagcccccaccacagagaattatcccacccaaaatggcaatagtgtagaggttgaaaaatgtcactttaaaatgtaaataatgtctatcccattatcacaggattcctatggggctcaaccccacattttgtttaaaaaaagtaaaaaaaacataaattgcccttctatgtctgatgttactactatggggcattgcacatatggacaccaaacttttcccttaaaaaggaaaatggatttattcttttagattaaaagttataaataaagctatcagattaaaatatattaaatatatccactgaatcttggtttgtaattttatggttttaaatgaatgctctaaatataaagagaaacaatgaaaagttattaagtaggagaaacctactattcagtgactaatatagataaaggaaattggaatccatgcaactaatagacttttctattagggtacagccacagcacgtctttcctaatagaagcaagcctgaaatgataagttgtttggatcacattaattaacattcagctctattagatttgtacctgaggttgggttcattttactggtgctgatgaatatcaaactacacaatatctacgcacattatattagaataaaacatgttttacattgaaggcaaattttagattcgactcttaataatggtcttttatattaactcagataactagagatagtaaaagaatgaattaaaattccagtgagccaaactacaacattgataatagtaatgagaattaattctgtgttgattttatggtgcctttgcctcgtaggtatatataactctggagtttatgaggcatgtttatagatcttaacttcttaattttgtaatgctgtcctcttaaaatttttgcttgagacggacaaaacctcctgaatttcttcaatttacatgggcatttttactaggaaagagcatgcagccttcatcagattctcaatagggtttattaacaaaaaatgttgagaaatcaccttaaaaggcaggcagctcttaaatgcttgttctcactgaagtccttctaaaatgatattgcatggactctatcagtctcttagcagctcatctgtagaggtaccaactgatcaaaaattcaaagttcttaattgacatactcaggttttttaaaatttaaagatccagattggtagctcagccatatagctaaattgaataattatgcaaatgctgcacaatatttaattggaccttttggaatgaaaataacccaggtgtgcacaattctttgcaatctggagcaaccattctaatatatatctgcaagtgacaacatcttgtatgtaaacaggcagaggaaaagagttctggctgccctcccaggaaaatatacatgaaagaacgtttgtgttacagcatttgtgttacagcacatacatatttctgagttgtttgttattaaagtcccattgtatgaaaacaactatatagacagactggcaatccagagagttggtagttacataaacaggtcccacggctaccaataatattaacacggtattcttagcccttaagaaacaaaacacagaaatttctaatactgggagtttaaagtgccacaatggaaaagcaaactcaattacaaatgctggattccacctggagcctattcttttcattttcttacttctgtttctgccaccttcccttcttccgataacagattttcaagtactgctcttagaattgctaaatgtgttcagagaatgtgtgataagatctgattctcctggaaggccaggttattttaatctttccatttctcacaccaaccatttaactaggtattatttgtttctggacgtcacagctaaagacacaacattttacatgaaaatgtcagtgttgaaaatattatttatctatctatcaaaatgtagccacgcatctgttcttgtttgattctagtaaaccataaccctaaacatgacacaaaaggggctagtgaaatatttgccgagagcggtactctaagttaacagtaaataattgaaaataagtaagtcaaaaccaaaaccaggaaagtttgcattcattcccaatcatactttaacagaacttgcagctgccacagattcagacatcttcatcttcctgtggagcatttgtcttttcatagcagaggacaatctctgtgactttcttatatcactgagaccatcttgtacagtttatttcaaaagcaagagtgttctttttcgtttcatgccaccagtgacaatacgaaaccagatctaactgaaacttcactcaacacattcccgacccgccaccccaaccctaatagcctctcataaccaccgttctactctacttctgtgagttcaacttttgcagtctccaaaaagaagtcaggtcatgtgatatttgtctgtgcatggtccatttcacttagcataatagggggactaagttcaagagatctattgcacaacatggtgaccatagcaaataataacatcttgtattttgaaaatcactaagggagtagattttaagtgttcttagcagaaaagaaaatacaatgaggtaatgccggtataatttagcttgattcagccatttcacaacttgtatacatttcaaaacattatgttgcacatgataaatatgtacaatttttatttgccaatttgaaaaacagagaagtccctcttcagatcctgtcctatgcagctgtcactcacttggctttgtaagcctgcagacagtgtcatttaaaatattttcctctgtaccataacgcttttccttttaatgatatataagaataatatttctctctaaatagttatttctttaactttgaaataattcagcatctcatgattttgatttccatttctccatatatacattttttggggctctgttctgggatttagggctaacctttgtcatggagacatctgtttttggcagtctttgtttccagggagtgaaaatgtgtgtagaaagaattgaatagctacatcttaggtgacacaattgaggaactggatgaaagatatttgtggaaagcaacataattattcaaactggaatatggccattgccctgggtttcatatttatcttcataagcaaagtggtttgggattctgtgcaagtataaggatttaggatttaaacactaaaccacatccctgcacggagcacatgggctttgttgttgataatcatgatagtcgcacaggaaacttgacagtgacagcaggggaacagcacagtatcctacttggccactggtaggaggatgcaatttaaatcctggcatgcgtagaatagcctcacttatctgtggattgttattgtaatctacatagtaagtttcaatcagaactcagttttgtgcagttgatttccaattcccgactctgcatcattagggtacaatgttttctgtaagatttctttgtaatattatagagagaagagcagaacaaatgcagttattcctctcaaagttcagctgaatgctactaatagttcaagaatgtggattgtaatggttctgtgcattgaaagaacacaatggcaaatgacaaagatgacactaagtgtgagccacagctattgttttgatagcccactctgcttttctagttaactttcttacaaccatcagttccatatttaagactagaggatcagttctgatgatgctcattcaaactcttgccaactgacatttaatgcactttaaagttgttaaaaccaagagcaggaaatgttacacttgtagtatcaagcctggctcatgagaaagttccatccactattctggaaaaaaaatagaactagcctgcaggacacaaagctacctgtggtgatccgaactatgcttctcaaaaatctttcttttgtttggccacctttataataggagttctccaacagagaaagagctgcttacagcttcagagtacagatggataattgttgctgtgccatctctgaacatcttagattgagggtcccagagaacctcatgtatgtgaatgttagcacagtacaaaagatgggacagagctttccagagcagtaacagacagctgtgcccagcactttcttctaaaagttggagatgctggatggaaaatttgtcattgtttacatagcacccacacacacacaaaaaatcctgactcactagcttctgtgttgtcatttttttgtccatggttctattgctgcctaattttcatacgggaccctcacagtggttagtctgcacagtaaggagtcaactgtgacatcctcatccttgaatgctagactccccactttctcagctcaatattccatgtgtccaaagtaatactgttagtatcctacattattccaggatcttgtcatgccacttcaagaaacaaattatcaccgctttctaagacttaccaagctaggggtgttgtaaagtatgtatgcaattgacttttgacttttgattcttatgttgaaaggcaacatagaaaataagcttccattaatgtaatgatatagtgttaggaagacagtatctacagtccattcaaaatattctgaaaattatagtattgattttggaacagttttgattccattggccatagcgcttaccttaagtcatttttttttaaaaaaaccgtcttatccatttcatatgttttacaggcactaaaatggggcacagagactaagtcacttagttgagttaaccaataagtaaaattgccttcatattctgcttcctaatgttgtatcttctctagcaagttcaagagagcttactttctggaagctttgcttgttagtaggatgtataacctgtgggaaaagacccagcagcatccacttttacttatctccttgccttctctgaaaacacactgaacagaaatatccccatctctttctccatcgtgggtttttcctttgggccacaaatagtgaacgccactgctttacaaagttattcttttcaccactaatagttctttgatgtcattttttgtacaagtgtcaaagtttttctctagaggcttccacacagttaagttcttgcttttggattctttctaaaccaaataaataaatcttcgagactgcaggttaatcaaatgccttcaaacatgaaggctgtttaggagctaagctgcacagacattttccaacatttaaactcttcatgcagcatcttcctatctcaatttgtacccgttagccagttccacagggcatattgggaaataccttttattttcaatatttatatttgtcttatagatatttgtcctttcaagtaggacaaagtggtaatgacctgcctctatcaaaaaattctacctagtaatccaagataagcagtgtgttcctagtgagttgcttacataaaagccaatatattttgtactgaatagtatacagtgttaaaaactcagctttttgagggacccaagcaagcctaacctacatgattttacaaagacaatacttaaaagtcataaagtactaagtctcaactttcagacttaagactcataaacgttttaattttttatcccttaaaaatgttattttttggctaacagcattgaaataagcgttactatagattaatactatgaaacaggaacaaaactgttgagcagacattctcccagggaaggactgtgtgtgaacacattaaacttacgcataaaagtggagactgtaagtgggttccagggtttccccacgctgactttttaaattaaatgtggcagtattgctaaaaataaaatttagtgtttctcaaattttttttagatagatacctcatatggtactcacaagtagtgtgaaaacttaagtagtatatccatctaaagcagcacaagcaatatgtcagcaccttttcactattaccacagagaaatagtgttggagaccatattgaaaatgactgtagtctggctgaggagatattaagtgaccagatggcctctggcacttctgttttcaaagctgccttatagtgcctttctcactttgtgataccaagctgctgccatgctagtgtccaccctcgaacaccatgccactcagacatggtgggattcgtgtttctgaaggggcacagtaggaagctcattcttgggccttctggcctgcctgagactgtgctagcaatacagtctcattgtgcacaaaagaagccatttttcttaacacctttgagccattaatgaaacctaccagttagaggtggtcaaaagacaaaattacaacaaatttagcttaaagatgtattggttttacttgcaattgtagaattgggcaacaccttgttctataaaatagtatgttctgatgagctgggcaaggtgttgtctgactttatggacagaaaaggactgaagaaagcagaaacaaaatgagaagtagacaggttgtttcaacatttccttctttctaggctttaagcagagggtactttcttatgctggatcaggtaaagggccccttctgcttggttgctatgaatctcctgtttaaaaagaaaacaaaaacaccacacaaaaaaacctgacccattatggtttggtctggttggctgaggcctagggccggagtctagtctaaaacaatggcctcccctaaacttgaacagggttacattgtagaataacataacaggaaatgaaaagagaaatgtgatgctcttcaacaattggtttatggggccttttaaaaagtgtgtatagagtcaatgatgaattaagatgcagtgtgaaagaaaatgacacaggacagatattcagagatcatttgttcagttttaaaatcagattattagtattgctgttgagtcatttcagttccttgtgtattctggttattaatcccttgttaaatgaatagtagaaaatattttctcccactttttggttgtctcttcactttgtagattgtttcctttagtgtgcagaaggtttttaacttgatgtaatcatgtgtctatttttgcttttgttgcttatgcctttaaggtcttatccccccaaaaatctttgcccataccaatgtcttatagcatttccccaatgttctcttctagtagttgcagaaagcacttgtaatttaacagctcaggaagggaatcaaatcattcagaccaactgaagctttcaaaatgttactgcttgaatgggcagaatatccaaaaacatttattgtgtgatcctaacatctacatattagaaactgatagaaaacttctgatgtatcagtaagatgataattacccttgtaacatttctggaagcatgtatgtatgtatgtatgtatgtatttaaacgaatgcttgtatatctagcatctctttcaattgactcaatacccaaggaattttatctccattttacaaataagagagattatgacttatttcaggtcacagaagttggatcacagctggaactttagtccagttgggtctagaaattcaattttctttttactttcatgactaaggaccactctataactctgaggtaaaaagagcaaacataatgaagttatttagagtagtgtttctaaatctaattttgcatgagtcccttggggaacttttaaaacatgtagataaccaggcacttcctgttatcctttttccactgcccctagcagacagacttagtatgtctagcttaggtaacctgggattgtgcaaaaaagtaaatcttcagagtccctctgaatatcaattctcattatgcaattatgactcctaaggcttaaaagtatgaaataaatctgtagagatcttaggatctcctgtggaagttgtttttgtgcctaaagattagcttgtttgtaagttcccatactcagtgagaactgaatattttaaaaaactggtgaagggtggcactgtattttaacgtaaaacatgcaggactagatacagtcacggccattcaattttttaagttgtatatctttgggtgagttacttagcttatttcagcccagatttactgctatgtaaggtgtaattataattattgagtaaaataaactaaagcatttaacacgatgtctggcagagactaagtttttaatactcttaaaaacatcttctggaggtaggcttctagttaattagtgttttaattatgtaattataatttttgtttcctttctctgtcctcatatttgctagaaaaacactatgtcaaccatttgatcatactcatttgtttctaagcatatatcttaactaatctagagacccatattcattgagcttttggaatgactggaaaatttctcaaagcttcctcccttatctacggtttagtttacaaaaattaaataagcttatgatgtgtgtctcatccacccaagtacatctgcagggctcctctattgtaaatcagctgcctaaggctcaagttagacacagtcaaagccgtgtatatttagggtacataatcttgatgtcaagtgctggagtcttgggcaaacttttcatctttttatgtaaaactgatttccattaagtatgaaaacaccttggtggtattgattttatgaaccctgtacattccctgcaatgaagacagattttagggtaaaagaggatgtttgcaagaaatggtgagttttattgtaagagaacttaccggccctatagagaggagaaaacaggttggaatgtccagctgctaccacccaacgggatcccagcacaaagaaaacagtcaaaattatgttcatcatgacagagcaaatgagcttttggggaaaacagaagcaaaataaacctttttgaataatttattattctataaacacaatcataaagcgtaatggtatcagttcaggagaaaggtcccactgctcctgtgttctacgtcagtggctgcagggccacagcaggcagagataaccaagcatgctttcactgccctgatcaccattcccccattaataatttgcttggccctttccttcctactgcctgaagaaaatcaatgtttggcagctctaggttgaattactgtttattttatctttagcctacacaactgcaaaaggaaagcctgagttttccagtgcatattccaatacctgtttatggaagtgagaacgagtcagatagtgatgtattttttcagagagtttcttaagccagctgtggataagaaggtccaatttgcattggaactgctaactaggactcagggaaatcccatctggtttagagaagagtaaatgaaaataaaacagaattgtgaatgcaatgcttcaataattagtttgcaaaacatgtatccactgccttgtgtgggcaaagcaccatattaggaactatagaggactgcaagaaaaacagaaaaacagagtgggctccttttgcaaggtattcgtggctattccaggcatcctttcttctttcagcagtgatctcctgagttattactatgtgcctggcgctgttctgtggactgcggacaaagacaaagtctctgctctcttggagcttatattccagtgaagtgggggaggactaaatgtaaatacatgggcaaaagtcagctaataaatactgtgcagagaatcatgaggagttgatgttcagttagtgagcaggctggttcgttactagggaagatgtgaagggcctctgagaagtaaaattgtagcagagacctaaataacgagaaagacctagccaagcactgagcaaggcaagggatgttcctggaagggaagccagagagtatggccagagcccgagatatcctgggtctggtgagtcatagatgagactggagtactggagtaggcagctggcaggtcacagtggactttcccagtgagtcagggattttgatttggggaaacctttggggattttaaagaggaaagtgacttgatctgatttttattggatactttaagaaataaattttgttttgtatacttaaggaatacaacatgattctatgagatatatatatatagtaaaatagtcaccatagagaaacaaattaacatatctatcatctcacatagttatacattttccccttatgtcaagagtagccataatctgatttagcaaaaatcatgaatacaatacactattactaactacagtcctctgcacattagatctttagacttgttcatcctaaacacctgttacttggtattctctcacctacatgtcatttcctctcccacctctagtaaccactgttttattctctatctctgtgggtattagacattgtttttttagattccacatataaatgagatcatgtaatatctttctttctatgcctggcttatttctcttagcataaaaccctgcaagttatgtatattgtagcaaatggcaggatctccttatttaaggctgaataatattccacttaatattttataatgtgtccatcccttgacagatacttcgattgctttctatcttggctaatgtgaatataggtcgggtttggttccaaaccatttcaacaaagtgaatattacaacaaagcaagtcacatgaatttcttggtttcccagtgcatataaaagtatgtttataccatactgtgctttgttatatgtgaaacagcactatatcttttaaaaaaatactttgataaaaaatactttactgctaacaaaaatgctagtgatcaacagtattcagcgaatgtttttgctggtagagggtcccgtcttgatgttgatggctgctgacagatcaggatgtgggtgctgaaggttgggatggctgtggtaacttcctaagacaaaaatgatgtttgctgcactgactgatttttcttatcacaaaagatttctctgtagcatgcaatgctgtttcatagcattttaatcagagtacaacctctttcaaaattggagtcagtcctctcaaactgtgcctctatcaattaagtttatgtgatattaatatttaaatattttgtcatttcagcagtgttcacagcatcttcaccaggagattacttcttatgaagtcattttactaatccataagaagcaactccttaaccattaaagttttttaagaaaaattaattttaatagttttggggttataggtggtttttggttgcatggataagttctgtagtggtgattctgagattttagtgcacccatcacctgagcagtgtacattgtacccaatatatagtcttttatcccttgccccctcccaaccttcaagtccccaaagaccattatatcattcttgtacctttgtgtcctcatagcttatctcccacctataagagagagcatacaatatttacttttccattcctgagttacttcacttagtataaatggcctcgcactccatccaagttgctgcaaaagacattattttgttcccttttatggctgaatagtattccatggtggatatatataccactattaaagttttatcataacattacagcaattcagtcacatcttcaggtcttacttctaattatcttgctatttccaccatatcttcagttacttcctccactggtcttaaacccctcaaaactctccatgaggttttgcattaaacttcctcccacctcctgctaatgttgatattttgacttttctcatgaatcacaaatgttcttaatggtatctagaatggcggatccttctaacaattttttcaatttatttttcccagatccattagaagaatcactatctatggcagctattgccttacaaaacgtgtttcttaagtaagatgttaaagtcaaaattgctttttgatccatgcacagcagaatggatgttgtgttagcaggcacgaaaacaatgttagtctccttgtatatctccatcagagctcttggatgaccaggtgcactgtcaatgaacagtactattttgaaaggaatcttttattccaagcactaggtctcaacaatggacttaaaatatttagtaaaccatgctgtaaacaactgtcatctaggctttgctagtccacttaaagactacaggcatagtacatttagcataattcttaagaaccctaggaattttgaagtggcaaataagtattgactttaagtcaccagctacattagcccttaactagagaatctgcctgttctttgaagctttgaagccaagcactgactcctcttctctagctgtggaagtcctagatggcatctttttccaatataagaccattttgtctacattaaaaacctgttgtttagtgtagccactttgatcagttatcttagctagattttctggataacctgctgcagcttctacattagaactcgctgcttcactttgtgcttttatattatgaagatggcttttttttttcttaaacctcatgaaccaacccctggtagcttccaactttacttctgtagcttcctcacctgcctcagccttcatagaattgaagagttagggcctttctctgcattagggtttggttaacaggaatgttgtggctagtttgatctatctagaccactaaaatattttccatatcagcaataaggctgttttactttcttatcattcgggtatttactggaacaacaattttaatctctttcaagaacttttcctttgcattcacaactcagccaactgtttggcccaaaaggcctagtttttggcctatttcagctttcaacatgccttcctcactaagctcaatcatttctagctttaaagtgagaggtgggtgactctttctttcacttgaacacttagaggccactgcagtgttattaatttgtctaatttctatattgctgtgtctcaggaaatagggagatgggggtggggggctggagagagacaaggatagacagagagagagagagaccgacccagagagacagagagagagagagacagagagagagacggagacggggagagagacggagacggggagagagacggagacggggagagagacggagacggggagagagacggagacggggagagagacggagacggggagagagagggagacggggagagagagggagacggggagagagagggagacggggagagagagggagacggggagagagagggagacggggagagagagggagacggggagagagagggagacggggagagagagggagacggggagagagagagatggagagagagagagatggagagaaagacagagagagagacggagacagagagagatggagacagacagagacagacagggagagagatggaggaagggcaggttggtgaagaagaacacagacaatattaagttcactatcttatgagtgtggttcatggcaccccaaaatagttataatagtaacatcaaagatcacagatcaccataacagatacagtaagaaaaaaagtagaaatgtgagaattaccaaaatgtaacacagagttgcaaagtgagcacaggcaggtagaaaaatggtgccaacagagttcctggatgccgagttgccagaaacgttcaatttattaaaaatgtatctgtgaagcacagtaaagcaaagcacaataaaacaagatatacctgtatttgtttttaaatataaaaataatttgctttaatgctgaacaaaaatgtcccatgtaaaaaattcatgtgctatctgttcccaaactcagtttccacacctaattacagtaaatagaaaggagagaaaaaccaaactttcaagatggaaaggagaacccaggacagcctcaaacccaacacttagaatggtatttctgcatgcccaatctacagcaaactttcagacttaagaaggaagagagaatggataaaacgttacagaagacagtattacattttaaaaattggtaagatagtagaatgtttagatctggaaggactttaaattaatcttttttccttacattcagataagctttaatgtgtactaaattctatcccaaaatctctattctttgtgaccctactgtaccctacgcagatttttgttgactcaatactccactgcacttaatttgttttttagtctcagctagacctgaaacaactttaggaaagggatagtgtcttcttgcttacttttatttttcctaccaactagaatactaataatcattcaaatgtttattgaatgaattaatggataagcaaatgaattaatataattagttgcttatattttaccccccacactagcctatagctttaaagttgtggtgactacaatgtctagtcacttaacctcacagggcagatttgctcaactaataagattttgaatgagaaagtgcttaaaaattctaaaagtgcttctctaatatttgttactattgtgttcaaagactgttagctaccaaatgaaggtttcatagtcaacagaggaggctgaatcccagacaattacaactgaggcccgggctactccaagtgtgatctttggagtatctgactcagcaaacaaacaagaatcacctcaacccaaaaccctaacccaaatagccatcattactacttccttccaatctccatctccacaccctccaataatgatgaattcttaaagcttgaatacatgttttaattgtaaatttgggttatttctgcatgtaattttacagttattttatttcacccttgtgagttggagttaagctctgaaaaggtcttattttgatgtctttccataagattgtattccttttttggcaagagaacagatctggagttgagctcctgccctctaccaaactgtgaaatttgagacaagtcacttgtcccccatgccaacccctggggcctcacttttcttattcaaaaagatcaaagattttgtcctaactcatgaaatcatgagcattacatgtaaaattaccttagaaactataaaatattcatttcaaatgcatcaagatgttattagctatattttatgagctcagcactccttgatggtcctgaagagaccaaaggggctgaggccaaagggagaattctccttaaatctcttggaaacaatctgacagaccttagaattgtgtagtaagatgaggacataaaggaacagagggtcaaggtagtatcttagctcctttctcccaacgtgttgatactggttaagatacacaaaagggaaaacccacctaagaaactgccaggaattcttttttttttttttcattttgttttaatgctaacttaataatcatgtcttagtgtaactaagcttttcttcatcaagaacattataagctcattgatgcacaggctaaatctttatgcttatttggtgctttttaatctgtctagcacagaatagggcacaacacaggtcttcagtgtgcctttgctgaattgaaatacaaaaaaatagcacatctttcaatacttgaagctcatttttataaagtatatgtgtgtagtagggaattctaaaaactattttttgctggtactagtttatttaatcaagaggaaatatcttcataaagtcaaacaaccagaaaggacagtgcaaatggccctcaaagcttgagcttagcaactgctcccctgttcttagtcttgccactgtgtggaatttaggacttctatatgcagatagtttgttacttgcaaaccattagaccaagcttgtcctacccacagcacacagggcgcatgcagcccaggacagctttgagtgtggcccaacacaaatttgtaaactttcttaaaacattgagtttttgcaatgttttttggtctcataagctattgttagtgttagtgtttttttatgtgtggcccaagacaattcttcttccactgtggcccagggaagccaaaagattgaacacctctgcattagacccttttaatactattataggtaatatattttacaacataaaaaaatcatctgtgtaccagtcagaaatgaaggttttgtatgaaacattttcattcttcagtatcaacagcccaagattctcctgactttatttctccagccctggcccctcacctcaccatctcttagctggccccagatatggcccaggtgttttaatcttctgggtgatctgatccagcctcttgactttaaatggcatctatatgatgataattttcagtttaagcctcccttcagaattccagtttctcaaatccatctggctattcaacctttccactttgatatttaagagacactttgggttcagaagagctaaaacagaactttggattccccaaacttgcatgtcctccaaattttctcatctcttaaatttgattcaggtgtacaaactccacatttgtcatcattcttgggcccctgtcccaactctcttccccacacccagtcaagaagtcctgttgactctgcctcgataacaaattgctcacacatttcctttgctccagctacccatgctgtagtgtaagtcaccatcatttcttgcttgaattctgcaacggcttcccaattgatctccccaattctacttttgcttcccaaaagtccattctccataccgaagccaaagtaatctttaagaagtatacatctaaacaaaacacttcttcacagcaaagaaatcaatacaatgaaaaggtagcccacaggttgaggaaaacatatttgcaaaccatatatctagtaaggggctaacttccaaaatttataaacaactcatacagctcaataacaagaaaacttataacccgattttaaaaatagacaaagtaacccgaatagacattcctctaaaggagacaaaagtggccaacatgtatgtgaaaagatgcttagcataactaatcaccagggacatgccaataaaaatcaccatgagatatcacctcatacatggtagggtaggtattatcaaaaagacaagggacaacatgtgtcgatgagagtgtggagaaaagggaaccgttgtacactgtgggtgggaatttggattggtccagccattacagaaaacagtatggaagttcctaaattaaaaatggaattgccatataacccagcaatgccttttctgagtatatacccaagggaaaggaaattaccatcttgtagaggtatctgcactccatgttcattgcagcattactgtaccgcattatgaaatgggttccttcaccccttttctgagcaccctccatgtctacagaagaagttatgaggaacaaaggtatatgcagggctcgttttgtaatgctgacaacagcaatcctcacatccagacttccatgtccatgtacagggttctctactttcgttctaagtcaaactgtgattcagaaatgagccatccattctcccagaattcctccattcaccccacagacacaaaaatcaaatctatgaaaatgtttttgtatatttcataggagaaacagatgtggaggcttaactcatgtatccaatgccaaaagtcttcaaaatcttcattaggtatttgttatgccaacttctttctcagccctcccggtttgtaactttttaaatctttacccagtgttgcacgaagactgttgagatggttccctctgccttcctctctctagtattctccctgggaagtttaaaatatataatgttatgtaaagtaactcactggggccttcctcttgggcctcacctctatacactgaagacaatgctttctagcaaggaggacccatgcttccagagaggagggtttgcaactggagtaacttgagtatgtctttgggattcttgagctcaacccaaagcagttcagaaacatttctttgaaacaagttcccaagatgaattctaacaactgtaatatcgcatttggcattttaaaaattttgattttacatttagacagagctattaggacatggtgggataaaaatggtagtatcgaaatatactgtttcaaatcaaattattgtattatttgttctcaatgacagacataacccaaacacattcttagtacccagaataaaggcacagccatgaaatcaggcagttattaataaaaacctagtgtagatagctaatgaaagatgaaaatgaagctgtgacatgattatgaactgctattagcaagcaatgtcattttgtatcttagagaccaaacaaggtttgtgtatgtgaactaatggttgacttatatggtaaagatatacatgcattatattcaggctatgttggcttcatttgaaactacagcttccatgggtttaaaaaatacacatatgatttgcaaagtgacaaccctaaattttcgtatattcaattgttcaaaccagtgatttctagaatgtaagtggtgtcctacttgtaagagttttaaaacaggcaattttggaataggtaaattactcagtagaagccttagagaacccaaattgctgatgtatctttttcgaaatgcctctcattatccaggagaatgtgtgtattggaagtatcttattctttaagtctcacacttagaccggttatgtttcctacttttaaaaattgtagaactttattctacagatgtcatttgatgccttttgagaccgaccatatatgcatttatacaatcttaattcaatgttaaaagtataattagtccaaaaaaatcaactaaatggcaacaagggtttttctttttctatattattaatttttttttcctccatctaaaactttccagctgctctttgtgaagttcccagaataatgattaacattattaaaccagagactaaaaatcttggtacggactgacccatggggacacattgctataattattttaaagtaaaataataaaaggggcgtcccatagcgggcaaaagttggactcatcctcaaaatttactctatttgtcaaagtcccctaaaagagttcttaggagtggttggaattggttgtcagaaccaggtgctctcaagtgtcttgcctttgtggttcgcctacctgggtttcccagtccttggttgaacattaatgttctcaacgagatataatactgaatataactcttgtgatctcttccagtggaggctgaggccatttctaaaaattccttccctctgtttcttctacagtatcttcctctccgtgtgcatacatgtgagaggcatagttttccccaacgtacttcagataaaccttattggcatagttttcctcaaagcacttccaataaactttattcctttcatgattgtcctgtagtttacagacactgatattgtactctttggagtggagaggggttttgccattcttacaaaaaaaaaattggctattcctccatttatcaggctcattttattaacattctactgtcatcattgtgctctgtcactttgactaagcccaagaaccctcccacagagcaatgttaattataacccctctatgcccgtaaaatatgccatctaaaggctttgaataaatttgggataaatttcctgaagcagaactcatgaacccatatgtattttgattccaattcctgtcaatacaggttctagttcaactcccaacacacacacacacacacacacacacacacacacacacacacacacctctcacatgctttccttctaattggcaagaagccttcagatgtccttcacccctactggaaaggcatgaaacaaaacccagtaccttcctcctacccctaaactggttttgtcttgctgcccctaatcctagcttgctgttctgtttttctattttcccctaaatgcaacttactttaagcatgtgttaactggattaacattcctacaattgaaggatagtatatgataacccatttgtcagtctagctactttcttctcttttaaatgtctacttacgacgtacatccagactgcacgccctttttattttttcaaagcaaagccaaaaaataaagaaaacgtaaaattagtttttaaagaaaatgcacaatctgtttttaattttggctatcacgaaaaggggaattaaccagccaaaaaagcaaagcaaaaaaaacgtgtcccctgactgctctgtctgtgcctttcaagcctgtgcgtctggttgttcatctctgaaagtgtgtgaaatacttttttctttaaactttttgtttttttctcccttcttgtttgggaattaagtgctttttatattatatatatctatatatatatatcaatgtgtttcttttaattgctagatctttatcttagatttgattttatctaaaattatgagaaaaaaagttatgaattgttttctgcagtttttccccactccctctttaaatgtggaacaacttcagctgcagaatcctcacatccacatctttcaaattagcctggtctcattgccaattgcgtgcaacatgggtggcataaggaagatggatgatgtcgtttggaaaatgccatttctctatagagaagtaattagcaacccagtgcgtgggccccctgcttagtagtgcgtctcaatcacctctgtagatttctgaacctcccccactctagatggggctgtgtggctgccgatgaagttgttcaacttgaatgcataaatctagtcttcttgtttttgctttaaactttttgatcatgactactagtattttatgtattttggctatttttagtaggaaaaagtttaactgtttttattatttgaaaatctttaatgaaactgtaataatttttggagtaattgcatgttgaagaagttgcagcttagggtgtgtgagattgtcagtgttagagttctgttctttatttccatagatgggcatgtgtaggctcatttgtttttgtatattgcccatcccttccttacagccagaagctctaatgcagctagatcactccgtgccgcccttacatggacatggcgactcacttacacatttactcctatcatcttcatctcctgtgtagttcactcatagatatgaccctccccttcctgcatctttccttcccattctccccctttctttagcattgttaaaatttatgtgctgtcatccatctccctaaattaaagaaagcctaaaatttgtcaaaaagacaaaaaaatatatatatctgaaaacttataaatgcagaaattcattcaaaacccgttagagtcatagaattttttgaaaggcaaattataaaagtaaacaggtttttttgtttggtttttcaatcatagcaatcggaattattttaaattcaaaaattgatgccctcccaaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgtaagttgactataaattaatatggtatgcttttttagtttaaattattttgcctatatggaaatgatttctttttttcccagaacagcttctatttttaatttgcttttactttttctttccattcttattatattgtgaatgcctcaatgttatttgctctccttctcccagcttactttggctacgaagttgattttattttctactatataattttgaagactatattttttatttcatttgtgtcgatttgctgaattttcactgttatgttttgtgctgaattgcttctaataatcaatgtgaattctactctcagtagaagggggttaatacattgttcttaccacccaaagaaagcctggcctctttgcctgaactttttcaccaccgtgtttaaagccttgaaagtattggtaggctctatttggtatcttaaaattgtttccagccagtgggaggcctgtaccctagaagaaaatgagttgagttagctccaagtagtaccagtggtatttgcatctttttaaaattccttaaaaagcatttaggaaattagttcttttccttcagcaaaggggaaataaggtactctcaagtgactatggtagagtttggttatccaggatcatactctcacttttgcttcaggctacaaaatcaattatactgaaaatgcagatatcaagaatcccaggtgtttcgagtattgttctatgatactgacgccttccagtgtatggaactaacaactggcaaaaacacagacacacacagaaggcacacacacattctctctctccctctttcctttgtctcttctccttttccctttttcatttctctcaaggatttaatcaggtaagctttcagggatcttaagattctaccaagaaaacatgatgattttcatatctaaagttatacttagaaaatatttcaggtgggtaccatcatcgtgtaactacagggtaagactattccttcaccttaagattatttgaaccaatgctgccttatgtacttcaacatacataagattggtaagaagcactatataattttttcatcaagaagttacttgttttgctttacagatatttgtgttatttgaactgttatagaaatatcaaactgaatggtggataagagtgtttccaagccagcagcttaatatttgggctctctctacctcagtttatgcgattttgtgttgtttgacatgctggataatattttaggtctaaaacttagaacttcctaaatgggatgttgttttatcttgatgcattaaaatattttctttctatgaaaaagatatccaaaggtaaatttaataaaatgttatttttaaaaaatacaagctatttgaattataaattatttcttatattctattatttaaaatagcctcaatatataattatacttctactttagcatgaagccactaaataaaaaagggttagaagaaagtgattatgtaagtgtttatagctcagatacattagtagaaataataacattagtaactagcatttctgaatagtagtaggtactgtgttaaccatctaacatataaaaaatacttgatatgcattattttaatatttgcattgatggtttgaggtagggtattttattattctcattttccagagtttaagaaatttgaccaaattcctagcactagtaggaactcctagagagttccgatgttaagagtctgagttacttcagaagcaaagctcttaataagcaaatgaaacactccacttgacatttcctgttttgtaatacataatgatatcaaggggctgtggctcatcttattgttgaaaaatataatctgtagcctttccaaatcaaacctatttcagacaaaccctttgctggggtggaagggtggtggggaagcgagggagaatgccctacctagaaattctcatcctgttaaaatacaagttaagcctctttgagacacttgagtttttctactgtcttctccccaggtacttgccctgtttgtccatgactattttttcccgaaggttgatagagagcaatttcatggttacaagctttatgatatttatgtgttacaaatacacacttctatgtcaccaaagagctaaatatctttgaaaaattaattcttggggggaaaagaattatttccccttatcatgtgaattttcaggaagaaatttggaataatgcaaataagagatgaagtaaaatacccaaatatataaaaagaattcaaggaattcaagcatggtgtcctgtcccagagtctcactgttcagcatcactgttttggtattttcgtgaactctcaaaacccaaatatctccagagaggcaagtgttgaaacttcatgcttgtttttttgttctttttttttttttttccaaagataacccactgcattcactatcacccacaacattctcacagttcagaagaattctattaaattttttatacactgtcttttttgatggcagtgagccccttttgctggatatcagccctagaggcatgaattatatatctacaaatacactcataaagcaaaaaagccgggaagccttcagggctaaaatagaccttttatatctctaatgatctctctagtttaaagaaaagcacaatcctgccaaaaaggggtatgtatgcctgattttaaaatgctaactttaaagaatatagatagcttttatcccaaactaaagaaaaattctggggatagcataggaaattaggattttgatggattacaggttttgtattactctgctcataaccctttatgactttgggttatttgcttccatgaatacttttgtaggcatgggacacatagttgatcactgacttcatgatctctgggaagtgaagaaaatattatcagctacttgaacatttctcagggtagtcacttttgattaaaataaacaagaagctttgaatagcttcccaccaaactacttttttgtttgtttgtttgctttttgagacagagtctcgctctgtcgcccaggctggagtgcagtggcgtgatctcggctcactgcaagctctgcctcccaggttcacgccattctcctgcctcagcctccccagtagctgggactacaggtgccagccactatgcctggctaatttttttgtatttttagtagagatggggtttcaccgtgttagccaggatggtttcgatctcctgacctcatgatccgcctgcctcggcctcccaaagtgctgggattacaggcgtgagccaccgtgcctggccaaactaagttatttctattaatgatcttatagtaggagaaatacatcactttctcctctcaaatgatgtgtgcctttgatcccccaggacactattatcatctgcaatcttaaacatggaatttaatattaaaattaattacaccaacatatacacttgtcccaggcatttttcatgtttacagttatctaaaatgttctacctattttcattagaattgctatttgtcataaggacccccgtgtactgcagttgacttcattttaaactaaaggcaatcttcccacttcttgagaagccaggaaagaggggttaggaaagcttctaccactttgttgtctaaaaatcagcataatttgggctcagattttcccaacagagggtatcatttatcatttttatcgctgctaccgagattaataacaaaatggcaaagaaaactagagatcagtagttctgaaagattttgttttctaaactctgagatggcatacccatcattttagttttaaaataagctcttatcatttcactttgggactcaccaggcttttagaagctctttataaattaacaagcttcagaaccctcttactgtagagttataaaaaatgtggttactcttttttttttttttttaaatctaagatacttgcattagtgtgttaaatgagagggagatagcaaagtaaagtaattcaactgcagagtgaacagtttgtagattttgaaacaacaagtacactgtggaaactttagctggtattgaaaggagaaaaaacaaaccgaaaaaacaaaaaggcaaatttaagactccggttgggtgtcacagatggtacactaaaattgcaaatgaatgccactctgtaatcatgaagatggtgatcttaatcccacttaaagggacactagcctcttacccaacagtttgcctttatattcaaactatttgtaccagggctttgcctcctaagatatcagttattccttgtcctttaacctagtttcctctttgcttactctacatggggtagatttgtcattgccataaggaacaaatgactcggtgtttgtgccagaaaagaacacacatgttaaacctgtgttacagataagttaaaaaaaaaaatcctgccttgtcctctgaaggtaagtaaaactgtgcctgagaaatccttacggaagctttagacagagtccatgggccttcacttcctctctctcatcactgctctcctattactcaaaccttgccctctttcatatatcaccttaaatctaccacttgggaccccctagcagaagaataataaaaaagtttgctcagagttagttttaggactggcttacctttagggaactgcactccaaatcccatttgtaaaaactagcaaaagtgtgtaaattatgcattaaataagttgtaaggcatatgaattatatatgttcacaatgtaaaaaaaagaaaaaaaaaaaaaacaggtgtctgctggtctagtacagtaagtgtgaatctttggcaaatctgcacagatcattttgctcaatagtttcaaactctgagcaccagaatagaggcttaggtttagagcacatactacaagatcatcttgagaatctcaaaaaggtatttttttaaatttcatagtaaaattatcacataggccagagatgacactgcaacattctgttgtcccttcccttctaaatggtacacattatatgctttctcggttccctcagaaactcagtttctttctgcagaacacaattgttattggctaaacagggagagaataaaggcttctgacatgggcaccaacagtttctcagtgcttgaaggtaggtattagctttcttctcaggaagcccttctcttagcacacctgaaacctggacaatttggatgcatgggaaaggtttcaggatgcaaggtgtggaaaggttgcatcttgaagcatttcctatgcattcaaaaggagagttttaatttgtgaatcaatcttcataggaaaaaccctggaagactgtgtaggctccaaggcttattcacttggagtcccctagaactctggtactgaatcacctccttgtctggctttgttactgatgaggtgggtacctcagctacagtcttatctgttaacagctactcaaacactgattatactatcacagcaaagttattaccaagtgtaagagacacacgtacgtggtaccagttgacagctcaatgggtcagctcagaaagaggccttcaacaataacgtcacattagtacctcaaccttctaaataactggggcagggaaacattcgcagcatccctgcgagtggattttttttaagtgatagtgggaatacatttttctggaatatattcaataaagagacatggactatgacttcttaagattcttcctttgcttggaaaacaacattataaagacactgaagagagatcagttatcctgctgacatagatgcatagcaatcttggccttacagtagggtaagcaaccactactgcagaatatttgtggtacccatgatctgcaaggccctgttatttaatgaactattctgagctttctttcccaacttagtctgtatgattctaagtgcaataacgagggtctatgggtaaacagatatgtttttgccacactagttagcaatcaccaatttaaaaaactcactttgctaagtcaacatttctgagtctaacagtttcaagtcatggatatctaggctgagtattttgaaaatctagcttccagctcagcatatattgcatacagcatgaaagcaatgcatacaaatattagactaatgcaaggcaagctgtcatttaatagtcagggggatttctggaaaagcatggtcaaaatggatttgttagatgaatatttttaactttttaaaaatccctattgctcagcttatagtaaacaaggactgtgattaataagtgtgaaataaaaggaagtaacttaagaaaacacaaaagacacaatcttttatgtttcttgatcttggtctcaataagatggtgaatcggtcattctcatcctcctgggagcaaatgagcagaatcccaagaaggcaataaagaaatcttaaacgcatgttaataaattcttaagttaagcacacaatgtgtgcgtgtacccacacatgccaattttgatagccagccagtatttataacagtatcattgactgaatgtcatcagcccataagcagatcctggaaagaacatatatagttgaattttatctaaataattacttgagagtatctttaaaaaatctaagcccctgatctagggatttcaggtttgggtggcaagaggcatacagaaggctccaaatctgcctagaatgattagactccatccagaaaagatccagatctttttattataatttctgaggcataatctgtgaatgacgttggttgagtgagagttgtttacaaatatactaattgtttttctttttcttttccatcccaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttcccaaaaccttgtatgctgatgcacttttattttcttaacatttgagaaaatctcgcactgaagctaattatgtcatatcttattaaaagccgagtaagagctagaccactttcatgtgatagaagatattctaagcagttactaattattacattatcaaaatgccatatttatgagataattatctgttacttgaggcattattttttagattgctatgatagaataaccaggagggagtgcatttttctggaaagatgatagaaacattgtattctagaaaagattattggatactatggttttgtttgtttgtttttgttttttgtttttcgttttttgtttgttttttttttgagacagagtctcgctctgtcgcccgggctggagtgcagtggcacgatctcggctcactgcaagctccgcctcccgggttcacaccattctcctgcctcagccccccgagtaggtgggactacaggtgcccgccaccacgcccggctaattttttgtatttttcgtagagacggggtttcaccgtgttagccgggatggtctcgatctcctgacctcgtaatccacccgcctcggcctcccaaagtgctgggattacaggcgtgagccaccgcgcccggcttggatactatgttttttaaaggcatttcgtaccttttacgtattttctataagtcaacaagctttaaacagtatttaaaactatgttcacatagtgccataagcactagaaagtcttagatgtcttctttccaagcctcccaccatattaaaatttaaaattaaaaaacagaatccaaaaccaaaatttaaatgagttcttcaattttaacagcttcttacaagaatttctgattacaacttgtttcatacacccattgtagcagtaatgtctcatatttctcgttctctcagcacacacttacttggccaattggataatccatctaccctttgttcttcactgtaatctagaaatatagatttaactgaacagctgtcctttatccatatgttggttaccagttttcaaagagttagaattttaaaaatatatatttagttaagcctgtgccttcaagataacattagtggagtggttatactatcgactatgttaggaatgggggggagaaagtcaggttcagtgatgtcaaattatgtaaagttttttttttgttcctgtcttcaaagttctgtattagatgttctcccatcattttttgagatggagtcttgcagcctacagtgcagtggcatgatattggctcactgcaacctctgcctctcaacctcaaacgattctcctgcctcagcctcctgagtagctgcgactacaggcatgggccaccacacccagctcattttttaatttattttttatttttttagtaaggaagggtttcaccatgttggcaaggctggtctcgaactccttacttcaagtgatccacccaccttggccttgcaaaatgctgggattataggtgtgagccactcctcctgaaatctttctaaatctcactaatatataattctaggactactttaagcattcactttttctttaattcaagaaacatttattgaacacttatgtacaagctagtctactattggctattgttactttgtttcaatgaaggcagaaaatggctagaaggattttaagcctttttgtctcttgtataaatctatacaggtccagtctctctttgctcatattcaaattgaagtttgatctttctccaaaaaatatccaagccctgtgtttgtcccagttgaactaatatcttgattatatagtttaagatcagtttgataatgtctattgaatatttactaaatgattatgggatattaaattgagagccttgggagcttatcatctagtaaagatgaacaaaaaatggtactatagtgaatgcaaataagctatcaaaaagtacaaactaagttgggagcttagaagaaattatgtaagggaaggcttcatagaaggggtgacattttggtaaaccttggaaaactgataggcagaaataagggctgtatatcattctaagcaaacccttaaagtgggagcaagcaggatcaaaaccataatttggattgatgacagactgcaaaaagtacattggaggaagatatgagtaggaaggtttttgaaatcatgtcaatgaatgggaagagagaaatgggagaatagcttgagaagttcaaggtcaagggctgctttgtcgagtacaaaggactcgagcatatttgaaatgaaaggtaataactgatctactcttatggagcaaccgagtttcctgatagagatgtttatctgggggaaaaaggcataagtcaatcttcttggagagaatgggatcagaaactgacatattgctacagaggttacaaaagctgtagtcagagggcttcagtgttctggatatattaaaggacaaggtcagatacccaagtgggaccgtgagtgattaatggcagcagtccactgacagcaccagtaggaaggcgctaatgaaaagatctctaaatatcagtaaggggttagctgccattaataatacaactttatagctttactattttttcttttattgttgaaatagtgagggcacgtatttttctaattgtgtttattacaaagaaaacagacccgaagaacttaaatgacttctccaaggtcacacagctaatacatgacaatgtcatgacttaaaatccagtcttgtggttccaaatttagagctctttcataaacctgtctctagagaagcaagtcattttctactttttccagaagcatttgaagtggaagctaaggcaggaaatgagaggatattgtgttagtctactgggattaccctggcaaaataccacaggctgggtagacaactgaaatgtatttctcagttccagaaacaaagttgcagatcaaagtttgttagggctcagtttctgggaagggctctcttcctggcttgtagataataagctaccttctcactatgtactcacagggcctttcttctgttcatgcactgagagatttctttttcttgctcttcttataagaccaccagtgctattggttaaagccctgccattatgactttgtttgaccttaattacttcctaaagacactacctcccaatacagtcatgtttggggttgggacttcaacatatgaatgttggaggggatatggttctgtttctagcaaatgtatagtagtgggaattgcaaaggttgaagttccaaagtatcaagggaatcagaattgggaagcaattctaacctttttgaagtggttacatggcccaagtagaagagcaaataattccaagagacaccaagccacagagcaggtaggatcacgtgagtagggcccaggatagaagagcagtgttagggttgcatgagagtgagggcatataagacaacaacagctaaaagcaatgcatgctcagatcttgggagatgtattaaatgagtagagtgaatttcaagatatctgagttttttttttttaatgattacatgggttctagagtcaaaatgccatggctcatctggtactgtaacttaagataaactgcttagctaaggctcagctttcatacctataattttgttatacttatcttgcaggtttcttgagaaatattggatgaaataattcatgtgaaatgcttaacatatgtgtgacaaataattatccttaaataaatgttggtcgttattacaattggctttgttacttgattcaggcaggatcaaaattagctgctatatgcatgactaaccaggaccaaaaagttaataaaaatacgaaagtttggcactcttagtttttctctaattctttcatttgccaagacaatataaaatttagttgctagctcattagcaaagattttccttcatcagcactagttatttgtttccagctaccagcttcagttaggcccagggaagccctgcatcccgagaatgtcactccttttctgagtttccatccttcagctttcttgtggcccttggtcagccaaatacctcaggcaaccttgcacccctttattgatatgcattattttgtttttaactttttattgtgaacgttttacaaatataccccaaagagaatggcgcaacaaacccccatttatccatcacttggtttcaagatcaatattttgttacccttgttttatctgtgcccacctccctatgaaagaatatcttgtaatattacacaaagttataaaacaaaaagcattcaaagagttgctgctgggcctctcgacctgagtcttatttagtgtttcagtgtacctaagcctaacgttctttctgatggacaattaatggcatgattctagttctttattcagtgacaacctaaaagagattagctgctaagtagactcttcatcatttaatgagattgcctgaaaaagtgaaagatgtttcagcttgtacgtatttcaattcaactgtgctcaatcaccttttaaaatgaataaaaagcggtctatagattatatattgctgctatatcttttgtaaaatgtgccattgtggaagagaatctgtactctttcaagagagtaagtaaaaggggagacttctaatttgtacatgtgaaagctaagaaatacctttacctctaaaaacatgatcacagatctactagcatattttaagagggttatattcatgtattttcaatagctgtaactatactgaatttacatgagtctacacagaagagatatccttaagcacattttcaagttatgattttttactgctccattgtcttttgacaatgattttcttctttgttctcactcacttgccatttttgacctagaattttcactataaaaatatcatgagagagagactcagagacacagagttatagactatttgatagtacattcttttctaccataaagtcaaggtaagtgttaggatgaatggacagaaccactataaacttttgcttcttcatttcatggagccaaatggaacatagaataattagtttcaacaagttaatgatttttctgttcctactctgcatttggtagtttgatattttatttattttggaaatttagcagagcatatataaacattcttaaggcaggtcctttaggtttgcaaaagagtacagtagacaggctgatgggtgggggtcagaaagtagataaaaacagaggcatcattaaaactgaatagctaaaacttccttggcattacagtatagttttcaatgttcatataccacgcaggaaaatgtacttatatgcatgtatgggtatgagtaaccagatctggtttgatgtcaaatttgatgtgggaagtctaggacagttctttcttaaaaaccaaagcaagaaagaagaaaaggtagggcaggggaagagagcagaggcaggagagctgcttctaagcagtttgtaactgctcagaagacagttccagaattaaagcatgtaaaataataatgaggtctctcccttcatgccagtagtgtctgatgctaacagataagctctgaattcacgcacacacacacacacacacacacacacacacacactctctctctctctctctcctgtctctctctctctctctctctgtctccacttcttttgaacaaaaggaaaaaaatgagttgcttgttcctatatggtaatacattgtaaatcgcttcaggtattgtgcttgtcttttgtactagaacttgtgtatctttttcttttaaaaatgcaaaacatatttaaacactgctattataaacaccacttccctaaaatatattttaagaacataattcccatatgtgcttaggtggacaggcttgacttcctcatctggcaaatgacaagctgcaatttggtacatatatgtacaccagggcaatagcatttttttttttttttgagacggagtctcagtctgtcgcccaggctggagtgcactggtgcgatctcggttcactgcaacctctgccttcctggttcaagtgattctcctgcctcagcctcccaagtagctgggattataggcacttgccaccatgcccggctaattttgtgtatttttagtagagatggggttttgctatgttggccaggctagtctcgaactcctgaccttgcgatctgcccactttggcctctcagagtgctgggattacaggcatgagccaccgtgcccggccggcaatagcttttataactagacaggttgatgttatgaagtagtaactggcaagtgtattttactgagaacattaggtatagataagttaatgggctttgaaaaaaaaaaaggataaaaagtaattggaccactccttggtcacgattaacactgaaaacagtaatatttttttttaattaaaagattttacaggtcaaccatacatggacatgtgactttgatatttctatgacataaatcagttgaagtgggaccgccatcatgcctatatcaaaaagccctctacatgcacacaaaaaggagaaagttttcaaagcctaagccagtcaaataatgctcagatgaaacagcggattacaaggcctcggttaacaagtactccagctcccgaaccagtgggcatcccaacattgactttggcaggcaggtgctggatgacatgcagaaggggtccttagaggctgtttccccttacacaacctcaaagaagtttaaattttcaatttactttttaaaagcagatacacagtaaacattggaatgtgagttttatgctaaatacattttggtttcagagtagttatctcatgctgccagaatagccctgaggattaagatggtttattgggatcaaatgcctaggagatttattatagtgcagactgtttactcattcccattaaaatgctgataatgcttatttctttacctctctctcccgcctgctttcttccttcctccataacccatattctattattttattttcctgctttaggttgaatctacttagatttttattctttattaaaaattgaatccttggaagctctctgactttatggctgcaagaaagtggcaatggcatacatgcagctcattaaagccttgggaacacggaatccctgcttagcaatttagatctaagaagtattttcagggagagtgtctaatgactggagagatgggtacacactggaacaatttatattaaaagatcaaaaacaccctggctatcatcatctataatataaagtcacgtagaagtaaagataattttcttccaggtagatgctttagttggataaagaggaagattatctactttatggccaaattctatgtaaattatatgtaaaacattcaagaaggcagatgagtttacacacaatatagcagcttttaggaaaatagacatgagacatcagaaaatatgatcacttaaactggaaagctagagcccaggaagtaatcctggagaacttgataatgcatccatatttataagaaagccaatcattgaatctatgaaaatatgtagaatgattttatgaaagttgtggttggtcaggcaagtgtttgccatgatctaaaatattcatcttgaatcctcagtaacccttacagtgtctggcacagaggaggtgactgagcaactttagtggaaggaacaattgaatatagctgatctgatactcatgggatgtacaaacacatctttatcattttccttttttttttcccccagtactttgctttgaaaatttgaggccagccatttgtcaaactttagcacgtgtgagaatcacctggagggctcttcacgacacagatcactgaccccactaactacagttcatctggaatgagatctaaacatttgcatttctaacctgcaaaggcagttctgtgctgctggtccatggaccacattttgagaagcacagtagcctataaagtcacaaaagagcaattatatacttcagggcaaaagagtagtcaactccattaatttaaaaagcatgacttgatgtcttttcctgcccaatggctcagatgtcttccaatctgaaagctctttgaatctatgatgaattatttggatactgctgatgtggcagagaaggaagctgatttgctagaggaaagtgataaaagaggaatgcagccaattgagccttactattaggatctgtgctaaactcttatctcttgtcacaattgagaaaaatcaggcttagagagtttaagtgacttgtccaagttcacacttccagtaagttgtgagatcagaacttgatccttccctgatacctaagaaattaagacatgtaagccaaattccaaatataggccatggtagcagaaccagtattgacagcaatattaacagtgccaacaattatagcaatttgaatattactcctaaagagtcctatgatatggatattatcttcattttatctttgagaaaactcagaaaaataatctgtctgagattacatagctagcaagatatggactaaggagtataaactccaaagcctgccttgtttatacaccactaagacctaacatcaagcagtacccttcctagaccctttaatgtaaatacatttatcaaatgtggatggcctataatgttactataggattccactaaatgaaattttgtcatttgcccattaacgacagatgaatgctgtgatgacctacctgatgcatagtgtcaaacttttatgtccctatccataggtttactgggtccaatagtacatttttataatttattttaacaaagcaatatatacatatagtttaatgggacaaataaaagctttacaataaataacagcagccccctgctctagttttccttcactcctcccacatcctgcttgccagaggaaaccacattctggtcttattttctctggtaattacctccacatttctccagataaaatatgaacctatcttttgactcactgatttcagatgttactgacttcctaatgttaaatgttaggattttgtctgacacctccctttctcttcctcattcttccaatatagttatattatacattttaattaaatactgttaggtccttttatgattatgactacaaaaatactgtcctgttgactaaagtatttttagaattccttttgcttttctacctaaatttttataaaatgcttagctttttctggaattgataatcacttttcattccccccccacctcacctacttggattcatttggctaaatcttctcactcccattaatagctttcacaaatgactcaagataagctttcacaaatgactcaagacaagctttcacattgtcaagtcttactaatgatgtattcaatctccttgtgttaatctttgaggcatctcccccagagttctctattttcttgctccaatctgaactggttgctctttcaaccactttcacagctactacccatcatcatcaacttggttttttcatcctctcctgtgatggatttcctgttttctggtttcacattgttcctttacattattcccttagtttagtaaagcacattctctagtagccccctgaaaatggatgtatcatatgtatctcaagatttttcatatctggaaatattatcatttacatttgatacttttcttcaagtacagaactctagagataaaattctttcccctatttattgtatttctctatggtcttctagcttctaatgttcctgctgggtggaccaatgacattttggttctttgtcttctgcgtgtgacctgttatttttttttccccagaatattctctccctggtgtttcaagtgccatgatgacatgctttggtggctgctgcttggttagcaactctatgaaccttacaatcttgtcagcagaataaggattatattcagagtttaatcaaatatt

SEQ ID NO: 369 - DNA, 432455 bp, Homo sapiens
agtccagaacattcagcaaatatttatgaagtgcccaagtagaaatttgcatggcaaagagctggggttgaaaatgaattatgcccacaagaagcttataaattagtgcagggataaaaagatctccaagatgagggcgggaagtggtatgtgccttaagaggagagcagagaaaagagaggaagatataagggtggagcaaggggaggttgattttggttggaaaaaccagggaaagcttcttgtaaaatgtggcaattaaactttcccagcagactaggtagaatttgcacatctacaactggcttgtacacagattataagttagggcagccatccagaaggcacacagagaaaatgtaggagagagagaaataggagtccagtttgcagtgttcgtgcaggaaggaaacattggctggggaggtcagttgagagcagacagcaatgggtcttggctaccaggcaaaggaattgaagcaatagaaatgtcgggagaataatttgggaaagttcaggcagactggaaaagtggattcatgttgagttgtctgggtctgggatcctcaatgaaatctttcatctctatcttgtggggaaccgaaattgccaccttaggtagcatcttactctagccatcttcttatatttggccagacttctttccttgcacaagacaagcccttaacatgctgctctaactttcccatttgtcatgatacttaggcaataaagctgcgggttgctgagagcctgccatgtgccaggcaccttggtaagtttgtcacatgtataatctttttaaattttctcccaaatctgacgtggaaaatgttccccctcgccccccttttcttttcaggcaaggaagcttgagtcctagtgtagttaaccatgtcctaagacaacccagcctctaagtgacagaaaagtgatttgccccattgtattctgttctttattctatgcaagcactcagagctcttaatgttgataaataaataataacagctgacaatgcatgtgctcaacataccacatgcagtcactcacaaaaataacatgaagtccttttactgtttttctcattttacacatgagaaaactgtcttaaagatttatataatttcccccaaatcacaaagttaccaggtggcaaaagccaagatttgaatccaagtttaaagcacatggtctttactcctttattataattgattactagtcttgttagcacagggaccagagtctagcagagtgccaggcacatggtgggcacatacatgtttttaaatgttctatgaacaaaataatgcaaatgaattagggaggagatgaaataaagaatgaatgaatgagtctgggtatgacaccaagcctgagttcttgatatggtccttcacactatgtacaaattttggtgaactactatcaacagcacagacgatatggcctggttctgactgtgtggtccatacagctgggctctccacaggcatggaattgcggtcaactgctaaatacttgctttttagtcagttatgctttacctatagaaagacacttctgggctgggcattgtggttcatggctgtaatgctaggacttcgggaagccaaagcaggctgatcacttgagcccaggagttcgagaccagcctgggcaacatggcgaagcctatctctacaaaaaatacaagaattacttggtcctggtggcaagcacctgtagttcagctacttgcggggctggggcaggaggatcagctgagcctgggaagtcgaggatgtagtgagctgtgatcacgccagcctgggtgacagagcaagactctgtctcaaaacaaaaaacaaacaaataacaacaaaaaaactaggtacatagcatgctttaatataaaataattcaattaacagcaatatgtaaataatcccaaatatttaggaaactttagcaagatttttgttttgtttttaaccaaatttcaccttttatcagttcctaccactgaatttttaaaaatgaacttttacattcagaatagttttagatgtatagaaaatctgcaaaaatggtacagagagtttccatgtaccccctatccagtttcccctgttgttaacatcttacattactgtggtcacagctaaggaaccaacactggtactttgttaattagacgccatacttcattaaaatttcattagcttttcccaatgctttttttttgtttcaggatccggggcaccatattatacttagctgttgtgtctctttagactcttctggtctaagtcagtttctcagactttccttgttttccatcaattgaaaacattgagaagggctggtcaggtattttgtagaatgttcttggatttgggtttgtctgatgttcttctcatagttagcctaggattatgggttgtgagaggaagaccacagaggtaaaaagtgccaatctcattacatcatatcaagactaccactacatttttaaagcgaaagctttaattctttcacttttggtggtgatagtgccacattactgtagttttgctgatggctttcactgagtctcaccggagagagcaaactctcctgctggcttatgagttcatagctaagtctttttcttttccttttctttctttctttctttttttttttttttttgagacagggcctcactctgtcatccaggctggagtgcagtggcgcaatctgctcttggctcactgcaacctgcacctcccgtgctcaagtgatcttcccacttcaggctccctagtagctgggactacaagtgctggtcaccatgcccagctacttgttgtatttttagtagagatggggttttgccatgttgcccaggctggtctcgaactcctgggctcaagtgatccacctgcctcggcctcccactgtggtgggattacaggcatgagccatcacacctggcccaagcaaggtcttcagtagcaaaacatttcgcaaaggaggagttctacttgttcagttttgcctaacctggataagacaatcttggctgtactaatcaggtaagtttcacccagttgcagtatagaagaatgtttttcttgtggctgtgaacaggtaaatggagacatttcttttctgcttttatttttcttcctctttttttcttatttctttttttctttctttttctcttttttctcctcctcctcctctccctactttccctcctcctccttcttcttttcttcttcctcttcttcttcctcttcctcctcttcttcctcttcctcttcctcctcctcttcctcttcctcctcctcttcctcttcctcttctttttcttcctttttccttctcctcctcttcctcctcctcctcctcttcttctgctgctgctgcttcttcttcctcttcctcttcctcttcttcttcttcctcttcttttctttttccttctcctccttctcttcctcctcttctttctcctttttttctttcttcttttttcccttacatttctaattcttaatggtgcagctgtcaccaaggccttcatggatgccagcaggaaacagcatttatgttgatgaggcagatgaaactgagcttatggggcaaagtcataggggaaaattataaatatgtatctgcaatcatatttttagtagatggtccccaaattccatattcgatttttttcagtaaagatgcactctaacttgtctttgtttggagtcatgcactgctgtctggacactgaagccagcctctgtcatggacttgtctgtgctcacacttccctgtgtcttctctgggagggtgctgctggagctgggccctggctcgagaaccaagatccatgatctccattcaaaactactttgcagttgggtttcagtcaggttttatccatatttgttaaacattttaaaatggttataagtttcaggaaagccagtaagtctcagatagatagaaaatatcaaggcaatttccaaatgacagtaatcattattgttctttaggaggccacatggaacaaatttattctggagtttgtctcactaaattttcttttgtttatttgtatgtatgtatgtatgtacttagcgtgtgtctcttttagacagaatataactcctgaaaggcaaaatagcatcagactttattgtagatcttggcttaaggtgcagatgttttggctcagttaataatcattctttaacctattttgaattttagttcatcaagtaataggaaaatatgacagttttttgaatgtgttcttaggggaggagagagaagagtgagagcaagcgagagagagagagagagagagtgagagagagaatattctcctttgaagatgagttctgggcaaaaaagggtcgatcttgggttggttttaagacattgccatgaaaacatccttttcccgtaatcacttcctgccttgtctttcaccacatctctcctctcattctttaactcctttacctagtgtggacccactgctcaagtttgggatgtgcttttctggctggtgtccacgtcttcctctggattgtcaggcctcagaatgagaagtcttaaaggtctcttccttcccgctttgccaccactgctggagccccaaagactttggagcttagcattaactcatcctttcaggtcaagcagcactggccttttaaagtggaaactgcttgctttgatgcatggaaatgcacattaatagaatctatctggggagggatggggcctatgcatgggaacagtgcccatcagacactatgcccagccacagtagctactctcctggggaggtggtgtctgagcaggtaggaggtaaggcagcctgcaagggaggggtttggggcagcagcagacttctaccaatgggctaatgtgctcttacctactcctgatagggtggccacacaaagccctttggttctcttgaccttataaaccagggaagccaaaagtaccatctcagtctggctcctgatcactacatgtggttgcctagaagtgactgagaaaagaagaagaaaaaaaaaaaaaaggaaaaggagaagaagaaggaagaagaagcagctgctgctgttgattatatatattcagtgcttaagtgaccgggactgtcttgagaatttataaacatcaactcatttaattcatacaattccatcagagaggaacttttgctgtttccattttatgttagagacctaaagttcaaagaaattaactacagattgagtatcccctatccagaatgcctgggaccaaaagtgtttaggattttgagctatttttggattttggaatgcatgatgagatatcttgtggaagagattctaaacacaaatttcattcaagtttcctataaaccttatgcacatagcctgaaggtaattttgtttttcccttggggatgctgaatgaactgtgttgtttgcctgcattttgatggtgacctgtcacatgagattagatgtgaaaatttccacttgtgtcatgtcaatgttcacaaaattttagattttgaagcattttggattagggatgcccaacctataacttgtccaagatgatgtagatagaaagaggtatgaccaggtttcaagccaggttggtctgagttttgagcctctcttaacaattctgttatattaagttaaacaaacaaacaaaaacctaatatccaggtgctgaaggatatgtgttatgggtgtgtatttgttttgcatatgtatgtatgcatgcatgtgtttttgtgctcatgtgtatgttgtgtatgtgcatgtcttagtgtatccatgtgtgttttgcctatgtgtatatacttatgtgtgcatgtttgtgcatgtgtgcttgcatacatatgcattaacttgcatatctgtacatatatatttgttgatatatgtgtttttgtgtacgtgtatgtatgcctgtgcatgtgattttatagtacagtagaaaatacagctgagaaaaaaaccttgataaaaatcaaggctcagtgtttaaatcatgtccacacagtttctatagaaaatggctttaggatatactaatcatagccctgactaaatggcctgtggccccagagcagagtcagcaggagggatgcaggtggtgtagaagccgtgcctacttttagctgcccatgaactcccacttcatatgcttctgaatcctgggttctttggatacatttatctggattgagataattttcttattttggaactgtattagtccatttttgtactgctgtgaagaaatacctgagactgggtcacttataaagaaaaagagatttaaataactcacagttttgcatggctggggaggcctcacaatcatggcagaaagcaaaggaagaacaaaggcatgtcttacatggcagcaggcaagagagaagtgcggagtgaaggaggggaaaagccccatataaaaccatcagatctcatgagaactcactcactaccacaagaacagcatggaggtaactgcccccatgatttaattacctcccactaggtccctcctatgacacatggggattatgggaattacagttcaagatgagatttgggtggggacacagctaaaccatatcagggacattgcatttcttgagtaaattcaagtgtgttgtcttcagtttattttgattcttcatttgacttaaagcaaatgcatccctttccaggaccatcctggtaaacatagccaggtcttcagaagtgcttgtaaaactgcatgaggtcactatggggatggggtggctcatgactctactgtgggtttatggaatgccaagtggcagaaacctaagactattcctcattttcttaagccagtagaagcaattataacatgactcattatggcaggggttcatatgtgtccttgcccctcataacccaagatggcatcaggtggagatgagacaatgtctgctccaaaagggggtgtttctttccaatgtctcttttaaatagggaggacagttttccacaaagccactccatggttcaggattgggttacatagccatgaaatagagtcagcaaactactatagcccgtgggccaaatctggctagccacctgtttttgttcagctcacaaactgagaatggtttttacatttttaaaggataagaaaaaatcaaaagaaaataaatatttcataacatacataaaatccaagtttcattgtccatcaataaagcgttattgtaatacagccacacccaattgtttatgtactgattagggctgcttttgagcagcagagccagagacccctgtgcactgtccatggagcagcctgagcaaagcaccaagctgagaaagtgcgtgggagagcaaagtgtctgatgcagttggaaaagacactgaggagattgggttaaggtaagattttggaaggccttgagtgctgagctgaaaaggaaaacttcgtcttgttgaaatgaaggcttttgaggaaggatgagctgtcctgaaatgtaacttgatgaatatgacagataggatagaagtctgatgtgatatgattgatctgtaatagtggttagctctgtgtcttagtctgcatgagctgctacaacaaaataaatgttgtagcatttattttgtaaataaggaattttataaaacaaaattccttagatcaaggaatttataaaaatagaagtttcttcctcacaattctggaggctgggaactttatgatctagacaccagcagagtccgtggctggtgaaggctctctgcttcacacatgatgtcttcttgctgcatcctctcatagtggaaggggcaatcaggtttcctcaagcctcttctataagtatacagatctcattcttgagggtggagtcctcatgacctcatcatatcctaaagccctcacctcttaatactgtctcattggtgattaggttttgatatataattttggaagtacacaaacattcagaccatagcactctgccatataaccaaaattataaagagatctcaccaatcttaatataaagctaggaaaatgcaatgtggctaaatggacttgaacgtgtgttttgtgctggattcactgagattttttttaaatggagttgaacttcaatatttaaaaaatctgaatttgtaacctctctcacatgacaagaatcagctggagctgagttgggactgttatttttaggttttccatagtctatcatgagttagtattcttttgacattgaggccaagtgtgagttgctatttatcgttgctgtttagggtaaatgcttgctgctgtaacaaataaaccctgacattccactggctcagtatctaatatatagaagtacatcacttaccgatgtaatagtccaacacaacacaaaggttcctggtaagtggatagtcttcttccatacgatcgtttaggggctaaaggaattttccatctcatggctcagccatctgaaccttagaggcctatgtatgcagctggtggatggggaagagaagagagagaagggttagtttctgaattgccttggctcagaagtaacatacaacaattttgctcatattctattggcaagaactagttaatggtcccaatcagcttcaagggagctataaaaagtattccatgcagccactttgtagcaacaactatttatggaaaagggaacatggatttgagtagacagttggtcatttcagctactatcatcttttctctactgtttttctaatggtttagggtttactcatgacttttcttattcttgactgatctcatttgcattacttaagaagtacttgtaggcaattggctttgtagctcctggtgtgtggttaatgcattactttagaacaacaatttagtggatataaagagtccttcctggatgggaatgctttgttaaatttatactggtatctagtcactatatctgtattctgaccattttggtctttctaccagcttccttctgtttagatactggactttatattttgttttctttgtttgtgtagcagactccttcaaaactttatggtgtaaaaatacccagtcattttattaagatgatgggttctatgggtcaggaatttggacaagcacagcagggatggcttaactctgcttcttggtgactgggtacctagctgaaaggcttaaatgtctgggtgtggtggcttgcacctgtaatcccagcactttgggaggccgaggcgggcagatcatgaggtcagggaatcgagaccatcctggctaacatggtgaaaccctgtctctagtaaaaatacaaaacagcctggcgtggtggtgggtgcctgtagtcccagctactcggaaggctgtggcaggagaatggcgtgaacctgggaggcggagctagcagtgagccgagatccaccattgcactccagcctgggtgacagagcgagactctatctcaacaataaaaataaaaattaaaaaaaaaaataaaggcttgaacatctgcagaccaattcagatggctggagaatggaatcctctcaaggttcctttactcatatctgtgaagactggaatgctgggattgtcacctgtagtgttccaaatggcctccccatgtggtttgggcttcctcacagcatggcagccttggatagtcaaactccttacatggtgccttaggactccaagagcaagtattttaaacaaacgaggcagaagccctgtaaccttttatgacctagcattggaagtcacatggtgtcacttcggtagaatgctattggtcaaaacagttgtcagcctaccttgatttaagcagagggtacttagaccctacctctttatgggaagaatgtcaaacaacttgaagccatgttttaaaaggtacatagactgtcacattaattggtatctttgtgcacataatataaagcaggccatttagcgaaaggagtaagttttcatcaaaagctcaaaatatctctaactttctttgatcacctctcatcactgtaaggagctaaaatgaataaggacaattctaattgctttaaactgtgaaatatgctacacatcccaggtactctctttagaagtctggatttctttttttgaattttaatgcattggactttgaggcaatatggaatcctatctggtctggaatcctctctagcctgatatgtggcttccctcccaaaatgtgtttaggtttcaagtctggcttcagaccaatcaggctatctcaaacagaatttataattatgggatgcatttggatctatatcgggaatatcacctggggtgcacagatagaattctgggagtccatgatcttggatgggaacaattacatgtttattttcactaacctctagttaaaatacagcattttcttcaattacaaatgtaggcaataaattatatttattaattgtatatatatttttattaatcttttcagtacctatgactccaggatttgccagtgaaagaagtcaacaatattttaactttgatcttaaccaaaaggccaagaagtgatgctaatattttcatatactacgacagttgcaggtatcttgaaattctgtttatgttcatcactactttaaagttgtgatagttattagctatgcttctaaatgacatgtgactacagtctccctgtctacagacacacgtctatcatagctgggtagtaatccaggcaactctgccacaagtcatgggctcagccaccagtccacgaagtctccagtcacacatattgcttcggactattctctatccccagttgtcaattaactaaaatattaaatgaggtaagttattttcattgtttgataatgttttgcaaaactgaacaggccaaatgagaatttatagccctggctaaggtggtgcagtctgttcttcctggaattcccagaggttgctcaggtttaggattcaggtgcgattgagggaggaagcaccatgagtcagggcacagaaacttgatcaagtggtataagccctggtaacatttttcatttggaagtttcagtgttctgccctaatagatggggccatgtaatgaaaagacagaagctttacaaaattagtattttgggagataggtgatacaggcacattgcacaaaattgaaaaattcagaaggaattcagtgaaaatatttatattactcctgtccctcagccacccaattttcttccccagagacaacaactgctactagtttttttggtataattatcgatcgaatgaatatgtatgcaatcaacatccaccataaacacatgccaagcccctactataacaagagtcccttattttgggggtatcatgaaaataaagcatgacattataaaattcaaattggtatggaaagatatcagttacaaaagaaaatctttcttgatccttctccttttaaaaaacttttttgggatcgtttattttttagtgcttctggtgcctagctccatactttaaataaagtgcttatatctctatttctggacttatcaacttcagataggactctccagtatgatatgttttatctaaagcaacctatattaactaatgtaagtgaactcctctctttccatttttcagttagttattctttttaattcctcttttggttatcttcacaactttaaaaactatttcttttgtagtgtcaacatcaataacattcgttttttgctctataaatatgattattctatgcattgtccatatgttcattctaaatattaacaataattcaaagcttctaagtttttatgaaatattataacttaatacaaatatttgttatttccaaaatgattattgtgattggacctttagagaaggaaatataatcaaaactgctgccatgcaaagcaatgttagtaataacaccaattcttatggaatactatcaatcccactttaaagatgaggatgtagagatccgaggggttcagaaccttgtcccaaggtctcaccgtatttggtagagcaaagtagacacggtttgaaaccaggcagtctgattctagtccatgatactcactattacactgttctgcctctttaagcaacaacatcaaatggattctcttgccttctactccatcaatttcctgtcacctgaaattctttgtagtgaagaatatatgaaaatggttgaaataaaatgtaaaaataacccttatgcccttcccataaccattgcccacccccaaaaaaatcaacgtcgatagtttggtgggttgtctttccagtcctttttctatgtagtttaacgagctcacatactttaccaattgcttgctttttgatttggatatcttcccatatgagcatataaaaatctattacatcctgttgagatagcactttaaaattcctttatatggatgtaccctactgatggatgtttggattgcttccagttttcactattacacacaaagcagccaagaacatcttagttcatgctctttgggcacatgtgtttttctctaggatatgttggtagcaatgaaattgctgagagtgtaggcacatttaaaattgtgataactcttgctaaattgcttcccttctacacacagaaggctttaaaatgtacacttcttccacgttgaatgagaatgtttgtttctttatagcaccttcagcatttgaaatcatcaatatttttactttttgtgaggctgatgggcaaaaaattgataaactggttgttcgtaagtgattcttttattactaataaggttcaccatctttttattgacattttgtcatctgtttgttgacatttgtaattcccctgcaaattgcccgttcatagcctttgctcatttaacaattgagatatgggcctcttatagatttgtaggagatctgtatagtttggataataatcctttatttagtgcattgtatatattttcttccaatggcgtgcttatttttcaattttatttgtgctttcctttgtcatacagaattttacatttctatgtagccaaatctgttaatctaccatggatatttcagttagtatctcaaagccaaggtgtttaaaactgcatttcccatcgtgcccccaaataccttctcctcttgaccatttgaaacttgagtcttgtttttgtttttttttttttattacaagggcagttggaaaacttcatggccaatgatcttgtaatttttttaaaaaagtaaaatagaagtgtaaagatatctttttaaatgcaattatcatgctcttccacgttgcagcagacaacaataggttgataaggtggtgtctttgcaagttcctgcactgaaacattattacaaattactcaatgtgttgcctggggataggtcctccaccctgatgttgtcaaacttaatttggttctctttagctcactaatctccaaaccagaccacttttcagcccacagagacccgcctttttattgtgagcacaataagggtcgaaagcatgtggaaggaatggttcaacgttttgcattaaccccagggcaggtgttccttcatggtggtaaaaatggttcctgaattctacccatattggagtgagggttgatagcaaacctaggggacatgatcagtttaaaaaattgcgtttctttccttccttcatgggctcctctccatgcctcctgctcctcctgaccctcccatctgccctggcaaggaagagagcacactgctttctgtccattctttgccctctttcttggcttccatagctatactttggggacctcacagtaacttcccagtgcacctcacagtaacttcccagtgcagagcacttgactgcacggaacctggattgactcaaacctgtgaatttcccttcctgaaacctaggatgccatggagtcccccaactgatttcataaatttggtgtcacattgtaaatcaagcagctgcagagtggctgggacatctgtttggttctgttattctctttactccaaaaggaaactaactccaaaaggtcagtaaaatgtgcacattgccagtaagtgcctgtattattcttcccaggcatggatcaaaaatatcaggatcttttgcttgttaaaagtaaaattttgtgtgcacacacacacacacacttattgtagcttcatggaactctgcctaaaggataaggcaatatatcctttgtttgcttttgtaggaaaagcaaataaataagtggtatcctggagtttacttagatatctgttcatctttaccaatttaaagatgttggaaacagtgattaaaaaatagctaaagaggatgaagaggatgcaagacaagaactgctatccataaccattaggttggacatgggaggccactttctttaacaggatttttcctatttccctttctcatagagagtgttaggctaggctgtgctatgcttacaaataccctttccctattccccacccacagctgcatattactcactttacattacacaggttcgtttctggttcttgcaggcctgatagggggcagataatcctcctgggaattgatctccctgctgggaggaggggaactcagtgccagagggttgcacaccgctcttaagggcagttctgtaagtgatagatgttacttctgctttgtttcttttgaccgcaactggccacatggccctaccatgggggtttggaaatatggaagagcctatttgataaatagtaaaggtctctgacacacaagctgtatctgaggcagacataaaaaagatacaattcctcatttttactacttaatttttgacttagcaacagtccccttcacacttccccctttcttttcacttctactaccaatatccataaaatatgctaaaatctaattttaaataaaaggttaaaagccaatatgacttagaaggtgtgtatacagaagaatatctatggactgtaatatagctctatataaataaaattattctatcacaaaatagagttcttaattaaaagttcccaaccaagttaattcccagcccctaaacagtttctagagtagactacgcattcagcagcacaaaacaccttcactataaaccctcctgaccaacactaattaaatatacagattcctggtctctgtcctaaatctacttacaccggaatttcctggggtagggcccattttgaaagagcaccacagataattctaataaatactgaaatttgagaaaggctagcttgtattaattttcccaggagcatttacatatttcaaaagacagctgaaagaaggaaatgtttcatatgaaggagtgatttgctaaaagctgagattcaaacaccagtggggcagtagtctttgagtgagggcctttctgtattgggccatactcagcatgtttgcttatgtagctattcagctacgtaaagttgacatgtacagtattttgggggtatcctatagtattctatttttgcattttctggctcaccctcatggaggatagtttcctattaatggcttttccattttgcctgtaggatcatcttcagtggtttttgttttgttttgtttcctatgggattttcagatccctggaatatgaaagtatccctacagagtagtttttgcttagttttatcaggtgtccagtggatttcacttgctcaggacaacttgcctgaggttggcttcacgacacttgcagagaattcctaatttacacatggcacgggcatgccttgtttggtcctgtgcatccaaggccaagggcagagatatacttccttgctgcttggtaggccaactgtaatgtttgcttctggtctcctcttcttgaagaaaatagtccctccagtctgctcagggcagatatcttactccctcaggagcatcagaatttctagatctgatctgatttccccagcacccatcctttggaagccgtggtatcatctctaagatataactctgtagcttttaatttctccttttccttcctggtacctgaagatattcatgtctttattttgaattcagcttagaagttttttaaaaaatgggtctatttgatccattatgtgtttggagccaggcccgggaaaaagcttatacttcatgactcttcagtctgccatttctcttgaagttttataaggttttttaggaggcgtgttactttacccttagttatattcatttgttttgtgctgccactgctgttttgtttggtgaattttctttgctcttgaacaatatttgatgttaaaaaggtcccatttcaagcagaaaacaggccattagtcacactctcccatggaactgagtttattttcctcacatagttctcatcacactatattgcagtcagttccagacagctttgctttctgcaccgtaggcttctgggcccagtgatcagatctcattaatctttttatctccagttctggcacagtgcctagcacataggattggacagaagaggtttgtgctgttggttattaaatagaaatccttgccgatgatgatgatgatggtgatgaatgctaccacaataggaaggccccacagaattctgatcctggtatggatggctagaacgtccttctctgtttattggatttttaagtgctgttaatggctattaactagtctgtgtagattaacacctgctccctgcctggatgcatacacagccattagttgcagagaatagcctccctgagggatcaaaaatacataaaaatttgggaaaggatttgtatcctttttctcagtgatggcctctggtccccaggtacatgctccacgaccatctgctacaagctctgcctgcccctccacccactcagcctcccttcctccctctcttcctcctatccttccactcttcctctctttttttctctcttttacaactatagatgaggtgctttgctgagtaaaaccatagtaatttataataaatacttgttggatgaattctctaattatccttaaaaggacaaaaatacagtctagctcattttttcatacaaaggcatcctctaatgtataagtgaattatagctgttagcatttactaaccacatcatcatctactgggtacttgttgctaagcattttacacctatggaatcatttcaccttgtacgtgacctgtgagatggaggatattacacatatgttgaatcttactggaggcagggagtaggcagagaataattcattccagagcacgtactctgggaatggtagagctgaggtctgaacacagcctgcctggctataaaggctgtcctaaacattgtacatgcttcacacagtacccatcagctgaacaaacagtccctatggagggtccaccaggcccacccacacagttgggattcttgtttttgattcaagagtgatatagagagctagagagtgctgggctcctctttcccttccagactggcagactcagaaggatgaggaaccaaagacattagtttttctatggcaagtctgaggctgacagctggggccaatatcaaggaattgtggcctaaatatcttgtactcctcttctggtttctagatgatgagggtaatattccaagaatgtcatgatagcaatattaaaattattattgtcaatattagaaagataaggcaatagcctcaagaagagaatacccaagctaagtttctctaataatccaaagtctgttttgagatgcaagcaagtctattttacagtttaaaaagagagagagaaaggaagaaagaaaatgctagccttaacacaggctctaaaggggctgccagcctctgtgtgggcgatgtctagcaccataagagaggaagtttggctaaggcaggactctcaataagagaggatgcctaccttctctgctctggggacaaggatctagaatataattatgtgtgtgtgtttctgtgtagggtgcattgaaccagatatttattcattgcagtctctggcaactctatgttaataaagaagattaagcggaggacatgggggagcctccagaaaacttctttgtgaggaagctaacatgcattctgtgtctcttcttctggcttagctccttccagttggctgagatttaaaggatggttggagatccagcagccatcttggaccatgaggtgaatcatgatgaagcaaaatgacagaaagagccaagatccttgtcctgtggaaagcaatacaggtcctggactgctcttgttacactagaaaaaatgtacttttagtttatttatttatttttgagacagagtcttgtggagtcttgctctgtctggcccaggctggagtgcagcggtgcaatctcagctcactgcaacccctgccttccaggttcaagtgattgtcctgcctcagcttcccaagtagctgagattacaggcacgtgccagcatgtctggctaatgtttgtatttttagtagagacaggtttttgccatgttggccaggctggtctcaaactcctgacctcaagtgatccaactgcctcggcctcccaaagtgctgggattacaggcatgagccatcacgctggcccttttagctaatttaaacaactgctaattttgattttacaccatttgcagtgaagcctaattgtagctgatccatcctataccaagtgactcccaacggacactacacagcataagttggaaagaatcaaagcctacttaacaattaaattgttttgtgtgtagcacaaaacagaccagagaaatcctgtttgagcagtggtgagggtgttcacactgctcgaacattgttcccaagttgtgatagaggaagaggggaacttcctctaactttttctgtgttgctttcgcttctcaccaacgctttttgccaggtgcctttgctgttttgatcagagaatgctaattgctgattgttccatctcgttaggtaaagtgggaatttggtgaggcccattccttgcattagggcaggatgctaaaacggtcttggtgatgctgaaaagccaggctctgtttctttttctccagagagagaggctatgtggatgaagatgatgaggatggtgggggcaagatggatgctctgggacagaagtacacttgcttttggaaaacaaagaggcctctcctcttgacaagccagttctgctaagtgaaccctggatagaaactaagggaacatttaagagtgaatggaattttaaaaattgcacaatgcagtgagatggcagttacagtgaagtctttgcaattattcttgctgatagtgaaggatcttatcatgatccctgtgggcctggatgaagccacttccttcacatggatgtgatggtatcccgtgacttggctcccgaacaactcctgcttagaagctgatgctgcacttggaaaaatatttctaatgtttgaataatgacaatacactgtgagtcttgaaatggtttcccagcttgagcaaggacaaggactttattgaagaattgtgcctggagggaaatgattggcaattatctgcttcattatgtcttttggggcagtacaaacaaacagggcatcaaagtaatacatgtctttaggttttggatatatggggaacattacatacattagtagcaatggtagcactgaccagatgctggatacgttctaagcactttactgatgttagcacagctgatccaatagttccacaaggcaaattccatcactatcctcattctgattttcagatgaggaaactaaggcatggttattaatttgtccacagttacaaggttaggttacgtatagttagtataagatagagatgggatttgaaccagggagtgggttccaaagtccaagctcttaaccagtacatgagaccatctgttgacattgattgaacacacacacacactgatatggtttggctgtgtccccacccaaatctcatcttgaattatagctcccataattcccgcgtgttgtggaaaggacttggtgggagataattgagtcatgggggcggcttcccccatatcattctcatggtagtgaataagtcttacaaaatctgatgcttttataaggggaaacccattctgcttgtttctcattgtctttcttgcttattgccaatgtaagacgtgcctttcaccttctgccatgattgtgaagcctccccagccacgtggaactgtaggtccattaaacctcttttctttataaattacccagtcttgggtatgtttttatcaatcagcagcctgaaaacgaactaatgcacacacacacacacacagacacacacacacacacacacacacacgatgtcgaggaaacctaaaagtgtcatgttatccatcctcagatatcggacagctcattctttttaatagttattgacagcaacttgtgcatacattttgaatagtcaaggttaataagagttatcctcattctctaaaattagcgttgacaccatctgtgtggctttggacaagtaatttaacctttccaagccttggttttcttattcgtaaaattgcaataataattcttttcctacagggttgttaggatgttaagcaagagagagtatataaaatgcctgtcatacgctttcactgtgacaggcataagtcatgtcctggagtcaggagtggaggcaatattgcctgaagaggagaaagttaagaatggggagagtgtttttctcttgatgcagaattcagatgcctacctttatggaggtaaatgtaagtggatgccagaaacagaaactgtctacttcagtggttggcccatgcgaggaactcaaaaaatgatggttttaggcctgttgtggcattcaaactcatggaatgccactctgaaacatttttctttgaattgtgcaaactagaatggcatccaaaaactttaacaggttgatagatgtcatcattagaattgtaagaaagtacattacatccttaccttgctttttattcaacatttcattccactcccacattgtattcccccagtgatcttaaaagccttccgaatccttgcttctgatatgaagaccagagatgaagtggtagataatgtgcctaccatatcttatcaggcagtcttccagcaaactctcactaaagtcccagctttacagaaataatccaatgtagaatttggaggaaaattattattgcaaggagaaataaaatcaggaagccaaactttccccctttattataactagtcaagttaattactcgttgttattcatttatttattcactcaccaaatatctatttaagtacctgcaacatatcttgttctatgtaggtactggaactacaagggatatgggagctcctttttttttaaaaaaaattatttatctaatttttcttacccccttccatcacagaagaaaacctgatgtctgagctgaatcctaatcatgaagatgtttttccaccattcctgtctgtgtttttctaccattcctgtctgtgtttttctaccaaagtgtgctcttgaagttctgcatttcccagggtaagtggtagggtcttccaaggagttgggaaggaatgggtaagcaggtggccatggctcttttgtcttttctatattttggggtttctcataaggatattttcaaagaaagggacacacacacacagaggtgttagaatcaggcaatccggtctaaatttcagctctgccagtgacactctaagtgtgtgactttgcataagttactcatctctgtaggactattttcttatgggttaaaatgaagatgataacaagtgcctcatggaaatactttacagaactttatagaacgcggtgaggatccaatgagataacctatgtgataagaatttgtcacagtgcctggcacatagtaggaacttattaaaagtttattttcatcctcatttccctttcgtcctcttcttcccattcttactgccttcccctttccctgtcttctgacgtcaccttaggggtagctggtgcaggtctagatgttcacagagattgatctaagttgtggcaattgttgtcccttctacatggacccgccccctttccttgagtctcttgtggaagtgactgcctgtgagagacgacgccagctggtagagggattgtgacctctgagagaggcctccacttttctgagcaggaaaaactgggatgaccttggctgccccaccttgggaactgcactcctgggaacatcatgatactggcaggaacaatgaggccgagggtggggggcagaagaaatgcttctctttttaattacctgcagagcaaactcattgtgaatactctcctaaatgcaaacatggagaactggtacctactgtagtcagaaattttgagtgccaagttacagggacacaactcaaattggtttaagcatagagagggaataattggttaaggagccaaaaatccacatggcttcacaatggctgttttcagtcactaaacccatgtcttcagaatctgtctctcaatctcagctcttccttcttaggcaggtcctcctcttgttgcagcaagatagtcactaacaatgccaggagtttttctaccacctttgcaaccacagctaaaagcatcccttttctgctggttccagcaagaattcccagactgagtcatctgtccatcctgaccaaattcctgtagggagtgggacacacttgttctgattggccaggcctccctgctggaaggagagattaaccaaatatagggtaaatttaggtagtgttaccagaagaagggatattaaggacacacaaaacaacaagtgtttcctccgggctcagtactttcatgtattttcttataaaatatctaaatcttacaaagaaaggacatgtttctaggtatccttgtgcctacaacataaacataagaatatttcaggcccatgaaaaatctaattattagcctatttgccctatcaaactacacagtgataaaataatgaaattaatatcagtttttgcttcacctatgcaattattaaattatctggatagatctttgtttctaactcataaataggttaacttggcaagcatcaaaaaacataggaagccatgggtgatggttagtttttgtttattcctaatttttttgttgcttttaatttcatcacaagagatggttagttttatgtgtcaatttagatagactatagcacaaagttgttcaaccaaacaggaatctaggtcttcctgtgaaggcgttatgtagtggttagcgtccacaatcagtgaacttaagtaagagattgttcttgagtgtggatgggcctcatccacaagttgaatagcttagtggaaaaaaacatggtttctctgagggagaagaaattccacctttggaccacagagtcagctcctgcccaagagtttccagcctgccaagctgccctgcagatccacgaactgcacaaacccaccctccttcctccaaatacacagtaacgtggcacatactgaggtttcagttgacatctatgacggtggtcccataagattagaatactgtatttttttaccataccttttctatgtttagacatgtttggatacacaaataccattgtgttatagttgtctactgtatacagtagagtaacatgttgagagaaacagggtataccctatagcctagatgtgtagtaggctataccatctaggtttgtgtaagtacactcagtgatgtttgcatagtgacaaaactgcctaatgatgcatttcttagaatgtatccctattgttaagtgacacatgactgtatacacacacacacacacacacacgtatgtgtatacatatatgtatgtatttgtatatatataggtataaacatatctcctactggttccgtttctctgttagaaccatgactgatagaccatagaatgttaaaatgtgttctgtagttgaaaaatgacattggtcatgctgccagtgagattcaagtcaaagttgaggcacaaacccattctcctttagtatgcaagttgtttaatatgcatgcacctatagtgtagttgctgaaaaaacacattttccaacaatggtaccactttttatgggcccctgaaaaacagtgtcactgcaatacttgaaacaaatacttgataatacttgaaatatagcacctttctactgaggaagttaaacaactttgcaggaattatctcatgatctacatgtgatgctaatgaggtaggtggcaaatatgatcagccccactttatagacggaaattgggacacagtggatgtgacttggcccaaagctgtgttgaaactcactaacaaactagggatagaaaaaggagttttgcaggcttcaagcctgcaagctttttcaaggtgtattctctctatccctcctatgagaatcacttggaattattaaaatgcagattcctgaactctgtcctagatgcactgaatcagaattctggcatggggaccaaagagtctgccatgttggtgagattcttgggtgagtcttgatatggtaaagtctgagaaccaccttgttaggtgtagcttttcaccttgtctatatctcaactgtttgactttgtaaatacataaattgaaaaatttaggaagtaaataactggcttttctgggtcaattaggaaagaaaaaaaaacgaaaagaaaaaatactggtttacttttttaaaaaagcgtacttttctcaaactccgtgctaggcaaaccactactctagaactcaggattaagaaactcactcaaaaccgctcaactacatggaaactgaacaacctgctcctgaatgactactgggtacataacgaaatgaaggcagaaataaagatgttctttgaaaccaatgagaacaaagacgcaacataccagaatctctgggacacatttaaagcagtgtgtagagggaaatttatagcactaaatgcccacaagagaaagcaggaaagatctaaaattgatgccctaacatcacaattaaaagaactagagaagcaagagcaaacacattcaaaagctagcagaaggcaagaaataagtaagatcagagcagaagtgaaggagatagagacacaaaaacccttcaaaaaatcaatgaatccaggagctggttttttgaaaagatcaacaaaattgatagactgctagcaagactaaaaagagagaagaatcaaatagacgcaataaaaaatgataaagaggatatcaccatcaatcccacaaaaatacaaactaccatcagagaatactataaacacctctatgcaaataaactagaaaatctagaagaaatgttaaatttctagacacatacacccaccgaagactaaaccaggaagaagttgaatccttgaatagaccaataacaggctctgaaattgaggcaataattaatagcctaccaaccaaaaaaagcccaggaccagacagattcacagccagattctaccagaggtacaaggagaagctggtaccattccttctaaaactattccaatcaacagaaaaagatggaatcctccctaactcattttatgaggccagcatcatcctgataccaaaggctggcagagacacaacaaaaagagggaattttagaccaatatccctgatgaacattgatgcaaaaatcctcagtaagatactggcaaactgaatccagcagtgtatcagaaagcttatccaccatgatcaagtgggcttcatccctgggatgcaaggctggttcaacatatgcaaatcaataaacataatccagcatataaacagaaccaaagacaaaaaccacatgattatctcaatagatgcagaaaaggcctttgacaaaattcaacagcccttcatcctaaaaactctcaataaattcggtattgatggaacatatctcaaaataataagagctatttatgacaaacccacagccaatatcatactgaatgggcaaaaactggaagcattccctttgaaaacgggcacaagacagggatgccctctctcaccactcctattcagcatagtgttggaagttctggccagggcaatcaggcaggagaaagaaataaagggtattcaattaggaaaagaggaagtcaaattgtccctgtttgcagatgacatgattgtatatttagaaaactccatcgtctcagcccaaaatctccttaagctgagaagcaagttcagcaaagtctcagtatagaaaatcaatgtgcaaaaatcacaaacagagagccaaatcatgagtgacctcccgttcacaattgcttcaaagagaataaaagacctaggaatccaacttacaagggatatgaaggatctcttcaaggagaactacaaaccactgctcaaggaaataaaagaggacacaaacaaatggaagaacattccatactcatggataggaagaatcaatatcatgaaaatggccatactgcccaaggtaatttatagattcaatgccatccccatcaagctaccaatgactttcttcacagaattggataaaactactttaaagttcatatggaaccaaaaaagagcccacattgctaagacaatcctaagccaaaagaacaaagctggaggcatcacgccacctgacttcaaactatactacaaggctacagtaaccaaaacagcatggtactggtaccaaaacagagatatagaccaatggaacagaacagagccctcagaaataataccacacatctacaaccatctgatctttgacaacaaacctgacaaaaacaagaaatggggaaaggactccctatttgatggtgctatttaaataggctgtttaaatagcctatttaatggctagccacatgtagaaagttgaaactggatcccttccttacaccttatacaaaaattaattcaagatggattaaagacttaaatgttaaacctaaaaccataaaaaccctagaagaaaacctaggcaataccattcaggacataggcatgggcaaggacttcatgtctaaaacaccaaaagcaatagcaacaaaagccaaaattgacaaatgggatctaattaaactaaagagcttctgcacagcaagagaaactaccatcagagtgaataggcaacctacaggatgggagaaaatttttgcaatctactcatctgacaaaaggctaatatccagaatctacaaagaactccaacaaatttacaagaaaaaaacaaccccatcaaaaagtgggcgaaggatatgagaaggcgcttctcaaaagaagacatttatgcagccaacagacacatgaaaaaatgctcatcatcactggccatcagagaaatgcaaatgaaaaccacaatgagataccatctcacaccagttagaatggtgatcattaaaaagtcaggaaacaacaggtgctggataggatgtggagaagtaggaatgcttttacactgttggtgggactgtaaactagttcaaccattgtggaagacagtgtggtgattcctcaaggatctaaaactagaaataccatttgacccagccatcccattactgggtatatgcccaaaggactataaatcatgctgctataaagacacatgcacacgtatgtttattgcagcactattcacaatagcaaagacttggaaccaacccaaatgtccatcaatgatagactgattaagaaaatgtggcacatatacaccgtggaatactatgcagccataaaaaaggatgagctcatgtcctttgtagggacgtggatgaagctggaaaccatcattctgagcaaactatcgcaaggacagaaaaccaaacactgcatgttctcagtcataggtggaaattgaacaatgagaacacttggacacaggaaggggaacatcacacaccggggcctgtggtgggatggggggagcggggagggatagcattaggagatatacctaatgtaaatgacgagttaacgggtgcagcacaccagcatggcacatgtatacatatgtaacaaacctgcacattgtgcacatgtaccctagaacttaaagtataataaaaaaagaaaatgagaaactgaaaaaaaagtacttttaatgcttcctactatttccaaagaggtttttaaagaaaatgaggcgatctataagtcactgatgggtacagtctatccaattcctggtctccatttattggtatttgtgcactgttttgctttcttaacccttcaaccttgcctgagagccctctcctgctgcctcctagggtctctctgggccctttagccaaacaaatgcagacaacattgacaacattggcaagccaagaacatttttgctacagtagccctgacaggaattgtacaggagctcttaagctgtctctaagaccaggggatatctgacagggcgaattcaccttggcaaaaacatttgatccactggccaaacaaactcagttggtgatgatgcaaacattggctgaagcttatagcttttatgtccttacctttttgtcgttgttttattttttaaaagtttgataaaaggaggttcctgtacaacagaagttcttaaagacaacaaaagcttacctttctataatagaaaaagaggttaggctatatttgaacatcttacatcctccatagaatctagaatattactgcatacactctctgtgtttataggagacctttgtaaaaacagagaccacaagatctattagggaggtgccattgatgtggccagtgactgggtcggtcctacgagttagcagccatcaccgcccaccccctgcactgaaacttgtcctcctcagtctgcagttgacttgcacataggatcacaaggtaaataagggaaagagggtgaatagagcacactttggcttgacactttaggcaaagccctacttagcagaaaatgactcaaacccttacgacctaaggtacaaaattctaggttcagtccctggaatcccgttttataaccctttccccaaaataccaaaatagatgatgcaaataatttaaaatgaaactcaaataatacactttcacaaacctttaattatgtaaagctaaacagtgttaagagttctgttgtgatcatggaaaactgggaatacaaatgcccatttgtgtggaaatgtttatggaatttttatagaatgaaactctatgtaaatggtaattaaatgaagtatatctacctgtgtggacatagataataatatctagtgtgtatttttttttttatactttaagttgtgggatacatgtgcagaacgtgcaggtttcttgcatagatatacacgtgccatggtggtttgctgcacccatcaacccgtcatctacgttaggtatttcttctaatgctatccctccccagcccccaaccaacacaaattgtgaaaggctacacagacgctccttggcttaccatcatgttatgtcccaataaacccatcataatttgaaaatattgtaagccaaaagtgcatctggatggaagtcaagcagataaagagcatactgagtgcatatcactttcacaccgttgaagtaaaaaattcagaagttgaaccattgtaaatcagaactgtttgtagtctgatgctgttttgcaaagtaataacaaccagacatgtaagcatatggaagcacagaaaacctagagggctatgcacctaatggttaagagatttgggaccacaggagatattcgctttctacattatgattttctcttatgtttgaatttcctgtaacaaacacaattcttttcttaatcagagcaaattttaggtgttaaaaaatgaaatgctggaaatttccttctgggggatttttccacatgggctagactagttgaggtgtcctataatgcagtctaatatagaggttgaacaatgtgtggtgctagtctgggttttcagtgaagcaggtgctgggacagagtcatgagtgcagaaggcttatgggctgtcacacctgtgaagggcggaagcagtgctccatggaggaagccatcgcacctgctgcagacctgactctcccacctcccagggaagctctggagcccagaggcccattagacccatgctgggcccttgtactgagccctgtatcactttcttacacagtcgttttctgagggtcacccgagaagagcatggcctggactgaacactgaagcaaacactgacagaggtgacacttggaggctgtcagctcaccaggcccctccaagcggcagggcaagtcttttcctgaatgggcatctcagctgtgcttttccacttctgccgcagtgcctttttcacttctctgtgtacaagcttaggctttatttatggaaaagatgatttggggtgaaatcctgcacttttccctatgtgatccacaacactttctaaccatgtcaattctacttcagctgtattatgaaaacagtgtttaagaagtggcttattgtatgtgaaagttataaaggataaagttatttatgttagtcagaatatataaatatgtgtcagaacacttttgtgaactccaaataatttctgagaagatactggaaaaatatcaatgacaaataattaaatatacaaatgactttatatttattcacatttcctcttcacaacagccctttgaagaagttgctgttattcccattttacagatgaggaaactaaagcacaaagtggttaagtgacttctccaagtcagttagtaacaggtagagtcaggatttgaacccagggagtgtggcttcagagttcatatttgtaaataacacaatcaactgcctcttctgtaaactgagcatgttcaccacaagttggaggtgacagcatgtgcagaagaaaactaagcatctgtacattaggtaagaatggccatgaagacggggcccgaaggataccaaggcaatgagctggcaggcctcagctgcagatggggatggagcaggccctacataggctggacctggagaccaatgctctaatctccatatggtggactcctcctattggacagagagaaactttaattagctgcctccaaatggagtttgcctccaaatggccattcttgggttttctagactaatgcgaaagttttcaccgtgttccaaatttttcctgtgggtacatcttcctatctgagatgcctgtgagaacatacctaaccattccccttggaacataaaaggatgactctcactgtgaaataaggtgagaaacatttctttctgcctgctcattcatggggcctgagaatctcttggaattgccataaaaatcttcagagttccatattgtttccacggccctcctcatctccctttgctattgttctctgaaatgaaggtatggctgataaactgtcttcttcaaagatttgcctttttcctcaatccctaagtagtgttgaagcaaaaattctatttcaaagaaaattactgagagttctaattacagttattgaaatccaaattctacacagcactctcttcaattatgaacagtgttcataagtagggtcacttatctagaaaattattaaaaattcaatgtacatgaaagcctcaaaagtccttgaaaggcaaatgttaggaaagggctgtttccatgacaacatctcctcatcctctttgatcccttgctgcccattttctagtaaacacctactttgaattgcaactttcttatttaataatttcaacaaacgttgggaaaatgtgttgctcattctccatcagtgattagaattttcctgaattttgatatcatgctaaccagtcctttcccaaagccatcctttactggagtagaaaatgttctccttactctaccttttctaaaagatttaaagaatgagagtatctttgctgcaatactttcttggctcagagacaagtggatttgcagtgtctgataatgttccacacaataacatattttcccttttcacaattaagtttatcatctaactgcctagcctatcattcaaaaaataaattgtcatggatttcattgactttacatcaatctgttggttcattggtcaaatcatcagggcattgcagacgcatgtttgggaactcacttttaataggaaaggagaggcaaggaagcaggtatgtcataatcacaagtctgagattgattgcattaaaaaataatttcagcaaaagtctgtatcatcacctttgtgcttgaagagcagcaagtgatacaaccccaagccactaacatatatggcaagaaggagaagcagaagaaaaccagggaaaagaaaaagcagatactcattgccctaagaaaaataattttgtaatcacaaaattaaattactctgctgtgaatcccagtgaagaaatggccttgttggaatggtttgatgtgctctcacaggcatctcaaatgggaaaacatacccacaggaaaaatttggaaggcaaacagtaaaaactttcacattaatctggaaaacaaaagagtggccatttataccttatgcctaactctaaaaaactcttaagtgctttgcagtttatttttggaaaagagagtaggagaaagaagaaagtggggcagaataacagggagagagggaaagaaacagattttttttttccttttggtccaaaagatgttaaaaagaatgttactctaagggaagagtggtattttctacctcattggtgaatcttgggctagtcctacagaggcggaaggcagctcacagcagagtttgctggcctcatcgcttgccctctgacaaatatccttttctctgacagagcagctgttaattcattttgagtaatgctgactgagctcacagacctaaagtacagacaactttgctattaacaggagggtagaagtaaagggaatataggacaaacattcatacaaaaagctgaaatataaaaatttaatcaaaatcaaaatctgaaatacaaaaatttaccgtaaaaactgatctgggaatgatagttgatataggctttaaaaatatattgggttgtttaggttataaaaaaatacatattaattgtagaagacattgaaaaaaagaagagtagaagaaggggaaaagacttttctactacctatactccattattaagagttggggggtattttattttttctcttggcaatggttcttatgtctgttcatttattttgtataagtatggtcatcatatatatatatctgtattttacattttaatttttatgccaatggtaaatatttgttgactgaataatacagcatctaaatttctgtgtagtttagtgttttataaacataattttaatggctgcataacagtgtatcatgtggagatggtatagctggcttaaccatccacaaattggaatattcaagttgtggctaattttttactataattaataattccaggtggatcctatctattagaccattgatggtaaaaccaggttaatggggccaccttgtaaaaatttatcttaatgtaggcaagcttactacagttcctgggcactatatatcacacaggtcctgtagtgggcttgagataatacacaaatcaaaaagactgaataagacatgatcatttttattttccagtagggtaaataatatgtcagcaaaaaattataatgttgggaatcagagccagaaatgaggcatgaaaactatgcatgaagtaactccttggaaagtcacaaaaggcatctctaaggacgtaatagatgagacaggtcttggaggataagtaggcatttgctcagcaaagaagggagctcttagatacagcgagaagagctgtggaagataaaaggatgaataggaattggggatttaagacctagtgaggaataaagatatttgaaagaatataaggcaacataagatcaatgtatatggagggcaacaaacaaaaaatgatagtaggtaaaggaagggagacataacttccattaaaatgtcacagggttagctgaacttctaaggatccaggtttgttaagtggtagcagatggaggagaggagatggggagaaggacacaccaggtgagcaggagaggcaggagcaaagctggggagggacaccttgcaagctgtgtttgggaaaccagcagtgtactttggctggattttatgtcagggtgtgcacagaggtagggtggaaatagtgctataaagatgttagccccagagactcttagagagtctttaggtgagattaagtttgggaatgggaatatgaacccaagaaaagatttataaaataggtgagtggcagataagaacagaatctgtccatagatagatgggaaaaaagtgattgacaaaccagtaagaaagttcttttggtggtctagacttgaagtcataaatacctgagctgaagtaatgacagtagcctggaaataaagaggcaaattcacgagctatttcaaagaaataactaatggaattggcaactcttcaggtgtggtgaaagaagagaaaaaaatgtccaagatgacttcaacgttctgaccttgagtggcttgagtgaatggagttacaactgtgcagaaagtgagttttatggaaacaacaaatgcagttttggttttgttgaatttgaggtgctgatgagagacccatgttccacatagttcattggcaaattgaactgtggagcttagaggatcttattagtaccttatctaaaaggtcccattatatgtgatttatgggacatcagttaggattaataaggagctcagcaattaaaaagtttcagatgggggtctttatttattgagctatttaaaaaatatgtagatgtaagctagaaattagaggatttttgcccccaaggagatctgtttaaaattcttggaagtttatctgaacctttcagtagtgattttactttgccaatgtgtaaaggttgctgaatgctaacaaatcaagccttaaaggtaattgtttgaaaaatcactttgggcacacatgacatcatctcagactcttatgataactcagatgtatgagggaatcaaaaccagatgagtttagtggatttgcagattactctcaaagttctcagccctcagagttttccagttgaacaaatactctctctggaagattatttaaaatattcaatgatttacctcttggcctacttttgttctgaacttaagtggagggtgaccagagggcaactccacagcatcagatatgagaaacatcaaacattagtgtttatatccatgcagcaagaagccatggtgtctttcccactttttattcatcagtcacttaaaatattttaaaatttcctccagaactcactgttaaaattgagaaactggcagtcaatccaaaagctgaaactttggatgatgctttggaaataccattgtcattttagatatttggatttcctccctttttcccttcctctcttcctccttctccttctccccctccttctccccctccctcctcctcctcctcttcttttctcctccttcttcgccttctccttcttcttctcctcctcttttcctctttctttctctttctctctttctttctttctttctgtctttctctctttctttcttctttttctctttcctcctctcctctcctttcctttcctttcctttcctctcctctcctttcctttttttcttttttaacagggtcttgctctgtcacccaggtgggagtgcagtggtgcaatcatggctcactacaccctcaacctctagggcatcagtgcaatcctcccacctcagcctcctgagtagctgggactacaggtgtgtgccaatgttttccttcaagattgtgaacattttgttgtttccttcctactccttgtcttgtgaaccaccttgaatcagtgtggcgactacacaatatatatataagatattcttaagaggacattgaattacctcttctaagaaaataattatattaattcttttaattccgtaaattgaatatataggttctaaaaaaatatgttttttgagttttggattgaagtttctactggatatgttttattataaacggaggagatttatatatttacttattaatggtgataacctattaatcatcaaatcactcttaaatactgcatattgttctttacataggatctgagatacactggggactatgttgtacagaatgcatgatgagaaagaagtattagtagatatcagtaacagtctgtcttttaaacaatgttgatataaaaacttattttgctcagtttcagtccaattatttgcccccctaatttgccacagcctagttattttaaaattaattaatctgaactttttttttcttccatgtaccatattgattaggattcagtagagagttttggatttatgcaccagtaaggtaaatgaataataataatatttcaaaatagagttgtcagcagctaattttgctatgtaaggacattgatcattgatacggaactcttgtagtcattgctagtgttcaccaatgttaggttctcctctccttttggggtacacaggaagactatatttgccagtctttttttctatttagatagggccatgcaattgagttatggccaatggaatataaacagatatgacttggctcaatttcagaccaaggcaattagaaccagagttttttcttcactctttctcccttccctcgtgcctctggttgaagtgaataactccaaggtggtggatcttcacaatagatgttgcctggattcctgagtcactacttggaggttatctccctaggagaactacctacctgttccacaatggactgtaatgtcagagaatcgctactactaattatgtagtaaactactatttaataaaaggaagggtgatttaaaatcaaaataagtaagaagcatgcaatctcccaatttcaagaaattgaatacattttttttactgacactgctgactgccaaaaacattgtcactgcctggcatttaggcgaccctgacatggtaattgagggcagtgactggagcagacagacctggggttgagtcctggctctgtcacttcccacttgtatggctttagcgtgttacttaacatctctgagcctcaatgtctttatttgtcaaatggggattataataatatctgtaatttaagttggtgtcagaattaaatgagacaacaaatggcttcttgtaagtgctggacgattgttggttatataatctatcttgggttcagagaggatcttcatctcattttttctcatgtttcctcagacttaatactcacaatttttaatattttataaacaggaaattaaaatataaacatttcaaagtccactgaaataattttcctgacattttggtaagaaatttctgaaaataggaaacttgctgttaggaagagttaaaaaagatgatgaggctgatatattgggaatagatgtttgggttgtgaagctttgggttaattaaagaaataaaaacagcagtgatgttatagaatcatgttccctagcctggaacatgtccatgagcaaagtggggtattgatagaggcaaacagaaggttctggtatgttctagtgtattctacacaaagtcatcatggatggatatagatatagcattaaaatcatataactatatttgtaagaggataaatttaaattatggatcaataggtagatattttttctttttggtagatgttatatcagactgggcaagtataattgccttacatatgtctctggaaccattttgattagcattggaagtaaaaaaaaaaaaaaagattactttgcatgatactgtgtccgtttatttaatctttaacatgttcccaataggagacttctttattaacaacaatactggaccctggaccaatcagaccaagaattcagccacacaacgcactacatctagttgctcagagatttttttttaccttaccatctgactctgtagtcatcttattatatgtaatggagtcttagtataagaaaagggatgaggtcatagtgataaacatcattttctgaaaatttgctgcaggtaaacttgctttaaagaaattcctttccaggaagcacatgtcaagttatatacattttgaaaaaacttagaaatttataactttttgattttgatttgactacattatcaaagtgcattttttatatcttggaaattttttgtcattaaagtatcatgttacatgtggtgaaatagtatttatatataaaaaatacatatttctatttcaccacatgtaacatgatactttaatgacaataaactaaaattgatacataaaattttaaaaatacaaacatataaaatgcaaatatatatataattttggagatgcttgctattaactttcgaacataaccacccctactattagtcatggttattagcaatagagaaaacataattcagtctccctagtttaggcaaaagtgatatttgatgaatctatctagtttatagtatcattggaagacctgataaacaggttataacttgaacctacaagcataactccctcagttccacacatacctagatttccaagctaactgccaccttcaccacagtcaggaaatagcatatttatctctggaactctagctgcaagagagtctagtaaatatagttcatgccccatcatctgcagtgctgaaaggcatgctagagggttttgaatggagattgagccaatgacaatatcagtccccctggtaatgcatgaaatgtgacagaccctttaaagaggtaattagaggtcacatcttttgtgtcttatataaggaaattgtcataaagtaattgccattaacattagtttcttgataatgaaaaaacatttttatctaaggggaaaactgaacagctgcagagagctgtaacttttataggagattaatctataagagaagacagcaaactacagcctgtgtgtcaaatcctacttgccacgtgtaagtaaaatttcttggaatatagacatactcattcgtatatgtacttgtctatgcctgatttcatgctgcaatggcagagttacatagaaccacagaaatcatttgactcacaaagccccaagtatttgctatttggccctttacagagaaactttgcagacctctgatctataaccccattgtatagtcttgtaaaaactcattgaagttaatactgagtagtgatcttatgaaataatattggtgaatttttatattttaatatttttttattttatatgggtgaggtcagtgtgccaagaatacacacacacacacacacacacacacacacacacaatcaaaataaaacaaaaagcatgccatacttgcaactatggaaaatcaagttgagaaatttggagttctaattatgtttttatacaagaatcccctagatttgatgtttatgcataactgggactatctttttaacagatttttgtatgattttccaagccaaaattctctcatttgttcactgggtcacatgacaagttaactgattctgacagcctctttacaataggatgctagaagtaacaaagtcaactaggtgactgtcatcaaagtaccaaaaagaggacaaaagattgtgtccggttgacttaaaatgatgagcttgatcatctaatttttcgtggctctcttgagcaatatagtgttgttgttttttcaaaacaatttcaaccagagtatcaatctccatttgcttctgctaaattattaaaaactacatcccttcccttcatttttggagtaagatatggctatgactgatcacttatgtatgtgtagacttggcatatccatcgtgtaattttttacaaattcctccaatttcatgaagtggcatcttactcctattgagagcattcttacctgcagttaaagagttggtgagcaagaaaggccatgtaacacacagattaaaaaataagcaaaattcctgggcatcctactgtttgtaagacccttgtttctcacccataagcaaggatactttcttcctttttagaaggacattagataaattgagggcatttggggacactattggatggaataaaccatgttcccatcttgggttggaaaagagactgtttccttcatcctgtttccttcatcattcttatgatgactaagtctttttataacccatctgtgccattgaggggccgaatttggcccagttggggatttggccaaggaaaaggtatgttactgggtctgttcttcccataattcaattgaatttcttgtttgcaaattctggccattttctgtactgctgggaaagatgattagaagagtatgtgttctggaagctgtggacattctatgctctcactcagctctagcttcatattggagtgagggggagagttagtgggagaattttcctcctttttggctctatttggcgaattatttcacattcaataaatggaaggggagaatcgaggcctgagtaattgacagtgaataatggttacatgcagcgaataattatcaggacagtattagagtaagtaacaagaaaaacaactggcaaaacatatgggatcacaccacagtagctgtgagagcaattttcagccttctataaatttcaagatcgttttgaatgtcaacagttacggttttctggttggccctgaaaataaagcttccacatagaaccttctgtatcccatcctccagttactttaatcccttgttgcttacctaatcttttcttcagttgtttagcagctaacttccagatatcatttggctgtgccccaccaaatctcaccttgaattgtagctcccataattcccatgtgttgtaggagggacctggtgggagataattgaattatggggacagtttcccctatactgttctcatggtagtgaataagtctcacaaggtctgatggttttgtaaggggaaacccctttcacttggttctcattctcttatctgccgccatgtaagacgtgcctttcaccatctgccatgattgtgaggcctccccagccacgtggaactatgagtccattaaatctcttttccttataaattacccagtctcgggtatgtctttatcagcagcgtgaaaacagactaatacacttccactttcaggaaaagtgtgcctagaaatgttagcgtggcagagatttgctgtatgctcaccaaactcatttcctctttctggccactcaactagactgcctttcccagtccacctgcttctaggtggagttgtgtgaagaatgccagaggaaatgacgtagccactctagggctgacccagaaagcatcctgtcctattcaatatattccctctcttccccactctttgtaggtgggtgatacaagagcaaatttgtattgaagatggaatagatattacatgaaaggagccctgatccctgagtcactatgggaggagacgcacccaatcagaaatatgtgctttgaactttgcatagtgagaaataaactttcattgtgttaggccacttggaatttggggttcttagaacagttagtttatcccaactaatacattgagcagctcactcatctgtgtttgtgaacattcattattcatcagttcatcattaatgcaggtgactcacagttcacttaacataaggaaaagtcctaaaactatgggattgttagaatcacaaggcccttttgttctggcgatgtttgaattagcttcttcaggggccattgaactagtcggtaattgtgaaagccactttaggagattgtttaagtgcaatccattttgaagggaaggtgatggggtagcttgggttttcacttcaggtgcaataatgcacagtgtgttgtgttctgttgcaaggtatagcataaaggattgttaataatggttaatgtgctgaagtttctgagtttttaaatctttttattttaaaataattacagactcagaagaaattccaaaaagtatgtgagggtgttccatggacctcttacccttgctttctccagtaatgatatcttgtataaaaatagaacactataaaaccaggaaattgaccttggtacaatctatagaactgacttagatttcaccacttacacatgcactgtttgtgtgtgtgtgtgattgcatgcaattgtatcacatgtgtagctcatgtaactaccactcacaatcaagatgcagaactgtgccatcatcacaagaatgcctcatgctaacccttcacagccatgcctgcatagccacgcccttcacagccatgcctgcactccagcattctctcctcccatttcctaactctcatttgttctccatctctataatcctgtgattttgaaaatattatataaacagaatcgtattgaccttttgaaattgacttttgccactcagcataattcccttgaggtctgtatttgttagggttcttcagagaaacagaaccaataggttatataggaaggagatttatcatgaagggccggctcacatgattatggaagctgaaaagtcctacaatctgtgatctacaaatgggaggccagaaaactggtggtgtagttccagtctaaacccatggtccaagaaccacagaagccaatggtgtaggccccagtctgagtctctctgcaggcctgagaaccagggaatggatggtgtaagccccagtcctagtctgaaggcctaagaactgggactgccaatgactgagggcgaggagaggatggatgtcccagctcaagcagacagagagcaaattcacccttcctccacctttttattctattcaggctctcaatggatttgatgatgcccactaacattggtgagaatggctattctttactcagtctacaattcaaatgctaatctgttgtggatgtgtcctcacatacccagaaataatgttttcccagctatatgggcattgcttagcctagtcaagttgatacataaaattaaccatcatgagtccacccttgtcaacttggcacccatatgcatctccttaaaccatgcttaattaccaagtaaagaaaataacaaggtcataattctacctaacaggattcaactgccctgcatgcaactaaaaatgcactaatctctttcccagaagaggaggtaaaaatccttgagtaatgtttactcttctcttgacatctcatcatttaaatactataatgtaaagttaacagtacttaagtactgatataaagtcaatacattttatgtaacatgataagggaataagagaggaaagaaaacaaaagtatttgcttaatgcatctatctacacaaacacacacaaacatattcataacaaaataaggaggagatactcatgacaattaccatcctcatttctgtgactggccgcgtggccacagctgatatttataatcacatttttctactacctattcagtattctctttgcctttagcaagcacctcagtggtcatggttctttacttgatggggtgacccaaacctttgttcctgaagggtctgggccattagcattcctgtatggattaggttgttctagtttctattgaccttaatcatagggcatggtaatactaagagatgccctaagggattgcttttattccagacatattcttcttttttttttttaaattatactttaagttctagggtacatgtgcacaatgcgcaggtttgttacatatgtatatatgtgccatgttggtgtgctgcacctgttaactcgtcatttacattaggtatatctcctaatgctatccctcccccctccccccaccccacgacaggtcccagtgtgtgatgttccccaccctgtgtccaagtgttctcattgttcaattcccacctatgagtgagaacatgcagtgtttggttttctgtccttgcgatagtttgctcagaatgatggtttccagcatcatccatgtccctacaaaggacatgaactcatcctttgttatggctacatagtattccatgtgccacattttcttagtccaatttatcattgattgacatttgggttggttccaagtctttgctgttgtgaatagtgtcacaataaatgtacgtgtgcatgtgtctttatagcagcatgatttgtaatcctttgggtatatgcccagtaatgggatgactgggtcaaatggtatttctagttttagatccttgaggaatcaccacactgtcttccacaatggttgaactagtttacagtcccaccaacagtgtaaaagcattcctatttctccacatcctctccagcacctgttgtttcctgactttttaatgatcaccattctaactggcatgagatggtatctcattgtggttttgatttgcatttctctgatggccagtgatgatgagcattttttcatgtgtctgttggctgcataaatgtcttcttttgagaagcatcttctcatatccttcgcccactttttgatggggttgtttttttcttgtaaatttgttggagttctttgtagtttctgaatattagccctttgtcagatgagtagattgcaaaaattttctcccatcctgtaggttgcctgttcactctgatggtagtttcttttgctgtgcagaagctctttagtttaattagatccgatttgtcaattttggcttttgttgacattgcttttggtgttttagtcaggatgtccttgcccatgcctatggacatactcttctttacctccattgtggagcagtagtccaattttcccttggtagtgaatgtaaatcactccagacaacatcatagttcccttcttggtcttttgactcagacacatgaggaacccaaagtggccaggcagaagtcttaacttccaggtcaaggaatcactcactgttgtgtcttctgaagaaaacattcctccctctggacctgtagacctgcatgcagaacattaagtcttgggaataggaagcaaacattttgctagtggatcactagaggtaataatgagtgagaacactcccgtttttacctgttgaatcctggctgtggaagaaacagtgtcatatactggatactgattcagagcatatactgccttctggagggccttgtcctagcccagcaaggttttgccacctagttgatgctgtatgtagctaaatcttcacaagctctttccacggttctatcagtcaaatgctttagaatagtggggaacatggtaggagcagtgaatcccatgagcatgagcccattgtcacacttctttggctgtgaagtaaattccttggtcagaagcaatgctgtatggaataccatgacagtaaataagtcattctataagtccacagagggtagttttggtagaagaattgcattcagggaaggcaaatccatattcacagtgtctattccagtgagaacaaaaacaatgcctctttcataatagaagtggtccaatgtaatcatcctgcaactaggtagctggctgaacttttcagggaatggtgccatatcaggggctcatggttggtcttgcttgtgccatattcagccctcagcagtggccatagccagtcagctttggtgaggggaagtccatgttgctgagcctatgaataaccttgccaccagggccactgtgttcatgagcccatgggcaatgactggggtggccatctgtcagtgctgtcagtcagggcctaataatccttgctgccaggaccactgtgttcatgagcccatggggcaatgacttaggtggctggggaaggaggctgacttttatccaagagtgggtcattttatccatctgattattaaaattctcctctgctgaggtcacttttgggtgagcattcacatggaacacaaatatctttttgactttttttgctcattctgagaattctaagagtcctatccacgtacctctttcccagatttctttatcaccaatttccagtcatgcttcttccaagtccctgactatccagccaaaccactggcttagcccatgacttggtgtataattgcacatctgaccatttctgttttcaagagaagtgcacaacctggtgcactgctcaaggttttgcccaccgggaagatatcccttcaccactgtccttaagggatgccccagaaaggggttacagtacttttgcttatggttgatacctgcatattgggcagaaccatctccatgccaggcccaagtttttttttttttttttttgtcagctgatcatagggaactccatatgcagccatagatgcaggcagggagagataaggcagtgtagcaggagtggggactgtgggcatttgggccacttcttcatgtagctgatttgtgatttcattgcatgcccagcctaatcatattacttccatctgacaatggagtgctgtcgtgcatgcccaatgccacggcttggtgggtcttaaaatacccagtccatgatgggcggctcaggtagtgtggtcatttgatagcccatgctcatctgttcagtctccactaaggcctggtagtaggttaagagctgtttatcaaaagaagaacagttatcagcagattatggtagggccttgctccaaaatcctaagagcctgtgcagcaattcatctacaggagcctgccaaaggctccaaatagcatctctatctgccattgaccctgcaagcaccattagatctgctggatcttatggcttaagtagcagagtagctcacacagaagccaggaccttttgcagagccttctcttgttttgggcccccactcaaaactagcagtttttcagatcccacatagtaaatgggccagagtaacacacccaaatgagaaatgtgtcttcaatgtttgaagaagtccactaggcattgttcctctttcttgcttgtaggaaagacgagatgcaacaactcatcttttaccttcagagggatagcttgacatgccccataccactggacccctagaagtttcactgaagtaggagatacctgatttttaaaaatttattttaaatgagaaataaaaattgtatatatttatagtgtaaaacaagatgttttgataaatgtatacattgcagaatgactaaatcatgctaattaacatatctattaccatatgcttaacatttttttgtggtgagaatacttaaaatctattctcttagcaattttcaagtatacaatatatcgtttttaactatagtcaccatgctcttgaatttattccttctgtctaactgaaattttgtaacctttgaccaacatctccccaatctctgtgccccaccccaacttccagcctctgctaaccaccattctactctctgcttctatgactccatctcttttaaattccacgtacaagtgagatcctatggtatttgcgtttctgtacctggcttatttaacataatgtccttcagactcctccatgttgtggcaaaaatgacagaattttcttctttctaaaggctgaatagtatttcagtgtatgcatatataccacatttttgggttaattttattttttttaattggcaaataattgttcatattcctggggtacatagtgatgttttgatacatataatatatagtatagtgatctgatccaggtaattagcatatccacaatctcaagcatttattttgttgtgttgggaaggctcagtatcctccttctagctattttaaactgtatcatctattattgctaaggatggtcgtcctacagtggcatggaacactggaactcattcctcctatctagttgtaattttgtattctttaacagacttctccctattcctatcctcccctttcctttccttcccagcctctcatatccttgttctattttttacttctatgagatcaacttttttgagcttccacatatgagtgagaccaggtagtgtttaacttcctgttcctggcttatttcactgaacataatgtcctccagttctatgcatgttgctgtgaatgacatgatttcattctttgtttatggctgaatggtattccattgtgtgtgtatatatatgtatatatcccattttctttatccattcatctgttgttggacacctaagtttattccatatattggctattgtggatagttctgcaataaacaaggaggtgccgatgtctcttcactataatgatttcctttcctttgggcaaattacaagcattgggattgctgggtaatatggcagttctacttacagtttcttgaggaacttctatactcttttccctaatggctgtactagtttatattcccaccaacagtgtaaaagagttcccttttctctgcatccttgccaacatttgtaatgttttttcttttgataatgaataaatcaaattatttaaaaatccaaaagtaatttaataattaaattaaattgaattaaataatttctgggttttctatttgttcaattggtctatgtgtctgtttttacgtcagtaccatgcgcttttgattactatagctttgtaggagattttgaaatcaggtagtgtggcgcttctaactttgttctttttgcccaagattgctttggttatactgggtcttttgtgtttccatgaaaagtttagaattttttctctatttctatgagcaaatgtcattagaattgtgatgggggttgcactgaatctgtagatcatgttgggtactataggtatttgaacaatattagtacttctattccatgaacacagtgtatttttctaattatttgtgtcttcttcaatttctttctttctttctttcttcttcttcttttttttttttttttttgacggagtctcactctgtcatccaggctagcattcagtggcgcgcaatctttgctcactgcaacctctgcctcttgggttcaagcaattctcctgtctcagcctcccaagtagctgggatattacaggtgcccaccaccatgcttacctaatttttgaacttttagtagagatgaggtttcaccatattggccaggctggtcttgaactcctgacctcaagtgatccacctgccttggcctcccaaagtgctagaattacaggtgtgagccactgtacctggccatcttcttcaatttctttaatcaatgttttatagttttcagtacacagatctttcaccaccttgtttaaacttattcctaagtatttattttatttaatgtttttgtagctttgtccggtagttcctgaattaactgattttcagaatattacataaatggaatcaagtagtagttgaccttttgagatcaacttttatcacctagcataattcccttgaagtacatccaagttgttgtgtatatcaatagttcatttttaaaatattactgaatagtattccattgtatggatgtaccatggtttgtctaaccatgcgtacattgacaaagttaagaattctctcaattttgggctataatgaataatgctgctctgaccattcatgtataagtttttgtgtgaatgtagcttttaatttttatctgggatgaatgttcgaaactgcagttgctgggctatatggcaagtgcatttttagttttagagaaaactatcaaactgttcttcaaagtggctgaaccattttacattttcaccaacaatgtatgcatggcccagtttctccgcatcattgccaacattagatgttaatataattttcactttagccattctcagaggtgtgttgtaatattgccattgttattttaattttccccagtgattagtgatgttgaacacttctttgtgtgcttatttactgtctacttatttccttttcaatgaaataactgttcatgtctaagtacattttttcattgaattgtttgtttgttttttatgttgagatttgagaattccttgtagaaacacaggttcaagatatagcttccttttttagttatgtggtttgcaaatatattcttccacattgtcatttgatttttaatcttctcagtagatctttcatagaacagacatttttaattttgatgaggtgtagtttattaattttttcctgtggattatacttttttgcatcaaatctaagaactctacctagccctaggccccaaacattttcttccatgactttttttttgaaatattctataattttacatttaagtccatgttccatttgggataaatttttgtatgagcagtaaagtgtaggttgagcttattattgctatttttgcttttgaacatataattatgtaaatcctttttgtatataaagaaatgacagcagtcaattgtaccattcatgatgctcccttacttgtgtttttgtaaactttcttgaatgggagacaggaagatggcatggagctacagctatggtatctatttatgtgcctacctatcaataaaattttgtgtcagcagagggaaagggctttaaacaagcaagcataagccaaataatcctgcagacatgtttgtcccacacagtgttctaaaaaaaaatcttgagctgacttaaaacaaatttgaagatttaatatgcaaatgtagatctacaaattctttttaaaaatcagaagattcagtgatagtagctccacattcctgtctggcaaccatgtcattgcctggagctgcttgcttctttagagaagacatgctctctccagttcactacagtctccaccaatccttgctgaccccccaacactgagaccccttttcagtgtcacctctcattattgttttccttgcattattgctttagttgtccagtgcttgtttctatgtggtgctctcatcattccctttaaatcctcacatttgtgacctccttaggtttctcttcttggcctgtcattctttatttccttccatttctcctctctctctcctttactctgtttttctttgattatttatttaagcccattaattgttgattggtagtgaagtgtcaccgagagtggcctatcactgggtgttcctaggccctgtaacatcctgaccctacaggacttccagtcattttgaaggcctagcatgcagcatgcaatttgtgagtcgtgggcttccaacacagaagtggtggtagagtgcagagaatacccactagatctgtgattttgaataacctgtcatgctttagtccttaagttgagtgcctgcccttctgagttgggccactgagctcagtcataaaagcataagtgatagcatctgaactataattattctaagtcacacttaaagtcattaaaaaaaagttggcttttgactaaggatgactcatggcatcctggagcgtgaaggccaagaaagagcaataccaaagggtgggagagttcaaaatcttctgggaaaacctaggtcagggaatgtcggacttgggctccaacaccttctctcaaaccccacaaatcattttttatttgatttgagaaaatgataacatgataaccatcttgagcacaagatggcagtcttacttctgcttcactgcctttggctgtctggagagaagtgataggaaacagagcggaaacaaaactgcttgtgttgctgagaaatattgaaaaataaacagtaatcaagaagagtgatgagggaagaaaagagatggaaaatacatgcaagtgtttttgagttttgttttgctttgtttagaacttggctctgctcagtcttgagtctctgtgctaaatacatgtaggctggagtctcacgtgtatgtttcagctctgatctagatagagcaaagaccctagcagacacaggggatgcagaaggaaatctagacaccatatgttctagcgcaaggtaggcaatgggtccaggtacttggacggagcaagtcttgggctaggctatgataacctctttatagtatttcttatgaaactaataaaatgaaaaactttcttttttatgcaaagacttatgccatactctggcaagcatatagacagagttcaactcataggtagatattaaaaagaagagtgaaagagactcttgctctctctctctctctttctctttctctggtagccactgaaagctaactacactggaacactctcatttctgcaaagaaaaatatcatatcccaggatgaaaaggaggaggaagaggaaaggctaacttaacaagaagctctttgacattcttgaattagacacccaacgtagtccacgcagtacggaggtaatttggtccttatggccagccctaagattgtgtcaaaaacaccaaagaaaaggaggctagaaggctgctgctgctcctggggtaaggtgaggttactctgtgccttgccacttttcccgatggccagctacagggcagtgccttttataggcacagaggtaccatctcagctctctgtcattccttccatactaaaaaacatgggctaaagtgacactttcaatccttgttgaagtgatattaagccttcattgtatgactttcttcactcacaaaatgaggttaataaaggtaatacaaccatttttgggaggcaacatccttcacatggagaaagtttcagggctgggcacagtgggtcatgcctgtaatcccagcactttgggaggccaaggcaggcagatcacttgaggtcaggagttcatgaccagcctggccaacatggtaaagcctcgtatactaaaattacaaaaattagccaagcttggtggcacgtgcccatagtctcagctacttcagaggctgaggcaggaggatcccttgaacccgggaggcggaggttgcagtgaggcgagatcccggcagtgcactccagcctgggtgacagagtgagactccacctcaaagaaaaaggaaactttcagacttaaagttgcggacattcaaagacaatatctaattagtcatccaagagcctcgtgagatagagttttgttaaatgtagagttgcaggcacagaaaggcaaattggtaacctaacaccacactatgtctttgttccataaacaaccttgtgatatttcttcgaataatatttattcatttatttagagaacagaatccaaaggacagtggagatttagcaccagaggcagtggctgataatctttgataactttggggttgtgagaccactggcagtgctctcaggatatcctctcccaatccaaaatgtactgagtgacacatcttttcaaatttaggttaaaaagaattgatgttttaaagttgtattttgaggatctgatactcttttaagattgttagaaatattctggactactgaaaacacagaattagctataggagtagctcctgccctcagaagctgaattatatttggggactgatttttctattctatatatgtcacttgagaggctaagaggaaacagaaggcaggagggcttctctcatttccagcaccttctccttaatccataagaaatctttccccatgcacagaagatgtctcccaggtggtagagaaggtttactgaaacttttgaagagcagtggggggaaggtcaaaggtgcaatttctgtatttgcaaagaaacagggcttgcagaatctctagggcttctaaacagaaaagaggtatttttattacaagacatgaggtcagtcaattgatcacagaggtgtttttttttgttttgttttgtttttgtttttttttttgagagagaatgagggtctgtcactctgttacccaggctgaagtagtatagaggtgcgatctcagctcactgcaacctcctcctcccaggctcaagcgattctcccacctcagcctctgggactataggcaggcaccaccacacctggttaatttttgtatttttttttgtagagatggggttttgcaatgttgccctggctggtctcaaactctgggactcaagcgatccactcacctcggccgcccagagtgctggaattacagacatgatccaccgtgcccaatcccacaaaggttctttaagaaagagaaactaattaggtgaaaaataacagaatatcaaggagtggcttcattcagcagaataatttgttttctgttgtttcttcactaggatgacttcagaagtgcaattctgatatggactttgtctccctaaggctttcagttcctcatatttaggataaaacagaagtttatgtaaagccaagggagagggtcaccgggagagggaaggaggaacagcagaaggagaggtccacacatgaaaatacttggaagcgccccagggcctatcagatgcaggtcttggcggaaattaccaaacatactttagacaggctgctgtgttgctgagtgtggactggcctcagggcctgctgatcaaagcaaaaggaagcagtgaaaaaaacatcaccatgtcttcttagagtctaatctgggggcaagaggccagcatgcacagttggtgctgattttcttgggcggatagaggaaaggtgtaggcgtggccaacatttgagcagcatgtggttcctctcacacgccatgctgtttccggcctccttgcattttactcatgccatcctcctggtcacttctttgagatattaagtgcattctttaggactcagactcagctcaagggtcagtgcatccatgaagccttacctggatcccagagggagctctgtgctcctcctttgtctcctataggacccagtacatgcgtccagtattatccatacacactgaaatgatctagcatgtgtcttcccataggatttcaaattcttagaatataggagtgatgccttcttcctacttatatttccagtgttaacagtgcctgtcaattgacttgaagataactaaaagtctggttgttaagggctgcttcccacctccaaatacttccctggaagtcattgtatgggcactgacattggtaggtctccactggcttgtagatgcttctgattataaggtagtctcagatgccttcagaaagttctaagactgtataaaacatttccttcacaaccaataactgtgtattattgttcgtgtaattccagaagttatccttttgatagagagcaattactttattgattgagagttagctaattatgtaataaaggtaaagatttgcatagagaagtgtaagagacatggagaagattcttggtgggtggtgagggcgggtacatttacaccagaccaagactgatctggctgtggcgctggagattaaactgtttaaatatgggatcctaagaagacttctgtgcattctagacttcaagagacagattgcatttttttttaggaaatgtagataaaaccctttgactgaatgactctagaaaataatactgatttgagagagaaaggaaattctaaaacaaaatcctgacagcagaggcatgaatgatcctcatgaggaagaaatgagactctgcttaactacactgtagattttggtgtggaagaagatggaaggtgggtatatagccaaattttgaatacaatagggcagcacaaaactgtgacaacagtggcagaaggactgaagtacagaatgtgtgaaagttgttgtgaaataaatagagagcaacagaaaaggactatttgggctgggcaatggtaatcccagaactttgggaggctgagtcaggtggatcacctgaggtcaggagctcaagaccagcctgaccaacatggtgaaatcccatctctactaaaaatacaaaaaattagctgggcctggtagcgggtgcctgtaatccgagctactagggaggctgagtcaggaggatcacttaaacccaggaggcggaggtttcagtgagccgagattgcaccattgcgctccagcctgggcgacaagagcaaaattccatctcaaacaaaacaaaacaaaacaaaaagaaagaaaaaagaaaaaaaggacgatttgaaccaggcttagagtaagaaggatgaagtgacaagaccagagtttgggcagatggtgagacattaacagataatagagacaaagcagtattttctacctcttattctgtgtctttctctggcgaggaaaaggatttttcctttagaaatggtagagataacgtggttaacaagaagttgacatcttagttgagggagatcacataagagatatcataagcttatttaaatggctgcaaagatgataaaggttattactgggtttgcttatatgactaaggataagctgccggaaatacttggagagaaagatggtacatagaagaaaggaagagaatttgtctcaattttccaagaaggagcaaatttgggatccagaatacacctaaattactgttcattctgttttctcagaccgcctccacttgcctagcctactctttctctttttgggctattttgtccaatctttccccatcactggacagggagtgggtacaaaatgagccaggtggattgtggctgggtttcatagggctaaactacaaaggggaatttctatccaagacaactcagtacactaggtcctgaaaaggcagttgagataaatcatttggagaagctgatattaaagaaacaaggtgtaaggatcaaaaggaaccaaaggaagaaatggagttacaggtttaaaaagctgaaatgcgggtggtaggttgacatcaggttagaatgaggtctgaagttggcacaaaaaatgaacttcagaatgactacaaagcaaaataaaaacaaaatattaatggacaataccagtttggtctttatgtaattgggtatgtggtgcataggtggctcaggctaagggttaagaaagacatagaattcagtttgatggattcttagctggttagacagtcaccttctatgtaaggatgaattaattagttaagaaatagatgtcagcataggcaacgtttttagttgagtgtctggacctgtcatgttaaatattctttatcactgacttaaatagaagcatgaaaggcaaatatattagacctgcaggtgaaaaaaatataagaggaacagttaaaatgttggatggcagacttgaagaaaggattccattttctctactttgcccctgagaggttaaaactagcatcaacggaggagcatttttagagaggcagatttaggcttaccataaaatggaactttcttgcaattaatggtgtacaaagatgagattaactttttaatttaatttaatttaactttatttgagattgagtcttgctctgtggctaggctggagtgtagtggcgtgatctcggctcactgcttccacctcccaggttcaagtgattctcctgcctcagcctcccaactagctgggactacaggcgtgcgccaccatgcccagctaatttttgtatttttagtacagatggggtttcaccacgttggccaggatggtctcgatctcttgaccttatgatccacctgtcttggcctccaaaagtgctggaattacaggcgtgggccaccatgcccagctgagattaactttaattcaaccaatatgtattgagctccatacatgatactctgctagatataatgacaaataagagaattatttggctgtaagagaatttatggctaacttcagtaataatctgtaaagtgcttatttctaatatcctgattaaggaaagttgctggaagtgttcaagcccagactaggaactgtatctccttgtaaaggagattcctgcaaatggttgaaacgttgtgctcagccagttggtttcaaacttgactgtgaaccacgataagaaatacatttacaacaaaatccagtacaacctataataaagtttcatcaaacaatgttgcctttatacctttgctgttttctattctagcattgtctagtctattccgttagaaatatcctaataaaagccactaaattgacttagtaatgggttgctaccccagttggaagaacattttgaagtaggaggtggaacttggctccagaggtaaggattcgaacttcaggtgagattgagtactagctgaaatagggaagaggccaaagagcctctccataagacacacccaccaatgccatgtcagtttatcattgtcatggcaacactcagatgttaacactcatttccatagcaacgacctgccgacccagaagttaccactctttgttagaaatgtctgcataatctgccccttaatttgcatgtaattacagtgagtatatatattattgtagacccgcccctgagctgttactctctaacaggctgcctttggggtaaccctgctctgcaggagcagtcatggagctgtaacattgccacctcaataaagctgttttcttctaccaccaactcgttcttgaattctttcatgagtgaaacccagaacttttctgggctaattcccaatttggggcttgactgcaacaatttggttaatcacctgcagaggtctgatataatatagtgcttgtgggtctttaagtacatggcaccatgtagttaaaaagtgcatggccataaaactgttctttgcatgaactgtgattgtcaattgcgttgaactgggaacacttgactgtcacaataaatatgggcagagtagcactgaaacatcatactatacttgttcattgaagcataagtaaacttctttgtaacaactgaagttcttttgtgatgtggtactgtaatagacttcccagtctgcagaaaggaaagacaagaagaaatggaaagaaataactttcttctaaagaaataatattgaaattgtacacatcacctccacttaaattctctggtaaaaacttagtcaaatggccacacctttacttcaaaagaagttgggaaatatagttgttgactgggtgcgatcaagtgttctattactcaagagaagaatgggagaatggacactggggttgtgggacaattaacaggattaagtaattgattaagccataatagttaaaccttgacaaaacaggacaacacgggagcaggtatgggtattgacctagactaccaacatgaactaagaaaataatccggagctgaccacgaaacctcgtcagatggatggcctgcaacttagatttaaggatcacccacatgcccgtgactccagttttctgaggctctgttgaattttctccatatgctcttccttttaggtgttcataaaaactttataagtctgtgttgacttagtatgtgctgtgtatgactaaaagtacaaaagtggaagatttggacacagagaagaaaggaagtgggatgaaaccttgggtttggctgtggttcagagtgaccaggtagcatacagttcacagaccatcttaggcagaggtggggaaaagtgagacctttactcagagttggaggatgttaggtagaaaacagtaggaaactgtataaacttcaaaagaggatgttggggtgacagggagcaagtgtggtgctaatcatgaatatcagcctttggttccatgtgacctgtgttgagtcctccatgctcaaatactccctcttttatggttgccatggtacctgaaattcctttggattacatctttttcccagtgtcctccactaaaatacagacattcttgggaaaatgaagtgtctgatgatgaacattatttggattgtgaacatgcttgtagattctgttccttccactgacgggaaggactctagaaataggataacaccggatctaaaggggaagaggcaacgcaaagaggaaaattaggcatggtatgggtaaggaggctgtaagttccaaataagtattcacaggtttcctggtcttttctcctcttacctcaaactacctctctatttcctctaagttactaatgtcgtgatttggtgtaaatacttctctgtttttctccatagtcaaacaaaacatattcacaaatactggctttctttgtaggctcagactacatattgtcatgtgagatgcattattaatatattgtggatatgcctccaagtcaatctatatgaaactctttttttcttttttttttttttttgagactgagttttgctcttgttgcccaggctggagtacagtggtgcgatctcggctcactgcaacctctgccttctggtttcaagcgattctcctgcctcagcttcctgagcagctgggattacaggtgcctgccaccatccccagctaattatatatttttagtagagacggggtttctccatgctggccagactggtctcaaactcctgacctcgtggtctgcctgcctcagcctcccaaggtgctgggactacaggcatgagccaccacacccggccctataaaactcatctttaattaggcatgtactgatgtaaagaatagaagtacagatctgtattcacttaatgatggagacacattctgagaaagatgtcaggtgattttgtcgttgtgtgaacatcacagagtacacttacacaaacttaggtggtagagtctactatacacctcaagtatacattatggcctattgtttccaggatacaaacctgtacactacgttgctgtactgaatataataagtaattatggcacaattgtgcgtatctaagcacagaaaaggtgcggtaaaaagagagtataaaaataaaaaatggtactcctgtaaagggcatttaccatgaatggagcttgcaggactggaagttgttctgggtgagtcagtgagtgagtggtgaatggatatgagggcctaagacattactgtgcaccactatagaccctataaacactgtacacttaggctacattacatttacaaaacattttcctacaataatatattaaccttagcttcctctgttttactttatacattttctaattttttaactttttgactcttttgtaataacacttagattaaaacacaaatacatttttgtacagctatacaaaaatatttgctttctttatattcttattctgtaagcttttttctatttttaaaatgtatcattttttaaaccttttttgttaaaaacgaacacacaaacatctacattagcctcagcctagagagggtcaggatcatcaatatcactgtcttccactccacatcttgtcccactggaagatcttcaggggcaataacattcatgtcatctctgatgatgataatgctttctgctggaatacttcctgaaggatctgcctgaggcggttttacagttgacttctttttttagtaagtagaaggcactaaacatggtggctcacacctataatcccagcactttgggaggccgaggcaggcagatcatgagatcaggagatcaagaccatcctggctaacacggtgaaaccccatctctactaaaatgcaaaaaattagccaggtgtggtagcacgcacctgtaatcccagctattcgggaggctgaggcagaggaatcgcttgaacccgggaggcggaggttgcagtgagctgagatgggccactgcactccagcctgggcaacagagtgagactcggtctcaaaaaacaaacaaataaacaaacaacaaaaaaaattagaaggagtacactataaagtaacaacaaaagctaaagtatagtaaatacataaaccagtaacatagtcatttattatcattatcaacaattatagatgtactatacataattttacacactatacttttatacaaatgacagtgtagtaagtttgtttactccaatgttaaccacaaacaggtgagtaatcccttgcactacaatattaaaatggctacaatgtcactagaagatagaaaattttcagctccattataatcttatgggcccaccatggtatatgtagtctattgtcgatggaagcatcataatgggacacgtgactgtattataatttattgacttgttccactattaatggacattcaggtcctatttttaggtatgggccactgtgtcttctatttattaaattatggtttccccagactttttcaaagtgtaaaagaaattacagagtaggtacttctaaaactagaacattacagaatctgagtttatttaaaaatctccaaactttataatagcattctaaaattggaggttctaaaggaactccagcagaacaagaagttgatgattggaggatctaggtcagcatttctcttttgtttttagaaacaactttatggaggtataattgctaataagctaaacatttaataagttgatcagatcgaaaccatcaccacaatccatccatcatcataaagtttccttgtgtcctttgtcattgctccctctggctcctccctgcctacttctctctttcctcgccagcagtcactgagttattttctgtcacaatctatttgtttgcactttttttttgcatttttgttgcattttcttgagttttatgatcccatacagtatgtactcctttttatctgatgttttcacttagcataattattttgagattcatgcatatgactgcaagctttgttcatttcttttcattgctgagtagcattctgttgtatgggtatgccacaatctgtgtattcattcgcctgtcaatgaatatttggattattacagtttttacatataaagataaagctgctatgaacactcacgttcaagtctttgtatggacatatgctttcctttcttttaggtaagtatatagaagtagaatggttggatcacctggtaagtatacgtttaacttttgaagaaacttctgcatttccaaagtggccatacaattttacactcccagtagcagtgtatgagagttccagttgctccacattctggtcaacacttggtatggtcagtttttaaaaattgtagccattccatgggtggatcacgaggtcagcagattgagaccatcctggctaacacggtgaaacccggtctttactaaaaatacaaaaaattagcccgggtgcggtggcggatgcctgtagtcccagctacgtgggaggctgaggcaggagaatggtgtgaacccaggaggcggagcttgcagtgagccgagattgccccactgcactcgggcctgggcaaaagagtgagactccatctcaaaaataaattaaataaataaataaataaataaatttttagccattccaattagtgtgtagctatctcattgtggttttaatttgcatttcctcaatgactaatgctgttgagcatcttttcatgtgcttacatgccaactgcatattttctttggtaaagtatatgttcaacacatttacacacttttaaaatgttgtttattattattcagttttgagagttctttatatactctgatatgactttatcaaatgttcagatatttcttacattttgtggcattttttttcattctattagtggtatctgttgaaaagcagaaattgttaatctttataaaatccaatgtatctatgtttttctatttatgggctgtgctttaattctaagtattttgtatttttgattggctattgtaatttgtagtttttaaaaaattaattcatgattgttgctagtatatagaaatatatctgatttgtaaatagttatcttgtattatgcaaacttgataattcatttattagtataagtagctttttcatagattctattaaattttctatacaggactcaacgttgtatgttttaaaaaagaacagtctaattcttcttttccaatctgaataccttttatttctctttttttgacttattgaactaactaaaatcttcaatgcaatattgagtagaaatggtgaaagtggatttccttgtcttttaactgctttttggaaaaacatcccctacccccactacactttctagactctggtaaccctcattctccctctgcctccatgaggtcaaccctctgcccccatgagatcaacttggattcatgagacaaactccacttactcatgatgtttttggatgtgcgatgtattgttgaaatcaatttactgaaattttgcttagaatgttagcactgacattaataggaactgttgttttcttttcttgtaatgtttttgtatatcagtatcaaggtaatgctggcctcataaaatgaattggaaagtatttcttcctcttcatttttctagaagagtgtgtatgaaattggtattctttttccttcattgttttgtagaattcaccaatgaagccatctgggagtggagttttctttgtggaaagttttaaaccagacattcaagttttacaatagatataggattatttaggtaatctgtttcttctatagtgagtttcattggctttttatctctcatagaatatgttcattacatttaagttgttaaatttatttgcataaagttgttcacaatatatccatagtatttaatatctatgaaatattcagtgttttaattgctctcattactgttattggtcctttgtgttttctcttttttatttctgatcagttggactagctgtttttattgatcttcacaaagaaccagctcttgatttaattaattttctctattggttttatgttttctatttcattattttccactctgctctgtattatttcttctcttctgcttacctcgtgtttaatttgttctttttttccctctgatttcttaaggtggaagctgaggtcattggttagagatctttcttctttcctgatacaggaatttagtgctataaaattccctctaaaaactgctttagttgtatcacacaaattctgatacatagtgttttacattttccttttgatttgttttaactctattcgctttaatcttttgcgtgcttctttctctggcctcaggtagctttattacctgcatgtgtcaatcagcactatgctgaatacttgagaggaaccctctgcagatgtccatagttctttctgggcaatactcttctctttgctactctgtcttgtgaactctgcactccttgatttctcttgagctagtctcctcaacttaggtagatggcctctgcctgggttccttctctctgaacgatgaccttcattgtcttatatccattgtcttaactttaatatattttgttcagtgttttggtcatatgattgagagaacaaatccgttccctattactccattttaatcagaagttggcagtattcttgcttatttttttacaactcagtattggatgttaaaatcaatgtattgagttattacatgcattcagaaatgaaatggtgtagaagagaaaaggatatattagtttatgtactaagggtaagtaagttttgtattatgacacttcttttttagttagtatatgcctttatgtatgtgttcattgggttgtgatataaaaggcatttcttattgtggatcatggtcaaaagagtttgagaaacattgctctaggtacatcatggttcagtgcaggtaggaacctgcagcacttaatttctatgcctgcattcaagggatctagaaaaaagtcatctctatattgttcatctgaaaaatgttcatcatctcttacaaaggtgtgatctgagaatccttgaagtgatctctgggacatatcttataggtcttaaaatcgaggtagatccacaattctatcagttaagaaatagctactgatcaccagtgtgttctagacactgtccatggaggtgttcagttactagcatgaataagtgggaggccctctctggcccagtactgaagcctatctggctactaaatgagacagaaagtaaggcaaggttttaagcagtgctaggagcactcagaacgcaaggaagatttgaaattgtgaaggtgagaaggagcgtgtctgggggaattatccaggttcttgcagacttagaggttaagaaagtgagatctcctttattttattttatttattcattaaaaatacacatatattttaacacctactatgtccttgagagatatcaatgaataaaatagataaaaatccctgccttcatggagtgtacattcttctgggagaaattttaaaaatatatataataagtaaattatctgtccaaaggacaaactgctatggttgaaatagtagagcagaagtagggtgattagaagtaggaccgcaaatcctaattttaagtgggagatagtggaatatatttagaatccaactataatagtagcatatatttactctaatagaaactctacaaatattccaacataattagactcttctggtgtacaaaccaccgtaagactgcctattctccataccgcattgacatgctgcagccactagggcgaaaatgggccgtttcttagaaaaatgggctcagagtatgggagtgtgagagaaatgtgggtgattacgcacacactccttccttccccaagtgttcctcaggggcttctccgcttaaggttcactgacaagacaggcggagttttacgtgcgtctgagaccaggtcatttttgcccttggcgtctcttccttggcgcgtcctcacctagtagagaatagaggcgcagctcaggagtaaacttcagcctggccgttcaccactcgatgtgtgttacagccgagtgacagtggtgagatagacctgctggccttgctttcgggacctgcagcaagatttttgggtgctgtccaagaattcccgcggttacactcagcgcccaggatctgtacaaaaaagccccaatagatgttttacgttcccttcgtaatatttaacgcttggcctagatccgagcattcactctaacgttcggtttcttgatccttcccatccccaaactctgcgggtagatcagtgactattactatattttgaacgagactccaacccattgctctctcgagagagaaggattgcccgcctttttcccccgggcaggagctcggcgaggccaggagagccgcgcaccggccgggcagggacgcgcaggcgtcgggcgccgctggttgcgcatctggcgccagagcgcgcccccagcgctgtgcccgccgcgacccgggccatgggctggtgctccggagcgtgccgggcgctctctccccgcgcgggggcaccagagccctcggaagtgtcaggcactgcggtgtattttccccgttctcttttaaatgactgcggaaaaacagattccgagccgcaaaagggaagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaaggtacggcaggggagcaagggcttgggatgccctacgtgggggtgggcatcgcggggagtgaatccacgatctgggaatggctacatcccgtcaggttaaaggatgagagaaaatgacgcggcgccacacatcggacaggccagggtggccaccgagcatttagaatacgcatcaggcgcgctcccttcccctcacatgtctctatttcccgggcgtgtgatggcagaaaacggcaggaaaaagacccacttagagagctagaattgtgtttggagactcccttccctctgcaaaagcaccaacaggaagcccctccaaaaccaccgatccccaaataggtggcccggaatgggggcggtgatccttggttaccaatgcagaacacgttttggtgtttacaacatttatttatttttaggatagcttgccctcccttttaggcagggtgggaaaggagaacgcggggagggagaagggagggaggattcctataataagaatcagcgcatttttcagagctgaaccaagcacggtttccatttcaaaaagggagacagcctctaccgcgattgtagaagagactgtggtgtgaattagggaccgggaggcgtcgaacggaggaacggttcatcttagaggtacctggatgtaaatgcacacacacacacagacacacacacgcacgcgcgtgcatgtctacacggccaggatgtgtgcgtgtgtgcgcgcgtgtgtgaactcccacatgctgctgctgtctgcttctggccagtggcaccgatgcctccctcctccctgctcgcccccagattcccctcccctccctggtgcttttgtctggagggtgttatgggtttgtgtgtgtatgagcgtgtgtgtgtttttggatttcagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccgggtgagcagcgcagatagtgccctcggtcgcctcggccctcactgtctccccctggggcggcctcggctactccccaggtgggacgtgccgcgccacctgcccgcgccaccggcacccagcggccgtggcggattctgcagcatcattcgggggccccgtcgcggagccaaagccgccggcagtctccgcattcccctttaaagggtccttcgcccggcctgtaccatggaatcctgtcttggggaccctttccctacctcccctcccttggcctcaggctcgaagagagagtgggcacactggtggctccagcggcgtcagtgccatcgcggggcaagttgattcctgggccggagctgggcactcatccatccacagtctccgggctggggtcggggtggggatgacgcgagcagagagggagagtgccccaattagtggtgttgggggtcctacgctcagtcttacgcgtgtctgtttgtcctcagcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaatgtgagttcctggagcttttcctcctttttctccttgcccctagggcccgagctggccaggtgggtaggtcctggaagtgaatgctgtcccaagagtggggagaagtcaaagacaagggatgcaggacagggtcatctgtcagttacctgctgtttcactggcttgggactgctagtgcagggagaagtgtgacactttagaataagtttcaaatatagatatacatatgccgattatatatttattcctcgtgggaaggaactcactatgctttttatatttcaaagctctgctgggtgtgctttaggctttcagtatgcactaacttagttttgggcatttttgtttcataaagtgctgtgtgtatgttgtgttagaagttccattaatattcactagaaaagaggttaaaataattaactttcccaaatctgttgagggaagtgacagtctctcccttaacatcttttttgagatttaagttaaccaatttcccttttcattttatatatcggattttgcttaggagatggcatccagagatggccttgaaaatgatctgtaagaggagaagttctgagtgttgaaatgcactcgctcaaaagaaaaaaatatgatagttggaagcctaaaagcctggtctaatttaatttggacttgacttcccagagatatgattttgagaccacttggattataactcttaattgcccattgaataatttcccaggactaggttggatgataaagcactgggtagaactctgatgaaggctggctttagcattggacctctgtgtccctggaaatgtttgagcttgttgtggcttgaagaaacagaactgtgtatttctattctccttttctgatgctttgtgacaaatgcatcaccaagcaagaacttgccagtcctttctctagcattcctgtgtcacctctactggactgttattgttatcatttttttcctgaaggatgctgtcattccatacatctcattaacatgagattttattcgtatacgtggaagattgtaaggcaaagtttctcccagttttccttattgtgtttgatactgagataggcagccctaaagtggggcttgggctgtggccttccggttgtcgagtgcgcatgcatttttccttccacagaaaacatacaaccatgtttctgccaacgtagttgaccaagataacctgttttttaatgtaagtaagagaccttcctagtctctgttgcctgttctgctgctgatgcttatggtgtaagcctcaggcaaaaggaaatgacagcagagcagaggggaatgttcaggcctagcatagctgagatgtgtcgggagcagccaactgtcgggctgagtccagggtgctaggatctctatctttttggcaaggagagcaggagccaagagcggagagcaagggtggatagggccccaactgtggtggtcttggactgggctggttgaggcttaccaggctggtccaaagtctgtggccttttgtcagaatctttttcatgagatggggtgtcagtagttagatggagaaggccatatggaattcagagtgcttctgactgttttgagattatggggagtgccttccacagtcagatattgttgtgtgtgtgtggtggtgcttttaaaattctgttttaggtgatagatgcatataatgaagaaagaaagaagatagggctgatcattttcactttgtttttctgtttgataattttaaggccatgatctgagaaaaaggaaataaaactatctttaaatctaaaaaattattatttcagaccttcctgatcttagctgcctgatgtatatgaaatcaattgatttcagcagagctttcttatatctgtcctcacaattgttgttgcttcttttatatctgatggcaggttcctattttcagcttttttaaagtagattttaaaaatatttacaaaagcatgtgtcatagttattcattcaatcgtggcacttctaatttctactctaacttttttcccttttgatttgaaaacctcttggggttgtgggattggagaggtatatagggctaagtgttgagaacagggaattaggttagtaatattagtctggctgggtagatgtgagtcctgagacaaagtatgtttctctgctctatctcagctttgtgtgagcccagccagtttgtgccccagtgcctttgtctgtaactcgtatgacaatacttctttggaaagtactccatataattattttgaattctgcttttttgacctaaaaatgacatcagtggatgcgcttgtttcactcgcatccttatatgacaccatctatgttctttttcttacatattaatatttgcttgcacagcttttaaattcttgtccagtggataccagctacagttggaaccaaattatacatattttaaaactttgttgttaggcccagtggtattcctaaaataacctgttgtaaagttctggtttagtggtatgtagctgaagttacgtgcgtctattttttaaaaatagaaataatgtggtgaataaactgtgattagcaacacacaacttgctgaaacaacggtttaccatatcattcaaaaatggtgtatcttttagcatctatatattaaaccatcatgcccttagggttctaagaacacaaatagtgggacattaaaaaaaatgtgtagattaaccaagaggtaggatctttttgttttgttttgtttttacatgcatgctttcagctaagctgacattttgtcttcagagtcattgaacctattttattaaaaatcttcccatcacagtacctgttttatattttttgcccactaatgtgacataactagatcaatatctatctataggtatgtatcacgcctgctcaacatcacactgctaagtggcagctcctgttatttggaaatggttataccacagcagtgttaaaatgaatttaaacgcagtaccaatgtcacatgcaatggaattcaagagtgaagcctgttgttggaattatgtaactggccgtttaaatcccagttgtattaagtgccaaagtgcattgcaaaggacaagttctgtttcacccaagtggtaaaaggcacagtcaaaagaagtcgtgcatttttttagctgtggtaaaaaaaaaatacataacctaaaatgtaccatcttacagttcagtagtgttctgtgtatccatgttgctgtggaagggcatgcatttttatgttgcacgtgctttatgaagactaatagggatcttttttttgaatttctccagtggtattctctgatttgggggtaatatttgagaacagccttatatttttcctcttagcacaacctaaatagaatttggagcttctcctatgacagactctatgtgcaatttattgttggcctggttaagcagctgtaatgttgtgtcattaatacattgattttggccctcttactttaataagctttgccattgcaattaattgtacttaaaaaaaaatcctggcattcacaaagattcagtgaaaggcatcaatttttattactctgatgtttacttctcagcccctccattgggggttttagaactttggactgtgtcttatatgcatttaagagccatgtatttaaatttggagcacggttacataagccacactagacttgttaatgaataaggcagtctaatttacatcattcattatttaatacaacttgcaagctggagttgagaacatgctgtcttcatagtgtaggtatttacagacatcagcttggcacaactgtgtggagtctttttagtttcataccttcaatctctgcaatatggacacttttgttaccctgggtaaaacagtggaaaagccttgtgacccttttgaccctactttcttccacctccccttccatcacccattatttatacaggaaaatgggtttgatttttttcttctctgaaaagtgatatttccttatgggaattcagaatgctggagttaagagaagagcctgggctgtatgttattacaagcaagtattgggaagttgaagcaatgtggtcccagttccctagtgtggagtttaggtctgtttaaggtctctcactgtttctatcccataaacctctgtttgtgtctgcttcaatattcccttataaaggtgttttctaagctgaagagttggctgaacagctgagagttgaggtctctttctccctagtaatattctgtatgatctctttgactatatctaggtcataggagtataaaaactagtgtttttgtttagctggggaaggggaattgaatttcttttctcttctcctttctttctttctttcctttttttttttttttttttttttttttgccttgagtgttaagcaagtgcatccagttttaactcattggtcatcttgcctgctagggaaaaaaacattatcaaaccattattgaataccataaactggccttatccctctggctaactttaccacttctctagagagtttcttgtaggttcaaaagctatagcgtaggatgtgacatgaaagacctgccccttggaacaatgccaatttttagttgcttctgatgcctgtaatcaataggaggatttgggggagagactattgaagcatggcaaagtttttacttgtttgatgtgtgtttgtgagagagagagagaaagatagagggaagaaaaaaaaccctgaatcttggattatttatggttgatcaatcatttttatagtctacttggttgagctattttaaaacaaatcccacctcaagcctcaaatggcaaagatctgagctccactgtggcctgataattttagctcacatttgattgctgatcaatctccattagaaaagtaaaggtcccatataactgggtgccttctcaccacttactttgctctctggggtgtccaaaggactgggaagttataaatattgatctgggagatggatgagtgaatgtgctcaaagttacaaaaatcttgcaaagaaaagcaatgtgtagatactaagtttattccttatgtgtttcaaaaaataaaaataaaaaagcatatcatggaaagctgaagtcaggagacctggaacttcatcccaatgtcaccactacccagtcactacccagttacctgatcttgaagcagccttttaatgtttctgggcctcagcttgtcacatgtaaactgagggctttggatttgatgctcagacaagtttctcaaggctctgaagttccctgaagcctcggtcacggagataaggaagtgtatacatcagctgtgaaggaagggcatgatacaaggtgctcggggtctggcagtgtgtgaatctgaagacctttggtgtcagagtgttatgtggaaatgttttcagtgtctgctctgaactccctcaaaccatgtctttttaaatgtgagctgctaacaaggctagtggcatgttagtactggtctgatgagtccaaggtcacagggtcagtgttcagatgggtcacttagaatcggaacctcagaaagagaaagggctttagaaatgatctgcttcagcctcttctttgcaaaaatcaagggcagtgaagaaagttgccgaaggccgactcattaacagcattgtgggaactagaagctccttctcctagcatccaaatgaatgctgggggcctttgctttagggtgcctcccctccgttctgtgttctcaaacagaccgcctaattctggctcatcattttattaggttggtgcgaaagtaactgtggtttttgccattacttttgcaccaacctaatagaaccaccataaatggggagacaagtttaacatggctaagtctgtgcaaactcatctctgtgagagaccaagtaattgaaaagtgcatgagctactgatctgaaagcaatcatcttatcttcatataggaagaaatatattttctgtttagcttactgtgtgtgagtgtgtgtgtgtgtgtgtgtgttaaatttgaagtgttcctcttctttaggcaattcatacacaaaaaatttgagcttcagagaaaagccttcatgagttggcagcaatgaggtatgctaaccttgggcctgctgggccatctttgcagattggcattagaagaggggcagagcagacagagtgaaatgaaacctgttgcccctggagtctttgccacagtcgggggtgcttatgtaagtggagaaacccgcagccctttcgatgaggtctgtgttagctgccctgaaagacctgtggccagagagtacttattattccccgacttctttcttccccctgacttctcaatgcctcaagattgatgactagtctcagtggctgagccagtgagcaaacttcaggattattggctcccatccaaaattcatccagctaccattttatgtgttgttcgtgttctgctctgagacctttccaggaaaagcacccttctgagacatatttttggttgcatgaagatttgctcccatgggacgtgaagggccctttacagacatctgcttatttaggtttacagcctcactctgaagaaggtggggaggttttggcagcctctgaggggctgtgaggtttattagtttgcctgggccccttggtaaagcagagcataatttaggggtaggatcctatctaatgtctcatttagggctctgtctactccaaccttggtgcccaaatttgacctcgagagccaaggcaattctaggagaggtctagagatttgaattcatgttcacagattaaacttcatgcagtgggaaggaggtgggctggtgcttcatcctctgtcttccccacccctatcctcttctcctgttcagctcctgagcagtctgatatatattgtgaagagataaatgatttggttgcctttggtaatatggcatcttcttgtacaaaataaaactgttaataatcacacaccatttagagttcctttttttatgtcaaataaggacaaattgctacttagcatcccatcctttcctgtaatcttcatatcccaagaattgtctacacacacacacatagacacacaccataatgttgtatgtgtgtaccgtgttttcatcaatacataaatctgtgtataaaactctgccatgtgtaatttgttcaacttaattatcttgagttgtaaaattttctgaataattgagaatgtgcttccctaaaccactattttaattttgtttttatcattctggatgtcccttggccaggatctggttgggctgtcttctttgagagaagtacttgagcattagtgcattgaccctgttagccgacctggtcactcagagacccactgtgtctatcttctgattctttgatatcttctcaacataaacgaacaatgtaaacaaaattgaaaggtatcggaattttggtttcaacctctgcaatatagtgcaatttaaaaagaaaggatcttctcaacgctaatctttgtaacaagagttgtttctacttcatgtaccccagagtcccttgctgtgaggtggcagaggggcctatgcctgaattgtctgactcttgctcactgtgtggcaagtgacctctcttttctgggcttggcttattcctctgtgtgatgcatgtgtaggggtggagggtgctgggcaagagagcttgacatcatagcccctagattccctggtaaggtgtgacaaaaaaacacacaactatggtgaaacaaaacaaaacaaaacaagtgtctttctccaaagaacaaaacaaaaccccaaaccagaacactctttttagtttactcccaattttacttcaaaaccctgctgctaccacccaaactcaaagaatgttatagatgatattgctccttggttatttcttgtgtgcgtctggtgctatggcttgaatgtttgtattctgccaaaattcatgtgttgaaactcagtcaccagggtagtggtgttgagaggtgggagttgattaggacataaaggcaaaatgggattggtgcccttataaaagagactccagagagcttgtttgtccttcctgccatgtgaggacacacatagaaggtgccatttatgaggaatgggccctcaccagatatgaaacctcccagaaccttgatcttagacttctcagcctctaaaactgtgagcaatacatttctgttgttataaattacccagtctaagatattttattttagcagcccacatggactaaggtacatgggtttggcctttctctttgcaactcttcagcctctttctgtttctggtggtgtttcttatccccttctcctctgttcccaaatcacagacatatatatacaaacaatcatttggctgtaaaccccctttaatggattgtaaagaaatcttgacttgtgtacttttttctggtggacgacctgtgggcagaccatcattgtttcaactgaacctggcttggtaaggttaacacagtgggaaaggcgacaaagtataggaacgtggtataactgaaaggagcgctggttagggatctaggattttggatacccactctctgacagtatcagggtctgggattttggttgagccacttgacctcaccagcctgactgatttcatcttgaacctggaggctgtgacactcatgcatgctactccttgaaagactctgtggttctgaatcagtcagccatgagcactagtgtttccttttctgttcaagaattcaccattgccttcactccaggggcaaacaagagcctgcttcagttcttttggtggctaaacagcagaaacctgaccagtaggttttctttaagtccagctctgccgttgaggctggatggttttgcaggtcaccagcttcctgccatcctgggtgacagcccttccatggtttcccaccaatagaaacaaatttttatttttttccctgggagtagtgttcaagactttttcagcccattcctggcccacttctgtggatgaggctctggcaagttttctaactgacctctttggttagtctctgttttctgtgacccccaagagcagaagctttcatggacatcaaatcttatttttctgctcatcaagttgtcttttcatcttggtggaatagtttgtcacatttcctgattgtcatgtgggtgggctgccatcatgcaaaaagtagttcagtgtcactagtgttattgaggacatggagatgtccaacaaacagggtactctgcagaggcaaggagcccctgagcagcttatatctagcaagagacagatgcatacacatctaaacactcccaatagtgggaagcattgatgtgtagatgggatgtgagtaattcccaatccttacttcctatggtagcagtaatccagctgagtttcattattttctctctgtcaaataatttttgatattcctggggccacctccactcatactgcattagagtaagctgcaacttgcatctgcaaccagttacgatggaagggctggagcgcctttcagctgaagctaatcactcaacctcgagcttttttctatcagcaattttccctctctcacatacctgtattttctgtttctttctattgttccacattttaagataagaattgaagcaggttcatgttcctcccatcttagaaaagtttttctttagtgtgattccctccctctccttctgctcctgactaaagtacctctcccttcaaagccagatcttggaagagtgatctgtattcattatgtctattttcctatctcttataccagtcccattccactgtttttcaaactcacttcaccatagtccccagaagccttcatgggccatattgctctgtccttatcttacttgacttcttagcagaacttggcttcatttctcactccctccttcttgaaacatccttttcctttggccttggtgtcaccacacttttcttgttttccctctatctctctgcatgctacttgtttgctttatttgtcggttcccttttctctgctcttaaaaacagaccttaaaagtttatgtcccttgggattctgtcctatggctgcttcacttcctgggctatctctgggctacatcaccctcatccattacttatgttaccttctttgtgctaatgatgtcctaatctgtttccccatcaattatcagtgaagacctttggactcatgtgtgcaatacccctctcagatacaggagagtgtgtcacacttcttatttctaaacaaaatttttcattgttgccccaaacccattgccagtgttccctattgtaatgaatggcaccattatccactcagtaatacaagccacaaaccgtgactcttccttctctgtaacccctacactcattcacatattacgtcttgtcaatccattttcctaagtatttcctaaatctaatttttaatatttccactgacattattcaatcattctttcaacaaatattgattggggtcttctctatgttgggaactagctaggtacatgggatatggtgagaaaaactgccctggtctcttcttaccgggcttgcagtgtgtgggagtgggggatggggaacaaacatctaataagtacttaacataaaaacaatataattcatgccatcatcatcttttgcctaaaatgctgcaatcgcttcctatttcgcatccccgcctccagtcttgtcccctctctgcccatacgccacactgtagctggagcggtctatctgaaatgctgatcttatcctgtcactgcttataattaccctctggctcccagtgtctcttaaaataatgcctaaagttgtttatttttgtttcagtttttaaagaatagaacaaaattgtcactatattgctatataaagaggcatataactattacatggaccagaatgcacagatcagcataacagtctttttctacaccagcagctctataaaaaagaacaaattataactggaagcttgcttggtgatcttggaattagagcaagggcatttaattttgcatttaaaatgttaaatggcattaagctaagcttgcctgaggcatccatctccataatgggagagccttcacaaagggaatgtagaacttgaagtactttggcccagacttgtatcccctggatggacactccttttcctctccttcattcactgcccaacaccaatgctgattgatgtattctttctttggaaaggttagtgcctttaaccaatgcttctcatgtctgggagcctttcaaattccttaaagtgattttgcacatcttctctctgaaatgcattaactttattgtatggaatttagctggtaattatattttttaaagtaatatttgaaagtgatcagaaatgcaagcagcgcaaaggagtgtaccatgaatacactttgtaactcttgttacaaagagtgtaccttcactctgaagaagttggggaggttttggcagcctctgaggggctgtcaggtttattagtttgcctgggccctttggtaaagcagagcatagttagggataggatcctatctaatgtctctcttagggctctgtctactccaatcttgttgcccaaattcgacctcgagagcccaggcaattccctcccaccatgtactcccaccctctaaaatccctcagctcccctctccaataacaaccactgattttattttgtgtcggtcccctttcagaaatctttgtcttacatatatagcacatatataggtctttttagtttgtacacaaatgagggcatgctataccccctcttctacatcttggtcgtttttcacttgacgatgtatcttaaaaatgtttctggataaacatatgtaaccaaccttattttcttcccagctgcacagaaatccactggatgaatagactctatttaaccaacttcttactggacaactccagtgtacaagttcttgtgtgtaccttctacttgtgtcctcacatggcagaaggcacaaataagctctctctggcctctcttataaagggcattaatctcatcccaccctaatgatgtaatcacctccagaaggccccacctcctaacatcacatgcataattttatctataggaaatgttcctagaatttgaattgcaggaaaattgcaagatatttgtgatttgtgtgtgtgtgtgtgttttcttgttgcttattttactttaagttccgggatacatgtgcagaatgtacaggtttgttacataggtatacatgtgtcatggtggtttgctgcacctatcaacctgtcatctaggctttaagccccacatgcattgggtatttgtcctaatgatctccctccccttgccccccaacccctgacaggccctggtgtgtgatgttcccctcctgtgtccatgtgttctcactgtttaactctcacttatgagtgagaacatacagtgtttggttttctgttcctgtgttagtttgctgagaatgatggcttccagcttcatccatgtccctataaaagacatgatctcattcttttttgtggctgcatagtatttcatggcatatatgtgccacattttctttatccagtctatcattgatgggcattttggttggttccaagtctttgctattgtaaatagtgccgcaataaatatatgtgtgcatgtgtctttatagtagaatgattaataatctttgggtatataccctttaatgggattgctgggtcaaatggtatttctgagactagatccttgaggaatcaccatgctctcttccacaatggttgaactaatttacactcgcacccacagtgtaaaagcgttcctatttctccacagccttgccagcatctattgcttcctgactttttaagaatcgccattctgactggcatgatagtatctcattgtggttttgatttgcatttctctaatgcaatgatgagtgaggatgatgatgagctttggttcatctgtttgttggccacataaacgtcttgttttgagaaatatctattcatatcctttgcccactttttttatgggtttttttttcttgtaaatttgtttaagttccttgtagattctggatattagacctttgtcagatgtgtagattgcaaaaattttctcccattctgtaggttgcctgttcactctgatgatagtttcttttgctgtgtagaagctctttagtttaagtagatcccatttgtcaagtttggctttcgttgcaattgcttttgatgtcttagtcatggattctttgcccatgcatatacctgaatggcattgcctaggttttcttctagggtttttatggttttgggttttacatttaggcctttaatccatctagagttaatttttctataagatgtaaggaaggagtccagtttcaattttctgcatatggctagccagttttcccagtaccatttattaaacagggaatcctttccccattgcttgtttttgtcaggtttgtgaaagatcagatggttgtagatgtgtgatgttatttctgaggctcagtaatatttgtgatttttaagtaaatattgccaagttgttttgcaaagaggtcacatcattttgttctcccacagaaactgggagtgtctgctttcctacaattaaggcagtactatttgtcgttgaacttttgttatcaaaccttttgtcctttgtcaaccagtttcctgagaaatagtacctcaattgctgtattttgcgattatgtaattatgattcagattgaaagtcttttcgtatgtttgtaagtcattggtattttttttccgtgaacttagcccttttcttttttaattgaattgatggccttttcaaaaaataataaaatttgtacttcacctaatgttttgcttgtcttctaatgtcagttaaggattatgatatttcttttcttctcctccttctcttcctcctattttgtgaagcagaattaagtttttttctagtaaagcttattttttttttctatgttgtaggtgtggctaagaagattattcccttttctaagagtataaaatgagcaattttatattttcttctactacttttactattatatgtttttacttttaaagcttttgtctatctaaattttaaaaatatatggaatgatgtaacaattgttttattattttttttttcagtatagccaatcagtttctggatcttattagttatgtaatgctatctttccctcgctaatttaaaatagcaatttggttctgtggcaggactacctttgtgtttgggcctgtttagggatctagcctattccattaatcagtctgtctatttacatgccagcattaaattttatctcccacagcttcttctttttttttttttctacttgaagtattagtgtcttactcatcagtcttctttcagaattttcaggatgattctagcgtgatgattattccacatgaattttaggaactgcttgcctagctcccctgcttgatagtggtgtttttaacaaagatggcattacacttatatagcaaaggctgacaacttcttatcaagtcttgaaagccccgtgtcctcaaattcaaagccatttctcagcctcatttcatgcctctacctttgtttgatgccatgatacagccactctgagttttcaatttatctactgagctatattctcacttatcttccaggttgtcctctctgccttctaccctggctaactcctgcttatcttttaggccttggctgtgatgttgcttcctctgcctctacacctggtctatgtcccctccactacatgctcttatagccccctgtgtttcacatcgcagcgtaggtcacttagtatcatcagtgtgtgcctgtgcacctgtctgtacacaccgttaggacataaactgcatgaaggcagggacatatggatcttgtttactgctctttcctagcatctagcacaatatcctagttctctgtgttacacaaatacacacggatatgcactcatgagcaccttctccccacccccatatatatacacataaatctatcatctagaactctaaataagagtattagttggtctctgggtcatcaatatgtaaatctctagacataatttttctcaagctatcaagttaagatgtttgtttatataaatgacctttatggaattaaagtgcacagtgttagttcatgcacagcaagagattgattaattgtggaaaggaaaaaaggcaaagccttgatgaggcaggctgattacatatccaacaggaaggagggacagcaaagagaggggaggatgagggcgttctgcagatgaagagagatgcagagcacacaagctcagcaacagaggaaaatccaggggaaaagaatcactccagggtcacctgatctccaacaaacaaataggtctaatgagaaagatttgtgccttttctgttaggtaatagctaataatggatatccttgtggatcaattgcagttttccctgcgactgcatttatggggcttcacttaaaaggcaattctggtgtgagatttcggatgtgatttatccttcttggagtacggatgatagaggctgttcatttttctcaaagaattgcaaacatcaggagtataaaaagataatgtgtcaggtctagtttaatgtaccatctgatacatatacttttgcacttttgcagtaaaaatgcattgggctgatcctatgaatgtttcatggggcttcctttatatttataaaaattaacgctattagacatttgagaagttttgataggtgcttgcaaaactcatcaaaaaacccaactgatagacatatgagattagaaggctttttaaaatagagtgaagtctataggttaataaattgtgttgaataatcaaaaagataattctttcttaagataaataatataaatcatatctattgatgttttatttatttatgcttatataatcagtatattcataatacgtatacaaatgaaagtggtttagactccatgtgtatttgaaaattaaattttaaaaaatgaatgggaattatgtatttgacgggtttttttcctttttttgtggagacagggtttcgccctgttgctcaggccggtcttgaactcctgggctcaagtgattcacctgcctttggcctcccaaaatgctgggattacaggtgtaagtcactgtgcctggttttggaatgggaattatggaaccaacataaaatgtttaactctgatgagaaaagtcttatttttggaattgagtcattggctctcacgataagcctaggtgaccctctaggatttaacttcttggctgtctcatttgtctcatttgcacaaatctttctcattagacctatttttgtttgttggagatcaggtaaccctggagtgattattttcccctggattttcctctattgcggaggaattgctttcccaccaataaaaagtgtcttctggagcttaaattcctggtgtcttgagggtactatagagcctcttacttacccagtctacactagaatccatgtggtcattaccatcctttgattgcattttgtatctatacacatacagttcagaaggcaatagatactctgttggcaaagtcatcttttcccatgggtagctcaaattgaggacaggaactaacttttatatatgcttatattgattgattgattgactgactcatgcgttcattcatttggttactcaatcagcaaatcagttttgaacatgtctttgtacctggtactttcctgggtcttgggtgacaagacttaggccagctcctaccatttataccttttatatggtctgtttcaagggcacaaacagagcccccagtcagatggccctacctttctctctccccaaaactacaagggacctcataggcaggtgcatggacagttcggcctacacacccaaactctatcaacaccaccatagacatcaaccttggacctccccctttcccttacactgctgtacctggtgtgtgcatatccatggcttggtgcaccctcaggaagatggatccaaggaaaaggcctgctcaggccgtaggagtggactcagggtctttgagtagggaattctgggatcctggggaagggtgaaatccaggaaggagcatcctattggctctgtggactccttgcctcatgtggaagcacttgctgaaggagaacagagtgatggactccaaaggacctgggcccaatgctcagggctaaaggtgccatggaccaggctgatcggccctttgcattgtggacctggcctctgcctcattgtgcttttgtgctatgacgatgatgctctggatcagggcaagtgcagggcatatgtcctgggagtgtgtaggggggtggccaggctcttcagatggttcctacacttcagtgccccaccctctcttcaggggctccatgttcccaacaaggacagagtatactggattcctccccatcaagttttgtgatattatcatagacacaagcagatcacaagcaaagcatagatctgtccccagcagtcaatgagaattgttaaacgtcattagctaccagcttcctcctttctctcttccccatatggattttattattgcccctgaaagttctgggtctaaatgtaatgtttcaagaatcagctaattgtggctaaatactattattttttactgggacccctggaggatcctgagattgtaaaaactgtgcctgaaaagttcctttcctcacgatgtcttttttcctgaattgaaaaattactgaatatgtcagtagacatgcataatggattgatagattaattttccattttctttgggagtttgtgtaggggagtgattcctgttgtaacattggtgggttaagggctccactaggatgtgtggtctgccactgctactttggactagtaactaaagctttcatgtctcagtttccccatctggaaaagtgggcaataatagaaaaatagaaaagcattactgtgaggttaaagtgagctgatgcatgtagaatgcttatagcagtgcctgacacacagttcgcactctgctgttagcttatatgtgtgcgcatgtgtggagctatcttcaaatatgattcagaggaaactactctgtgaggttgggaggactgaaaagcaaaagactctgccttgagcatgacactgaacagcctgaggctaagaggacagatgtaaatggcgctggttcccttatggcaacctttgcatgccctttggcttgtctgtgcattactctcatcgtgtaggacctggtgtgcttagctgattgggacattaaccattcgtgtgctgagcgatcacaagtgagatttcatgactgttattcaggtcattgtctttgttctgtgactttggtttctttgatggtcctggtctattttattggtcaggttgtttattaacagtcctcctggactctgggattgtcagtcattttctcttttatttttctccattttctcttttaactgtcctttttattctttagttgtaaggcctttaaaacatagacatcttatcctttttttaaaaaaaagaattgtagtgaaacacacatgacataaagtttgccattttaaccatttttaagttcatatttcagtgatgctaagtacatccacgtgttgtgtaaccatcaccaccatccatttccagaactctttacacctggaataattgaaactctgtacccttcaaaccatgaccccccataaccttacctccctctagtgcctggcaaccaccattctactttctgtctctatgaatttgactgttctaggtacctcaaaaatgtacatctttttgaacagtaatatatcccttgaattaaaagctttttttttaaataagatatttgtttaggacttttacagctattcatgctttccttttgcaaaataacttacttattgtggccttacacaaccactatgattggaatttctttccactagcatctttgaagtttaactccaaagaaagtaatctctagccatctataaaaatgactgaaggttaacatgagaagtgaaatgctgaagataaaatgggaagtgtccctgaatttcactccctttccttactcccatagcctataaaagttggctgaaaaattgtgccaatatcaaaacagaccttcatagagatcctaaaattttaccactggaatcattctcctctcttgacattatgctcatttttctctttgccatgcttgacctatcctgaagctggagaagaagtattagttccaaaaattttcttcttgtgaaatgatttgtcctgactggaggccaagagctttcaaaactgtgttctgctgtgattcgtgatgacttgaatgctttttagaattcttacagtccaggcgaatcattggagattcttcttcaagagtcataaatgggaaatgtattggcttgaaagaacagggaaagaggaaaagacattttaaaaaatgataatttattacaaaaaaaaacattagctgggcatggtggccggtggtggcaggcgcctgtggtcccagctacttgggaggccgaggcaggagaatggtgtgaacctgggaggtggagcttgcagtgagccaagatcacgccactgcactccagcctgggcgacagagtgagactccatctcaaaaaaaaaaataaaaaaaatgataatttatatgttagattgaagtttcaagattttactttttaatgagcattcattctgaaattttaataaatcatagatgaaactacttactaacccatttcttgaaaacaactagtatagagtaattctatagtgtcagcatattgtacataaagaccatttaatttttatggaatgaatgttaaaaatgtcacaatcagtttttcatcagtatttgaataactatttgaattataattattttatacaataaaattaataaggtaaaaatgagagggatgaaagaattaaagacaagaactccaactaaccctaatggttggcatagttgctgtaactgagtgcaacatttgtccccaacttcctggcagtgaaaagagaaactcattattaggaaggagaatgcctactaattccacaggaacacagatttgtctggcagtgtattccaaaaggaatttcttttgcaggaacaataagtgatgtaacgcacagtttttatgaaaaatccagaagtagctttcattttcttcttcctgagaaagccagtgaaagttggaggaagtgacaaggacatcaattctgcaaggaggctaaagttgtccaagaatttaatctcctatcccagggctgtaattataacagatacaactcaggatgttagactcccattcctacatgccctttgctgaaccaggctttgatggaaactggactgcacatgatttgaagttgtctcctttgacaagagcctggaaaattttagtctctgttgctggttaaggccagatctgttctctttgaaaaccaaacaagcagatggtgggggctgacatccttttataaagaccaagcagcctggtctgtgtgcttgttcaggtggaagctaccctatctgagtatgaagatgagctgcagaggtaccagcagagatgcaggcttcctgggggaagcagccctgtgactgccccagaacttagacaaatgcttgattgaaatcccagagttccaccccacagagcagcagagaaggttttggcctaggagctgttaggagcaggtgtgaccagacggcctccccagccataggaaaagctcccttaggctcccgtggtgcctccaaccctgagagagatggtcctcttgtgagcctgccaggatgaattagctgcagagggcaccccaagtcgctgaatgagctgacttgtgtttctgatggtttcatattgaccgatgttagagtacatctgctccaaataaaaactgtggcttaaacgtcaacttttaagccatttctattttttggagagtagttcagtgtcatttttgtcctggtactcttcatggtttaatatggtaaattggtgccatggtacctgttcagttattgtcttcccatcggctgtcgtggattactgtgacctatgaaagatctgagacctaatgtaaaatatacaattatattaattaaatacgttggaagaaaaaaaattgtcagaaaaaaacccatcccttgcttctcctgggaattgtatttaccattataccaactatcaaattaccttggctatgtctgtgcaagtattagttcatttttaacaacagaagaagtttgcaaagtttccagaacaggtaaaagtaacttaaagacattgtcaatttttaattgtagtttctgtgtcattttacacacagtttcttttcttttcttttttttctttttttcttttttttttttttttttttgagacagagtctcactttgcctcccaggctggaatccaatggcgcgattttggctcactgtaacctctgcctcccaggttcaaggattctcctgcctcagcctcctgaaagcagggattacaggcatgtgctacccacctggctaattttgtatttttagtagagacggggtttctccatgttgctcaggctggtctcgaactcctgacctcgggtgatctgcccaccttggccccccaaagtgctgggattacaggcatgagccaccgcgcccagggtttacatacagtttctgtgtgctagtctcctggtagcatttatttgatgaggttcattttagagattgctatgcatgggagctctacacatctcctattcatgtaggagattagttggagcattaaagtctcttatgagcaagaattaaatcaggtgtcataaaatctttccatgggccagtgaaagatcggaagttgctcaagatggaaccaattggaaatgtgctccgaacaacccaggggcagcacagctcgtggttgccaggaggagatgctggttcagtttcatggaccttctgttttcttaagacaacatggaaattcaaaactttttaaatgtgaaaattttcaatctcaaatgttagtgactaattaaaattttctaaaaaataaagcacccttgttggtcagatcccgaccacgtgcttttgactgtgacctctggctgatcatcagttgctaagatttacccatcatgctacttgtagactgagatccagtcttaaacttgcattcagggctctggcaataagttaaattaaagttatcctttcattatagagacctatatgttttatgagaaagaaaatgttaagtttttttttctcatcataaattttggtggtccctgttggaaatcaccatattggtgggaacagataagaaaagtgctatataaacactcagagagaaatacagagtgtaatttttttctttataatattttgaagattttttctcataatttatgtattgaagagatgtgagatattatcaattcaaatttcctcttgcactagaggctgggtgacattaagctcaccagctagttagtaaccaagccaggccttgaaactggtctgttcattttaaataataattagcattaattgaaattctcatgtgcagtctggttttctaattttcccaacaaccctaggaggcagttactgtcgttactgcattttgcagacaaggaaactgaggcgtagggacttgtctcaggtcatatagccagtaagaggtgaagctagtgcagtatgtttagtcctcatcctacactaccaattattttccaggcactcaaatttgtaaatgcccggagtatttgggctgttctaataagctgcagttttcagaggcattgtgtaagaatctgaagatttcttatttatctcctattgttgctctatgtaaatataatacaggacatcatcctaaaaagtatccctgttcttttccattgactgctgtgtttgggctgtgattatttgtaaaggtccattgtgcaaaaactctagaaattatttatcgtgaaggtgctggatttacaagtccccagtcctagagcgtggtacagtggctatgggctcagacttcagaggcaggtacatctgggttcaaatcctgttttggcagctatgtgacttaggggaagtgatctggcatggcgaggccccagttttgtcttctgaaaaatgggaacaatcatagaactctcctggtagcattattttgttaggagacagtccctgggtagccttctggctaacaccagttagcactccataaagagggagttactggtgctacttcaaagctcatggccaaaaagaaactgaaagctgaaaatgccactgctcaacagcatgcagtagtaagctcttcaaatttagattttgggcttgctcatttagcgttctttccattcacgtcctcacagttggggtgcataccccctcaagaatagagccacagactgagagtctgatcttccgtatcacctgcacctgctcagggactgactttcaaaactctttctcagcatttttgctgagaaactgaaactggctagctgtgaacccagggaccaagggaattttttttttagaaaaggattattctactccctatgaaagaaaccttagagcagagagaatcctgtcatagttgaaatgccgtggctgtaagcctgggaatttgaggtctatctacttttatcaaatctaatctatcaatcaatcatctatctatcatctgtctatctagagatgatagatagattgatagatatcatctggagatgatagattgattgatagattagatttgataaaaatctatctattggccgggcgcggtggctcacgtctgtaatgccagcacttcaggagaccaaggcgggtggatcacgaggtcaggagatggagaccatcctggggagcttgcagtgagccgagatcgcgccactgcactccagcctgggtgacagagtgagactccgtctcaaaaaaaaaaaaaaaaaaaacacacaacaaaaaacttctatctatctatgtatctatctattttattgatctatctataaggagggaggatggggtagcaggaaacgattccactttgaagagtcaccatttgaaatattcacagctgcttccatttcattttgatgtgttgccaaagtacagttcaggtaataaagtctaggctaaaggggaatttttcttttgagtaataccactattaagctaatatgcttaaagacaagatgcattagatactactccttgttgcttgaagagattacctagaggaattatttgataggttgttaaagcaaatgtgaaaccttttaaaatgtaatgaggaccctttccaggaacctgtaagtcaaaaatatttctgtgaattttctctaaaattacctcttttctcttattttccaaaaagccagctataagctttttgttaagccaaagaagaggaaattctttaccctcagaaaaatgtcttagtaaaggtcctgaatgtcaaattgagactggagaagatttggtgacaacacaaaacaagatgacaaatagcatgtactgtgtttatgttctaattctttatccactttccgatcactcttcaaagcttgagctcaatgccctttctccttttaagccttcactgacctgcccaattatttaaatatatataaacaaatatatatttccaataatttttgtagttccttccactgtgccctcacagggcaagtgcatgtacttcttcttaaaaccttttctttttggctcatcatatcctgtggcagtgtccactgtctctccttagagcatcatctccttcaagataaagaattgctggatttgaagaatcatggaggccatttctagtcttacattcctcacatgttggggttctgtggcaaatgaatgcttatctgctgagggcaattattattattattttagacaagatcttgctctgtcacccaggctggagtgcagttggcgctatcatggctcactgtagccttaacttcttggactcaagtgatcctcccacctcagtctcccaagcagctgggaccacaggcacctgccaccatgcccagctaatttttaaattttgtgtagacagggtattactatgttgcccaagctggtctcgaactcctggactcaagcctcctgccttggcctcccaaagtactaggattacaggtgtgagccactgtggctagctggtttttatcacttaaataaataagtaaataagtagtgggtttgaatatgttgtgttcttgtaatctaaattagcttttagattggacaaatttggggttccaaatcagctttccacccccttctgttattgtctttcctttgtttgcttgttttctgcatgagaagtgaagctgtgtcctatgacggtgataaactccaggtggaggatcagtttgggtgccctaagtgagcagacattccttgagcatcagctctgtgctaggaaacggagatcagtgagatgagatgaggagctagcaattcagttatggggtcaggtagactcatagaaaaataaaattgagggtacaaagagtacctcccattgctctaattcttaattgcaaacttacaagtgcaataaatgctaaaactgcatgccaaccgatggaataaaaatgttctgattggaaaaagcatttttggtgttgtgtctacaaatcactcaagcagtcgtggagggtcctgggatagatttagatgagtacattgataagactctatcatataagatccaatctttagggcaatagttaatgaccttgggatgtagtaaatgtgcaaaaaataacagcaaaaactgccctcataatatgaggtcctagcaagagtcctgtatatggacttggtaagggaggaaggcacattctgggcagaacaggatggttgaaggccaccaatgattcctggcagattattaataaaggttgagggccagggaccctgagggactgacgaggtgagagaaattcctaaggagtaccaaatgaaacaaaaaatccgaattcaccatgcctcttggtcactatttaagggccgctgacttgcctaagagagcatgcaagcaacgtctgcaggctggggggtggagggaagctcaattttctgagaagatgaaaactccgtggacctcgtgagattcctgtgaggcaagtgcggggacatgggctctgggggcggaggggctgtgcttggaagcccctgggcctaagctttctagagcagtgggcctaggttagaggagtttgaggttgtcatggagagaaatctcctggttggggtgtgtgccacaattctgggccttcccactgctcccttgagggaatggcaccctttttggagatgtgttttattaagcagagcttgactcggtgaagagcccacagtgtcactgcactttaacaggggcagtggggagtggttttctgggaaagagcctgctgcccgcctgtcagtggccctgacctggcacttcctctctccttcctaaccctgtgcctttgggatcagttgccctgaggcagagagcaggagaggccagggctgtggagatcctcctggaggcaggtggaagtcaccaggagggggcagcgcagcacacaccttggtcttctgtttccatgcggaggctgtggagcagggaaagaaagctgttagctgtttgctgtttgggtggtccagggaaccaagaacttgagctcgggtgtgtttgtccactgagtcactgagaaaccctggggtctggctttcctgcagttatttcctttgtatggttgttgcagtctctgtctctctttctttccctctctccctcccaccctttcttgcttgctgtctctttcttttcttttttcttcataaattttaaaaattcaaaaaagtataatgacataataactttatataattacattcagaaataatagttgaatatttttaagctattttttcttttaataaaataatttagcagtttaataacataaatggtataaatagtttctgtgtatgtgtgtgtgtgtgtgtaaccccagacccattctcctttcccaaggccaccttccttggaatcatctttctatacttggcatatctacttgactgtgaacactatgtgatattattttttgtgtatttttaaaagttcacacagattgttttatgttacatgtacgtatcagtatacaattttgcttatcttctttctcacttcgcatagcagtgtctttctgttcaaatatgtagatctgatttaatctaatatatatatatatatatcaccttattttaaacaatgtctatttctttatggatggacactcgggttgttccagcttttgactctatgacaatgaatgttgtaatattctactgatcatattacaatgactcttcttgagtccatatgtgagaacttctcttggatgaatacctggaatagaattgctgggccctgaagggttctgatttataattttccaagatacaggccaagtgcttttcaaagtagttataacaatttacacttcctccaacaatttcagagaaatttcatcacatccatagaaatgttttacattgttagactttaaacattttgtcaatctagtgggagaggaataatatgtcattgttattttaatttacatttcacatttcttgggagataagcaacttttcatgtttcttggccaccgaagttttccctctgtgaattccctgttattcaccttactggcttcttttctaaccctatgatttgattcttcacttagtggtagctaaggagagtttcttagggggtagatttcctgagcagtttgtagctagcatctatattgtggacatgactacacgtagtagcttatgagggggaattcttaggatctactactagaggagcccttgctgaaaatttttttttttttttgagacggagtcttgcactgttgcccaggctggagtgcagtggtgtgatctcggctcatgtcaagctccacctcccgggttcacaccattctcctgcctcagcctcctgagtagctgggactacaggtacccgccaccacgcctggctaattttttgtatttttagttgagacggggtttcaccatgttagccaggatggtctcaatctcctgacctcgtgatccgcccgacttggcctcccaaagtgctaggattacaggcgtgaggcactgctcctggcccttgctaaacttgtaatccagctcttctgttggcctttccatcttgacaagaagaaaaatgtatttatttatccagggcattcttgcccccacagtagaagcgtattctctagtgaccatttttcataacttcttttgatggtgcttttgaatggttttcagcaaaatttcctgtctggtcttagatttcagaatagtggtgctttgcttaattggctcattttcatctcatgaatactgtgaatttaccattgaccaaatttatcctcatctccttctttcttggacactggtgactagaaagcatagaattaagcttatgtgtgtgtttttttttttttctaacgagtgtatgcatttctaaattgaattccgggctccgttgatatctctttatttttaatttatttttatttttaaattgttttttttcttttttttcccacatagttttgtgcaatccattgacatctctacccctgtctttctctcctctatgccttccatttttatttgctggttcgttgtattctattgaataaaaccggggagtttataaattaaatgtctgatgaaaaatgaaaagaaagggcataagtaacaaaaagttaaagatgagtgccttgtgcagatcataataaagtccccattgagttccaggcccttgttgtgagcatggaggatgcaaggataatccaggaaaagagtgaggaagaactctcaatgacttcaggacagtgacaggcctcatgcttacacagctggtaggaggggacaggcttgcctggaagtctggattgtgactccagaggaaaactcgcccacattatctatcctttttgctgtcagttgcatgagaaaaagtattaaaattcagggctctttagaatgcagttcttactgtgagatcatttagaagagtgaggtcactgtggtctctattgaaaatgttggtgaaaaatcttgcaaaaatgtatctaaagtatgataactctgaaacagttgatgttaaaaattgagcattcctttcaagtcttaaaatgtttctttcttctatgtgtggtgggaggagagaagggaacgaaagcttcctgcacatttattaagtgtgccaggccctgggtatcagggacaaccaagaattttttcagaagaagccgccgttctatcttggaggctggttttttatgtaacaggggacaatgtttgtgtggatgcttttaaaagtatttctctttggtgtaattttgtcttctcagagaatctactgatttttatttttaaaatttattttctaaaaagaggtgcccaaacccttactatacagcttgtcatcattttctttcacacagtgggggacctatagatgctgtgtgttcctccccatcatttaatatttttttcattttaactcacattgttaacagcagggctgcatatttgttttcagtgtcttaattggaatatgttatatatcttaaattttttcaaaaagaaaggggagatttcctcctggcataatttcttgtaatgcctttgtaactccaagtgcagttcatcttttctccatctgtccatccatccgtccatccatccatccatccatcctttgagtacctaccttgtactgggtactgagccaggtgctgtgatgcatattaagaattataaaacagatctagctatctcaaagacattgtgatctaagaaaactgaatagacaggtacttaaataactgtagtacagggtagagtataggaaattccatgatgatggttttaatagttatttgtttggatcactagggactttactgattgcaaatgatagaacttaagattaacttaggttagtgacatctagcctgagagacagttgtatctaaaggctcaagtggtatttttagagttctgtctctttagctctgcttctttctgtggactgacttcattcttggacagtctatttccttgtagcagaaaatttccccatggaagccccaggcctgtgccatccttcagctatgatcccagagtaagacagagactctctcttccccagcattcatttatttaatctcggggaagactcctcttagtgtaattgagatcatgtgcacatctctaagcccaccaatgtgggcaaagggatggagttttctctctattcacccctatattggagggcttagggggtgggggagggaggaggttcccacggagaatgcgctaaggccatatggggtttgtgaaatgtggttcatcaaaggaaagattgatactgttactgacaaaggcagaaggaggagatgctgggccaggaaaatagagagaaaagaggaaggggtagggaaaacgcaccttagtattttaggaggtaaaggagggagtggctgtctctcttgaaatgtggggaaatatgtgacttttcttgtgcagtgatgacagcagcatctctgtggctctcaccgtaagagtggaaacacctttgagaggagtagatgcatttccacggtgttttcacatatgtacactggtgatactccaaaagggaaagaaaagtgaaattgttgggtgaaagagtgatgaaacacgaggagaaatgaaacccagtgcaagggttattgaccatgaaacctggtcagtcatggtttctgctcagtcatgctcagttttgctctactgctgtatttaaaaaaatggcaaggctcagagtggtgtggagggagcaccttggacacctgggtgaggtggatgggagttcttcatggtgctgctgcctacattctgagtcactgcgattcactctctgctttgttacagtttcatcgcaaaccagaaaaggttagaaatcatcaacgaagatgatgttgaagcttatgtgggactgagaaatctgtgagtactcaggaccagggcacattatctcagagaattttcctgttgtctgctctggtcaggcaggcattcactggttcgttctaatgtgcatgaaattatgtgttttcacaggacaattgtggattctggattaaaatttgtggctcataaagcatttctgaaaaacagcaacctgcagcacatgtaagtagagattgattcttttgcttcccaggacccattttattcaatatttcccccctctgtttattttccttcttttccaacttgaaacctccctttttaaagttagtatagctgtgataatagcttagaaacattagctctgattttgtttgattttttgaatagcttcagaggggtacttagaacaggctgtttattccctttcatgaatttctgggccagttccatcttggacagagcaataggctagcagcaaggagtctgatgtgaaaactgtgtccttgcacagagttcttgattttcttccttggaataatgacatactccctggaagacatcaaactagtggaatcgaaagaagctgacttggccttggcctttatagggaaataaaaattactggtgcttttcccctcacaataggattctcttttgaaccttcattttcccaaagccgtctgtcatggtttgataaaggtagagaaaaatcaatcatgggacatgccaaaggtacagaaaattattaacaatgggaaatatttccccaaagtcttgttgatgctttgtccactgaagtcaaacggaaatatggaaaatgggaactgttagcttgtttgttgctaaatcctctagatgatggcatttaagtccataaggtgtggctttcctgagagttgtcttcattaaactaaagatcacctaagtgcagaatatttatgcatcactgagctcagacttgtactcccatcccctgagtttttagtggaacttctgccagaaggttgttgcctgcatttattgattctgttttgctgtaccaaattctctttgcagtgataccttacatgtcatagtctatctgtgggaccctcacctggattatttcacatgatttttttctgacaattggtaggacagatcttttttatgcacatttcatagataaaataagagtgagagagttctaggacttgctcagattcatagatcgtaagtagcagagttatgactccagggccaacccctctccatgttcttacaataagagcacaggaaataaaatctgtatcatccttagagaatcagactttcttataaggttcgtcctctttctttttttttgaggagaacagttccccaactgatttccatgccagttataaaagaaaccattctcttagaagcagattgcctggacactctattgaaatttgttgatattatggaaaatattaatttcataaagccaatatcatagcttcatattttataggtggcattaatgatgaagtcactttaaaaataaagtctgtaaattaagacataaaacattctacaaaaatgtgataaaactccagggaactttattaacacatttcaattaaatgctttttggaatcatttttgcagtctgcacaaatctttgcctgcacaaatctgatggctgcataggccttgatagcataaacaagagagaagttggatagaagaaaaaggcaaaatgctctaatgcagtcacttagatgtaattaatgacctcagtggttaagttctggtattttcattacagttgaccttagacccaaattactcaacaactgcattttactggctcttttatcacatcacttctcctaatgttgtgatttggacagtgggctctggctaattatagttttattaatagacttactgattactttactttgtatattttcattattgcatgctatttctatgaatatgaaagccactttgtatattttttcatgttgatatatgacggtgattttggtggtattctttttttttttttttttttttgagatggagtctcgctctgtcacccaggctggagtgcagtggctcgatctcggctcactgcaagctccgcctcctgggttcatgccattctcctgcctcagcctctccagtagctgggactacaggcacctgccaccacgccaggctaattttttttttttagtagagattgggtttcaccgcattagccaggatggtctcgatctcctgaccttgtgatctgcccacctcggcctcccaaagtgctggtattacaggcttgagccactacgcctggccggtggtattctttgtgcagtacacagcttatataaagtcaaatatctctccctagctttcagagaagaattattttaaaatgggaagctaaagggacatacatatcttacagttttctgaagaagcaattgttgggatgtcaatcattgatcaaattgcaaaaatgctactaatatttatagccatttattgaatagtaagacagagagaaataggcaagtgccaggcagttatgaagaggtcatcagatggcagtaagcttcatatagtcacaggacaaaagaggctcttaatcaccaaaatctgaaattaaattaagtagtttgcttttgagaacagtagggaggaaggaaggaattaagtcaggtgtctgcctttccggatcttagacctaacctctgcttgtgatggaggactctggggaacagcttggttggtggtcccctgattttccacatgcaaattgcactcttccctcaaatatcaacgcagtggggtgcaagggagctgataacaaaatatgtattaaaagctgtttctctctacccctgggatatactgatgatctctctgagtttccccagcaatataaaaatgcatacaagatcagtctatttcacttcgggttttagggaaatttaaatgggatcctctctctcactttcaccacttctccccctaccctgtccatgtgagcatcacatggggactgcccagagccccagagactggtcactgcgttatttcttgatgcctttaattcctgcccagccccttagagcccagggactgtgagaaaagctggtatttgtgttttccagggactttgcagaggtgctaattagctcccttgcaaagctctataatcaaacagtaagaggattgttgatttttttccctcccctcttcctccattttggcttttggccccaataataagtatggctcataaaactcatcttgttctttggccggtaaccccgctctttgcggtgctgctggcagccccacagaggcagcagctctgcggggcggcggttttaccagcagacagggagacccttcaccctaagcctcctctttctttgctgcctctctctgcctttttcttgaggaggaaagcaggtttttggtttttcgtttgtttgttttagaaagattgggacttctgatgaagatgaaagcattgtgccttagaaactgtggaagataggcagactgacttttcaatgcattgtataccagtgaaacccattctttttttttttttttttttttttaaagaaggagtcttgctgttgtcgcccaggctggagtgcaatggcgccatcttggctcactgcaacctctgcctcccgggttccagcaattctcctgcctcagcctcccaagtagctgagattacaggcaggcgccaccacaccaggtgaatttttgtgtttttagtagagacggggtttcaccatgttggccaggctggtctcaaactcccaacctcgggtgatccaacagccttagcttcccaaagtgctgggattacaggtgtgagccactgcacccggccaaaacccattcttaattcacgttccaaaagaagagacctatgtgggcacattttacaacttcctggtggattatttttcatgtgggtgagcactttatactcagtgtgaagagagaagatgcacgcctaggaggaaggacggtaccctgtgtaggtaggggtttggatgagtggagatcttaatatagaattaagctgggagtggacacacacattcatgatttgtgagacaccagagtggtaggttctttcttatcaactgactagccttagttcatgctttagctcctggttgtaatgccaggactgtgtgactgatcaaacacactaggatacttcagtgatgacttccttgggctgacggcaaagagtagcctcaggtgaggggccaggatcactgtcaccctcagatctcatgtgtgttattttttgtttttgttttttttttttttttttttgagacggagtcttgctctgtcacccaggctggagtgcagtggcacaatctctgctcactgcaagctctgcctcccgggttcatgccattctcctgcctcagcctccccagtagttgggactacaggtgcccgccaccgcctggctaatttttagtattttttttagtggagacggggtttcactgtgttagccaggatggtctcgatctcctgacctcatgatccacccacctcggcctcccaaagtgctgggattacaggcgtgagccaccgcacctggccagatctcatgttttatccaactctcaacccaacacttgccttcctcggcaggaaacacacactgaaagtctcattgacttcctccggtttgtagaggtcttggctgtttttatgaaagttgatgtttattttacattcattttatttattaaacacatcttgaggcccaagcatcggatactctttaaataaatttaaacagtaaacaaattcgcagagtgagtcggctgccagggttatggctctgagtttcctaccccaaaatctcatgacactgatcattggaaactcttttatagaatcaaattacatgtttggaacatgtcagtaaattattattttttttagtcacaaatatatctttttattgtctggttggtctaaatctgaagatggtatgtcactagaatggttcaagatgaaatctgacatattccttgttacctaatttttgtttgttctcatcgtggaggtatgcggttatttagatcatatgtaaacaatctcagtagagttttttttatcaataaaatgtctttcctataaagacgtattgaattcagttaatattcagagttttgtatgccacataatttcaaaatatccatgatgctctttagttttaaggcatattttttccctactgggtttatagttttaaattttatttaatcttacatatcctcctattaattgttcaaaagatcagggtttctataagatatataacttggctccaaatcaacatatgaaaagtaagcttttgggtgaaaaagacattaaaaatacacaatatatttatgctacccctcccagcaaagaaaaaattatagacaaggttagaggaaaaactcagctatcactctaagtgaaagagagagagatctggatgtaagtaaagcttatataatgatcaaataaaattatattttgaaaaacaaatctctatttgaatactgtgttcctaaaatgtaacattttaaattcatgtttaatgtttttgattcctttcagcaattttacccgaaacaaactgacgagtttgtctaggaaacatttccgtcaccttgacttgtctgaactgtaagtaatgattttgtgtggcatttggggaaatgttttcaaaggaaggggtaattaagtatttttcttttaatgagtgatgttgcagatctatttttataccaaattctcaaaaaatgatttctcaagtttcagtctctcagtcttttattccttcaaggtttattatctctcatttttaaaattcagtaattaaaaaaaatagaaatctcagtagtgacatatcatttctgattcatttaaatgttgattttacataaataatttctggtacagggaaaaaagagaaaaagaagggggctttgtgtgaaaacggctgtatgctttatatctcacagctctggtttggttcctgttggatccaggccctaaagtcaagcaaacccattcaaggaggaaataaaaatgggcaaaactctgctcacttttgtccatcttaaggataggggacattggaggagaggtagttgttctctctccccacccatctttgtgagattttcttccagatctgttattgcattcaatatttatttttaagtcccattttcttctgttgtaaaatgatagaaaacgtattgaaaggtgttgatgactaacagccaggatttccaagtgagctccattccttgcattgtccccattaaacaaatatgaactgttgctattcttatggtaaggcacctcaaagcatcctaatgcagaggctttgtggggcagatgtgggcccaggaagaggcctttgaagattaggcaatggcatttgcttaaactctatcttgcctgaattgtggagtctttttatgaagatccatccttattcacaaggaaattgtgcagattggaagatgtcactgctggagagacaacaagttaataggtgtaatgggtgttatatggtgaaagtcttggcaattgagaattatttggaataaagtgaattcaggacgttgaagcactaatgcttctaacacaggaataggcatgacaaactaaaggaagatacatgagatagggtaaagtacttggtgtaaaaattttgggcaacattgtgtaaaattttcttgctggattaaaaattagagtttcaatttcaaatttatgtctcaatattcttcttgaagcatatttaatcaattaattcaacaaatgttaattgtgtacctattacaaatcaaaatgatatggcacagggccatggggataaagggagaaaagtttctatgttcctggattctgttatccagtgggagaagtagaaacctaaagataaaagtgtaatgtgctgtcataatcatcgagcttgcatagtaagctggagaaagaagccagctgtgcaccagtgttgtgttgtcatatgaacattgctgtattcataattgaagcattcctttccttctttatcccttctgctgagttaatgatatcttcttttagaaagactctttagttttgcatgtactcagagctccaggaagcattttggattagtggggtttaaactggtggtgggtcttttctgcattctattccatatctcataacatcaaatcccattttggtgttggagggatacttggaggcgatcaagcagacacaaattaaatgagtctaccatgaccacattttcccctaagaaactcctggaaaagtctccagggatccctgagattcttagaacccaaccagaaaaccacaggagtaaatgatgttgcaaagcccaggtcctgtcttcacggaaatcttaagtattgtggttaatgccaggcagagtctatgtaacgattttaaatggcctcatttaaaggctcattaccataaatggaattcatcttaaataggccactgagtattacaaataagcatttaaagatttttttttccttgtggtttttattttcctcttgactacttcctcttttacccattgcaggccacaggagtccaggcagcatggctgaggtctgaatggcggtggctttccacccacagtggtctaacgcagctcaatctgcagctcagttgccttgccctcagaatagcttgctctgtgtgtgtgtgtgtgtgtgtgtgtgtgtgtgtgtgtgtgtgtgaaggaggtctacagcttcctttcaggttctctctctcacctttactccagctatcttgaatcaatgaaactgactgtgattgtataatgcagaaagctaggggtgccagccttctggcattcacaatttagtcttagctttgtacttacagtctcattttaaattgagatgaaattgttctgccccctgctgaagtttgagcttagaaagtggtaacacttgagcctttagcctggtcagaaataagtatgttagcattcctgaaaacttcttgttggcatccttttaataactctataataaccatgataaatttgtcatggcaccttattttccccatgttatgagatgttcttttctatcctatattttggctatttctgtctctatcttgtttcccctgttattctgtaaggtcttctatcattctccagtgctgtctgcatataggagatgctccgtaagtatcagataaatgaaggaataataagtactgtcatgctatgaaagtggtatgacttccaagcattgctggctagaaagaattcataatgttgtagtattttacaagcactaatgtagctaaaatggaaaaaggaacttgatctgttgtcatttttgttccctgtaggatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtaatttatttttaaatcaatgtgttctagttgctattaattattctcattgccttggtgcggtagtctgggaaaattaccactacctggattgtatatagtattctgttgatgtctccagtgactcagacaacatttatgtgcagtgtggagtaatctttgcaagtagaatattaattcagagtggatggctgtaaagtgcatagagaaaaagtacactgcttattctttttgtttgtttgttcatttgcttatttgttcatatttgtttttccatctatccatccatccatttatccacccatccatctgtgcaaaaactatctgctaaaagtgtggcacttctctggccacatatacccttggatggcacccaggccaaggatctcagggtgatgaaagtgtcctggcagcacaagcaaatccaattcaatccagcacattcccttaaacttgtcttactgccagaggtctgtgtctcttgatggggtgccccaagtctgccatgccacgtgcttctccccatgtctggatttaagatctcctactttaccgtcatcccctattcctcttcccagcgttttcatctccaacatttaaaagggcaccgaatggcaaaatcagagctcatgtgagtgctagtgagttataaggaaggaatagcaaagtgttctgcttaggattttactagtcttcagtgatgtacctctacaatacccacacatgcatgttactaccccattgacatttgaatcggttagtcaaccagttaacaagttcacaaacaattatgtttgatcttctggcctagtggctggtgacacagcagaaagccatgtagcacctggttcttgtgcacaaggaatctgtgtattaatcacaaacaaccgattctttgttttcggaagacgctattatttgaggtctattttttatttaagaaaaatggagctgctgcacacgctttgtaggaatgcgataaaaataaagatatgagtctgtttcttaccctgaatgaccttagaagacggccctgacccttcccacagatttttctgtcacaaatagagtcctttggtttcataatgggggaataaggctttattctcttgccaacctctgtcagttttctttgctagctaacacttaaaaaataaaaaaacttttaatatgtgtcttttcctgattgataagagggtaactgttctctgttctggtgcaaatttgtactgctgagagaaattgcctagagggacaagaaattcaatgttgagtcacctggccttttggccagctcccaaatccccatggcagttgtggccacattggttcagcaaccactgagaggaaaagagagaaagcatctgactcttgctctgatttcacaaactgcctcttaacagacgtctgctttgtccttgcctgaaaccaatttcatttttttccattgtaatttttggttgtgttgtcttggcagcattccgggaatgcaccccgccttacgtgttattgctcggccattgtgattgggataggggacgtgtagggagtgaactggtcctcatttttcctaaacagtttgtcaattttcagtcattttttatttctgttttctacaaattagtcaatgaattgtgtgtctaagagtgaggttttgaatctactgtaatgagggcatgggctcaattgatcgattaggactgaatggttacattcacggtaacattcacaattcatttcaatgtcaaggatgcttttcaaaaagcaacattatagaagagtgtggcaagtgaatcgacagacttatttttcctatcgtttttgtgttcttaactgttttgttctttcccttttaatttttattctctttcaagtgttttactttttataattgcatgtattatattgatatgtcttgttgcaaaagtaatttcctacattacacatatgatgtttgtctttttcttgcctaaccatttctcctaaccatttcaggtcagtagtcatagatctgtcatattctttttaaccattacgtgaaattcatgatacaatgtgtcttaattaattaagtgttccatattgacgagcattttgcttattttccattttttcaatactgcaaaaatgtttcagcaagcatccttattcatgctttttacacatatgtacaagtgcaaagttttttctagaatacacagaaagaagcagaattgttggtttatgtggtttgcacatgaaaaaatggctgtatctatttatgcccaccctaacaaggtataccttgatattagcaaacttgttagtgtttgtctttctaaaaactgctgtcatggcttttgagtttgcattttcctgattactattgagtatcttatatgtttattggactgtgtttatgcttcagtaaatttcctgtttatatcctttgtctatttttctgtagggtttttctgtttctttactttcattgttctttgttttttcttaattgtttgaaagtgataaatattctctttttaaaaaagtctataatactgaaatattttctgcacaaatttaaatatgtattttctgcatagagataaccaccaataaggcagaaaaaatatttttgcttccctttacttctcctcccagctctcagtttgttatcatctgggattttatttttgtattgttacctggcttttttgaagatgtcatatttctttgtatatcatagacttttgtgtcttactgtgttcttttggtgtgattgttctttttgctggagtatatcttctaatacttctttcatagaaattaaaaaaataaaatcaagttcttgggtggtgggaaattggcctgtattttttcttctcagtggaatttgctgagtaaaaaattataggctcaaaaactgagaactttgaagatattgcaccatattctttttgtattgagtgttgctgatgagaagtctgaggtcagtctgttgcttgctctttctaggtaaactgtgctttttatattttttcccctctagaggttttgagaatttactccttatccatgttattcttaaatttcaccacaacgtaactagatgtgggtttttttttttttaattctgcttattgtgagggataccttttcaatgtgtgggttcatgtcttcagttctggaaaatttttcttattgatttgctctatgtattctttccatttattctttcattcaggaatcgacattggatagatatttacacttttggctccacccatgctggccaccttttccttagtagtttccatctgcttgtccttgtgtaccgcattatgggagaattggtttgctcattacttagcttttcagctgtttctccagctgctgattttttttcctttcaaccactgatgatcaatttccacaatctctcgtgagtcattttttttgtgactgaaatgcccttctccatacggggtttgctacatcagcagggagtcctgcaatcctgcctctacttttcggtcctttgaaagcctcactattttgtgaagcacatggttatgtgtccacttggggctgtactgcttttcattaatcctcttctgctttctctcgcttaggagttctttatagtttcttctccatcagcgatgtgccttctcactttccaactttgttctgggttttaagaaaaatattgagtatcacttctggatatctgggataagaaagggagccttcactttggggcttagtcatgtattaattttcttttgatggtttcccaactttggttctttcaggagaagttataatctagacagaaaatgacactagaatgttggatttaaattctctggaattctgtgttgaagaaaccagataataatacgccaatatcttcaagttagataagtcttcaagtcttgtttgaaaaaaatgaatttatggtcagctggctttttcttttacatatactttaaaaacacatctgttgtgtttaagtcacagatttgaagttcatcttatttccacactttttttgggggtaaaactttttagctaactctgaatcagtgaagaccatggtcttgtgtgtgtcatctttgtaaaccaacaatttgccaactactgtggccattgtatttagtttgcaattggtactatttttatttcaatgaaaaagaagagctgctgagattttatttgtttgtaagatgagttttctttaaaagtttcccttgttagtatttcatcatagagatattatatggagaacaagttctctacattttatatgcaaatatgcatattccatggtgcctgctgtactccttgatcataacaggcatttgatgaaggtttgctgaattaacaaatgcatgaaccatatcatattaatgttcatattggaccaggtttttaatataatggtgtgaacgtttcagttaattaaaaataacttacatacattattttagccaaattattctatagtttagtattttttcattatttttgaaatttttatcttgatggcatttttgagagagtctcatttcttcttttttctttatatccttagagattaatcgagcatgatagatggggctgggaagcttaactgcatcattctcattaatagtgcagtcaaaatgcctcacaatatttttctaacagtcccctcctgctgtgaattactgtaaatttattcatgctgtaaaacaagtggtggttcatttcttcaaacggcccttctaaaccttagaaaaactttgttaattgcaaggcaagagaacattttcatataacatttccacattaattggaatagagaggtgctatgagcagtggttctgaagactgaaacagaatcatgtaagtgctggtgaagaaagctgatttggccaggctgtgctgattatcatctcgtataaaaaatctccctgctacttcttcaagtgtttctaatgaaattatttatcacgtagtattttctttttaatttctgctcaattcctgcacacttagatgattttcagcagttagtcttgcagtagaaacctttcagtcacctcccctggcataatgggattattaaggagaagtggatgttatattttaattttaaaaaatactatcattattatttaaatcttatctgagagcttcttcagcaagtgttaatagtacatgaaatgctctgtcttaagttgatggcaaatacatttaagaaaggcagtattcctctgggtcatatcaaaagaatccctgcacctattttactagtaactagttaccacacagaataatagtcccacagtgaatataaggtggcaattcacttgttggttgaagaactgtgcagttactatataaaccatccttaatggtcccatggattgaaatcagacttgcctttgatttccttcctatttattaggacaatttcagttttccacttttccaaccttccaacttttaatgtagaagcttttaaaggcacatcgacaaaatactatttatgatagtgaaggtcagttcacaggtgcccaggaggagaggccgggttccttgagataaattgaatttaatgatttatttttaagaattacttttggtttcaaccacagtttgtagcacatatgtctgtgtagcatatttgtacatactccttcttttgttcgtgttgaaccaagaaaatagactggtagtaattctactttgttaacactcccagattaaaagaatatgctatattaatgctctatgtggaagttagagtgatatgaaacattattttcttagcaacttagttggattggctttctttcctgaaaaccacacacaaaggctattttagtgtactgctttggtttaattttcttagagatcaggttttatctcccaaatcaagcaaaccacacagtggatcgttgtttttctttatcttcttagaatgtcaaatgaagttgtttttttctcatctgtcaactgctgtttaaatttttgtgtttagaagttatgtagtacctgtcactattgtgacatggctcacatgtgtttagaagtgcagtttcaaatttgagcttgcaaagtcattttgctaactttctgtcatttttcctaccaggtataaagcaatcacttctaaataggtcaggctcattttgacttcattcctggttgtggaatatagctgttcaggaggcaaagaacttggaagatatgacaaggaggtggaagggtagaggggaaggttatagggttttagtattctgttgagagagaattaagagataggtcaagtgtttatttgttttaagttctgttatgtgtgcacaaatagaagtgagaggagagaaggcagagaacagacaacattataatttacttgaatacttttatacatgtggaatgatgacccaacatgaaatgaacagagctcaggatcactgaagcaagctgaaaacaaacacaagcaagacctactggtgattactaaaaaatgttagtaaaacccaaccttaacccatcttatttgttgccaaactgggttaatccaaaatgactagagatttgtttttccttaagagaaagtgagggcctacacactttgaatgagtgattgaagcacctagtcaatttggtcaactctcaagaagtatgcactaataggtggaagcagagacatggaagatcccagcaaaggaggcagccagaatgctctggttaaggccctggacagacagatgtgggccagggccaaccccactgactagctatttagtcataatacttgatagccttaacttcttcatctggaaatagaaatattaatggcacctactttctaggatatttaggatgactgataaggtgataaatggaaaatatttaaaacagagtctagcacatactaagtacccaataaataatagctattactatcatcaacaagaatagttagatttaaatgtattttacatctgaatttaaatatatgtatatcttatattttgtcaaattgcttgaaatgaaaataaagccacaacaaacattacaatcaaagaactgattatgtactcaaatctgcttggggaatgtaagatcaatggaattcaaatggatttctttatagcaggagttctcagaacttttaattttctaatgtgcattgtgaacatccagagcttcttacagagcctccttctccttctccttctccttcttcttcttcctcttccccttcctcttcttcctcctcttcttcctcctcttctttcttcttcctttttttttgtaatcttggatttttttccctctagaatctcaataaattagagttctataagacacactttggggaaaatttgatggacaactcaggtccatatcagatttaagaataatagttgtaggaacaaaagccctttgaacaattgcccgacacttatggtctaaatccctgtccttccaagtgtgttctgtggaacagagagtttgctagaaatgcaaattcttaagccccaactcagacatattggaaaagaagctacatctttaacaagataccctggtgattcatacacacaatagagttgtgtgtatgaatattcttacacacaactttgtgtgtaagctttggtgtaaagaaaagctttgggaagctttggtgtaaagaaagtcaacattttcactgcctggttgatgattttctgctgaggtctacaggccagtacatccttcctgaaggaatccagatcaagagacatttacgcagaggtatctgtctgcctgagaagctggtcatctccgatctccagcgaggttccccagagtgcaaaggaagacagctgtagggcttagagtcaggatccttttacagtagagctagcagctcttggaaacgttgctgggctttgctgtgtacttgtgctgatttcaaatcttgttaagccaagaagtagtgcctggcaaatggttgatcctgccttggctattcatgcttcccaattcatttttattgtgctaattaaacctcgagtggtatttcaagtacagattgttttttccattattgaatctttggccagcatattaacgctgtagaattaacatgagtcagatgcttacttatttgtggaagactttacatttaaaagatcaagacttggccaattttgctcagattcctttggaaactgcgatgacagggtgatacaatttctctataaataaaggagactcactcttctacagaatagacacgtaattatttttaaatgaaataattcctttatcaaggaatcataaataccactttatcagtggtatttatggtccatgatgaaatggatatgtacagctcgggaggtagtggtgaagaccctgacctttgagttcaaattctaggtctatatgtactcggacaatgttgaataatgtatttgacttttccaaaactcatatacttcattaattaaatgagggcaaaatacttatcttcaagattggttctaaggatgagataaaacaaggtactaggcaagaatatctggttcagtgaatgctcaataaatgataatattagtatcactataattaaatgcttttagagctgttaattatgtaagcttgagtttgaaaaaaaacccacattagattttataggaaaaattaacattatgacataacatttcctactgagaatctctttattttaacctttctctcctcagaatttccaaactattagatacatttataaaggtaggaaattcatcccatgggtttgtacttgaaatgccaaggtgggtgtctttaggcttcatcagtggggtctggctatggagggggtcataccttgagaacaagcaccatgacgggccttgactctgatggtcaccccagagtcagcagataaatctataaatatagaaagtggaagagtcggctgggcacggtggctcatacctataatcctagcactttgggaggctgaggcgggtcgagtgcctgagctcaggagtttgagaccagcctgggcaatgtggcgaaaccgcatctctaccaaaaatacaaaaaattagtcaggggtggtggtgtgtgcccattatcccagctactcaggagcctgaggcacaagaatcacttgaactcaggaggcagaggttgcagtgagcagagattgtgccactgcactccagcctggttgacagagcaagactatctcaaaaaaaaaaaaaaaaaaaaaagggagagggagagtcaacaaagcacaaacacttgcaagctgaaaaagcagatggttgagtagtaactgacttaaagggtgagaatactggttaccaagttgacaatggagaaagccaaggggaaacttggtttatatggcagaactactacaatgcttagagtgtgagagtacagggaacaccaaacactgtattggttgaaagtcggctaagcccaggtgactgcacctctcctgcctcagcagaaaaccggaggcttaattctctaaagtggataaaacaaaggttctgagaaactacagatagagtgaggccatgggaaccataaagaatatgatggatttacatactgaatattaatatttccagacctctttctcctccaagcaggaaattggaagagcattatttgaataatttgaccacccccttcctcaaaatgatttcatgatcctgacatcaggtggtacctagtaaattggccaataatattgtcctacaatgaagatgacaattcataaatttgtgcgatgtttctagtaccccattcttaaagatgtatgaatagccagacataattgaggaaagcttataattgaaagataaacacaaaagcaccaaagagagaaagagaggaaaaaaatgcgaaaaacaaagctgatatagagaaaagaaaaattcaagaaatgattataaatatatgatagaaatcgtaagagacattgcatccatggaacaagaagagggtgctataaaaaaagaacactcaggaacaaaagaagggccttgggaataaaaaattgacagaggaatgaacaaccttaaaagggggctttaaaggttaatctaaaaaaactccttgcaaatagagcaaataaatgaaaagttggaaaataggaaaggattagagaattaaatggactatctataaggtccaacctccaaacaatagttctaagtggtaagaaagcatgtgttatagttatattggcacatttttttcctttcatagtggtacatataacggtgttgcaacctgtaattaataccattttaaatttgatgaaataaagtaagtattgcatattagatggttctggtgttagtaaggcttgcatactcataatactcataataatcttttttttttttttgagatggagtcttgcactgttgcccaggctgaagtgcaatggcgcgagcttggctcactgcaagctccgcctcccgggttcaagcaattcccctgcctcagcctcccaagtagctgggattacaggcacccgccactgcgcacggctaattttttgtattttttagtagagatggggtttcactatgttgtttaggctggtctccatctcctgacctcgtgatccacccacctcggcctcccaaagtgctgggattacaggcgtgagccactgcacccggccacatactcataataatctttatgtctccattgagacaattacagcacatgaaaaaatgtgaagacagagtatgttgaatgtggtgggggccatggggagggctggcattctgtgtgtaagcgagcctatatttcatcttccacagtgggaggtcaatagatactgctgaaacaggaaaaccaacaagtagcaataaagaatgatacttagtgatgagcagagcaataccaaaagaagaagttaaaagagatgaaatgggtgcctcagggaacaggaaatagtgccacatgggtaaggtgggactactgtttttcacacatagtagcttgaatctttttcgtaatttttatagaattatcaactcttgtgactaaatatttgatttttgaaaaacaaaattaagtatatacatatttttaaaagtcacccagattatgccattgacttcaaggagatttttcactaagtaagcccatttcttctattttgccttgacatgctctgtaataaactgaacagcttaattgtcatagaagttgtgaagaaaacacattgagaaaaacaacagactcatctaaggccacaaagttagtatgtgccaggtttagggtgtggggcttgtattacactctgttaatcattgttatatatttcattgccctgtataactctggctattaggggcttttttttttttttttttttttttgaaaccccatgaaagatgtaacattggtctctattggatgcttacgggaaggaagagtttggaagggggggtctcactagcccctgaaagccagatcttattggggaatcctctcccagtggtgggataaccatgaaatatagactgtacaaatcttattccagtctgatttcactaataaagaaagatggctttgccggtaagaatacatgataagagaaaggtttatccataataatgtgaagacgaagggtcagatattgccaggtgggtgggttaattgcaatttaacggctgttgaaaatgaatcgccttctttgacctccaggttctgatctgagttaatgatgtatcatagttcttcaagacatagctgtcgggtgactatagtcccaagcagagttcctgacaccaagagagggacaggctccactagcaggtcctgacatattgttataccctctaagacatgcctacgtgtaaaaattaccatgattcttatgcagtttaaagcagtgtccacactcagttggtgtgataatttcatgaagtgatagcagcatccctaaaattacacatagcttttgaaatataaaagtataaaaatgatgctttgctggactattaaaaatgtttatgaggttcaaagtttcatctgataaatacattctcagagtctttccaataaaaagaacttttcactgaaatgagtccaacccattttcattatattccaaacaagatagcaattttacctataatatttaactatgatttatataactttgaaactttctaacactgcaatagttcaaactgcttgtctttgaaaaatgctttgaaactacattttcttcaatagaatgagtctttcaaaatctgtgtctggtagagggttagatttgtgagagttacttaaagcaaaaaacagatttttgcaaaaacaaaataggtgcatctcacccttttgtgttcttgagcattagtaaaaaatggggggtaggagacaggaggaaataaaagacatgatgtcagtccttatgtacaatctctgtttatgtgcaaaaactggattagtaactgtagaacaggaaaagaggtggaagacagttctttatactagtgttcttgaaataaaaggttattcggcaataatgctttaagtaatgtgcataatttattttgaaatctaattatagctttttttggtttatgttagatctatgaagctgatcaaagtagcactttttcagatcaacagaaatcagtctcaaaaagcaattaaagattgatttttaaagcataaacagttttcaatttattgcttttattttgatactgcatttaactatttgcatatgcctctgtttacttttcttgttccataggtttgccatctgcaaatctggccgcacctaacctcactgtggaggaaggaaagtctatcacattatcctgtagtgtggcaggtgatccggttcctaatatgtattgggatgttggtaacctggtttccaaacatatggtaaggcttgtgtttggctgtgtcttaatagagagacaagagtgtttcagaatgcgagaatgtattaaacctagtgatgatcatttgatattttataaggctacatatagaaatttacaaagagtttttgatgtacattcactttctacttattcttaattaataaagactaatgcaggcttgcattttagttatgcatacctaagagagcgaggagtctctatatccctagtgagctctttgtatcatcctgaacaaagcgagtgactttccctgtggtcttctcccttggagggaattcagggatcaagtcaacctcatgcacttagcaattgaaacctagagaaatagaataacttctgatttacttcttcgcctgagcccagttcaggcagagaagcttttctaatgctatatatacatattttctctagttaggggaagaaaccccaaatcttgtcactttgggatcaatcctaatcaaggttatttttgtctgttaattcatttgtagaatgaaacaagccacacacagggctccttaaggataactaacatttcatccgatgacagtgggaagcagatctcttgtgtggcggaaaatcttgtaggagaagatcaagattctgtcaacctcactgtgcattgtacgtaatcagactggcatgtgtttttaatagcaaatgatcatggacgtacctacgtttgttgctggggcactctgggtgctgcttaaatttgttaaaaaaagtatatgcagtgttttgtgcatactctattaagaaacattatcagcctcttttactgttcaatttctgcttaataactcttgctcatgcatgttttttcttttaagcttctttttcgattttgagcttgtcattttgtgccttcctctgtcttttttctgatagaatatactttgggctggttgctccctctggttaatgttttagcttaaattttcgtaaatcagtttctaaaactttcttcctctataaaagcaatatgatgctttaaagttatgatacctaaagtatttactagctgttcacaaatgcctaattgtactgttgataaaataaaacctcattcttttgttatcaagtttctgtgagaaggtaggattagtcctacttaaattactgaaaattattatcaccggtagaaaacttttattattattgttttaaatttctgtatacattgaatctaagttcaaagatatccctctttttaattaaacataagtacattgtttttcagtattgtaactaatacaatatacattttgaaattccaaattatggcttttagcatgaaggtgtatattcagtaaaaactatatagacacttcacgtcattgtaaattctgagctggcacggtataaattaatgaggttttactctatttggattagaatttggatgagaaaaacatgaacatgcatgtgtgtaagtgtatgtctgacttacacacgtgtagacccatggccatagctggtatcaatatgctggttaacactcactcatagcacacattcagtgtgtgattgctggagtgaatgattgaaatcatcagctgtaatcctttatcattgttagtacaatcactatgcccagtgggtactaaactcataatttctcatcattttgacccactcagaagcctgaagtcaatgttatctccaaacatatgcaagcactttcaactgtatgtccttaaatcagcacctaacccaaaattcatttgagcatggtggaaggaatgatgggccctgggtgtggggacctgggctggtgggaggaaggtaagtgtggcccctgccccactgtggtccttgtagtggttggttcatagcacaggtctacaagtgtgtgtatctacacatgtatggaccttattttgtgtaatatatatatatgtacattatatatattatatatatattatgtatatatatatgcatatgtataatatatatagggtctccccaaattatattttaattgaatttttatagatgaagtcacatattaaaaacttttgttttccaaagactattttaaggaggcctgtgagagatatttggtaaagcaaacaattaaactttgcccatttaaatttagtaatatcacatttctcagagtgagggacatagtcacaacatacatgtgcagagttcagctgcacaggtgctcagttgagaggaatgtcactggtaactggaaatctttccgtaaattatgaaagtgaattgggtccttttatcggctttgcttcttcctaggtagtactgtgggaggatttacctgaatacaagtaagggggtaatatcagattacctgctttctattaaaaatatccaaacttgagtttttttctcagtttcaggttaatatctgtatggtcactaggctctgaaaaattgaccttatctgtcatagtttagacaaagagcagaagcaataaattataaataatattaacaactggctgggtgtggtggctcacgcctgtaatcccagcactttgggaggccgaggcgggtggatcacttgagatcaggagttcaagaccagtctgggcaacatgatgaaaccccgtctctactagaaatactaatattagccggtcacgatggcaggcgcctgtaatccaagctactcggaaggctgaggcatgagaatcgcttgaacctgggaggcagaggttgcagtaagctgtgatcgtgccactgcactccagcctgggtggcagagtgagaatctgtctaaaaaaacaaaaaacaaactaaaaatattaacaaccaagataaccagtgcagagaccccactcagagggtttgtctgttccctggctacaataccttagatttttttctcctcttgtttgatgaacacatacagtcaagaagcagtgcctgagagggaagggccactgtattaaacatcaggattcaagattcttgttccagatctgccttgctcagtaaccttgatgagctcacttaacctcattgcactttggtttcttcatctgaaaaaaatgatgctattagatctcaaaggtcttttccagtccttgattttgtaattaccaaagccagactacattaaaatgaacagatgaagcattttaaataccctcacttaggataagtactctgtttaaaaattctacttgataatgtttgtttccccaaagcataaagtgctttatatctaaagttgaaataatccctactctgtccaggcttagattggaccccaaacatttaaaagatctaaacattggcatctaggatcctagcaaaaatggacaacactatcatgaaatgtgatactttcaaagagtatttactattgacaatcagtaataaatgttgatttgttatatttataataattcatcatcagcagcaacatttattgcattgatcagtttgatctgttttcgaagttatgtgagatcagggcttcaggcaaaattttaaaagtcatttttgttatttaggaaagaagtgctatcaaaaagtattcattattttattattttgagtttttttggtgatgaatctgtataatatcaagatacagatattagaaaccaaagtcaacttcaaatgaactctttccgctgtcagaaatctcttggatctgtttggagctggttttcacttatactgaatagatttgagaaatgactgtaatgcaggggtcttaagtagaacagagaaaggagtctctctgaagctctctttggggagttacatccaccctgatgatgatacaaaatactgatggattccagagtttctgatgatgtgtttttctaagccaaacaatggttgagtaaaattccctatcaatgacacagacatctcgagatggggagaattctgagctttctgatgctattaactctctctttttcaatttagttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgagtaactgacacttttgtatgtggggagaagataaagtctatcattcacctgttgacaaaatcatgtatacaataagccatcccccaacctagtggcttaaaactccattatttagtgttgctcatggatccataggtcagcggagtggttttattttgcatgtatttattgtggaattcagggtcatgaagcagcagctacataggagatgtgcctgttatgataagtgtggagtgaaagaggacaactgcaacgatgtgaggcttcctaaggcctagattcagggctggtgcactggactgtctcttcagcttatctgccattggccaaagcaagtcacagggccaaagccaagttaaggggcagggagttgtactcctcccaagaaggtgatgaggaaattaataattttgaacagttatctgatacacactggattaataactactccaggatgcttgggtatcttatgagaaaagggttattattattatttccatcactgttgcaagtatttaatgagattttgtacccacaatggcaaaacccatgcaaaaccgcaagcgcaggaactgtgtatggttggctcgtgatgcatttaagatttattttctagcctcttacctaattcaaaaaggagaattctggtttctcatccatggatgagaaattagtgtcttggactgttttgcttacccgggctgactgagctgagtgattcttttattggctccggagctgttttcctaggagtggtaatagtgcttctctggccaaaggctaggactgcggaaaggatggctagcatcaggggtctactctgggcacagcaggagcgtgtcagtgtgagcttcaggaacagtgggacaagtgtcatgcatttacctgcttcagatgctgtccttcagtggagtgttcttacctactcagtctcattgcccaaatgcttgctaccaatgtggtggccaaggcctgtgtttggatgttgggagctgtacatgaatagagttcctcatcagagtagctctgagtcagtcaaagtcatgcaaagatgacttggtggagagaagggaaaatagaaccctggggagacttgtaaggcaggggctgcttgggctgcatgtacctgtgtggctcccagggcccccccaccagcaaaggtgatccatgcaaagccatctctgcaaaacaataaacaagaatgcagtccttctcattacatgataagttcctattattttgctcttcactagacctctttttaaatgcacaagcttgcttagtatattcaaaatgtgatttggaatatgtgtttgatttataaacagtagcccttcaggagcacataaaacaagcaatatttggatgcaaaacccagacacccctggctgttgctgtcttttccattaaatcttcctcttaattgagagtttagctgcttggctatggttgctgcagtaaatccctagcttgcagtgtgcaggaagtcatgtttgagggaataatagcttcacagttaaatccagagacactgatttaggacagtagctttttgcttgttcttacataaactttttatttctgaataattttagatctgtagaaaagttgcaaagatagtatagagcgttcacagccttatcacctcccccaccattgttaatatcttacattactttggtacatttgtcacaaatgagaaactaatattggtacattactaacaactgaacttcagacttatttgaatttcaccagtggccctttgaaactcttgggggcaaaacttgattcagagtgaaggtctgcagtgaaaagctgtcagaagtggtctgagtcttttgatatcaatgcacagtactgttggtgtaaagccagtagcttctgttttggaaaggattttgatgtctttccttttgaacatttctatatggtactgatatttggtagagctgaactcttcttatccatgtggcctcattttcattgatcatttctgctagtttttacttagcttgtgatggggaagaattgttttctggtataagaataacttggtgcttctcaaacattccctttaaaagaaataattatttataaaaaatacaacttaggctaaattttataaatatgtttcctccccttctttctttccatcttcttgttcatgaatttattaggtccttaaaatattaataactgctttcagaaaagcccgtttttttgttctctttaagtatttacttaagtgtcagctatcaaggagtaataaatgaaagtggaaatgaaggagacttggcccagggtgacagtggatataaatggccctagtgggccataaaccagtgtgaccgattagagattgaccccacttggcttgggaaatagaatcgttgtgggtatttatgagactcacaaccatagcacacagacaatgacctttcttagaattgcttcctttctctattaacctcctttaaaactaaagaaaaataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggggaggctgaggcaggagaatggcgtgaacccgggaggcggagcttgcagtgagccgagatcgcaccactgcactccagcctgggcgacagagcgagactccgtctcaaaaaaaaaaaaaaaaaaaactaaagaaaaataaacaaatagcaaaaaaaaaaaaaaaaaaaaaaaaatccctgcttgtctaaagtactttccaagttaacaacagcaggtcaagtttggctttatattccattaatatttctactattatcatatgataattgatgaagaagtttagctctcacaaatattttttataagaaatttcagctactttctcccagttgttttggtaagatcccccccttccctttttttatttgttatattggaagtttcccggcttacaaggaagcaggcagcctgggctcactgtgaagctagttgcatttccatacagagccataattaatgtgacatctctggtgtcgcttagcgtatgtgcacctcattcagcttagagcagatttctgctcgggcgcgctggctcatgtttgtaatcccagaactttgggaagctgaagtgggcagatcgcttgagctcaggagttcaagaccagcctgagcaacatggcaaaaccccttctctacaaaaaaaatacaagaattagctggatgtggtgtgtgtgcctgtagtcccagctactcgggaggctgaggtcagaggattgcttgagcctgggaggcggaggttgcagtgagccatgatcgtgctactgcactccagcctgggtgacagagccagatcctgtctcaaaaataaaacgtaaaaaataatttttaaaaaagaactaagatttccatgggatggtcattttgcttaggaacttgtttttgaaaagagagaataaagactattgaaagaaactgaagcataaataaaccaaaagtctccaaaacaaaaattggtgaagaggaatggaccaattggatgtaatgacagtcctcataacctttacttccgcttgggatgcagacactagacgaggtggcagacactctgttctctacttggaggaaggatggggaagttcgacctcaagacagcggcagcccagtccaagggggtgccagtcacagcgtgtgaggatgtgaggcaggcattaaaagagagcggcccagcaaaccaagatccccgtgtaatgtatcttgagagtgctgggccttgcagactctgccatttccccagccagcaggctaatgtggaaggacaggtgctagcagatcttcagatgtcagcaggaccccagacaccaagccagcgcccttccccatctgttaatcactggtagcctggctagtaactgagaaagagaaaagaccttcccagactccagatactaaatcgatcactttgggtcccacatttaagaattgaacttagctctggttagtttgggattgtgtttaaggcaaaaaatgcaaactttcagcttcaaaatgaaatctagaaaaccatgatgtttctcttccagcacactgaagagtacaacttgtgacaatcagactacaggagttttatgttacttttgttttccatcatgtctttaaaatcgattcagtatgagagatcttccctggttcccagaacagtagcttcctgccccttgttgcacatttgaatcaactggagactttttgtcactattttgtttgattacatttttaaatacacattcctggggcctagctttagcaactcagattccgtggctctgggatgggagttgggctttggctttttttgtttttaaggtccctagtgattctaatgagcaaccaggagtgagcctcactgattggaggagaactctgagctgtgtaacatttttctgcttttgattgagtgacaaacaatcctttggttattttcagctgcagatagaatctcaattgagaaatggcatgtcccacctgagctagaaatgaaaactctggatttgagctcgtggccagtctcctgtcctccccaagttcaggctggcagtatggggtcagggatggagtttgttgaagtttcagtgtccctgctgcccaggtgaaagggggtggagaaggagatgacagggtagttggctcactagtggctttgtgctcttggaacctgggaatgttcaatgctgatgtgccgactttctttcctggatacctttgtgggcttttggagatttctctctctgtatttcccatgacatgaacaaatgtgcctctgctccagctggcacaagcaactcctaactccaggaaagtactttatgttgttggggtccctcagcaggacctgactccccacaaagactttctcctgtgctgcctctggactgcaggggacactcatagtctcttgtcccctaggtgtacaggtcaagccaaatgccacctataccccatggctgcaggtttctttcaccttctctggcaagggtcaggccttgtcctctgagccatccgtttgcagagaacataattcaactctcagagtggttccatggaagccccttggtggggtggtgtcagagcagcacttccctaaagaaacttctttataaatccttccttgttctctccttccggggatatcttacactctcaaggtgaatcagacatttccaaggacataggtccagttctcagccagttcctttgtgatttctgcctctgagtgcctcacatcactttggtataagttactgaggcaggaagagtctcacttaacatcctattatgctagaatctagggattttgaacaatgtgccagctgtctttggaggtatgagaaacagagggtcctgggctaccccttgcagcgagttgtaacacttgagacaacgtagaccctacctcttaggaaggtggcaggggtggggtgcaggatggtgggaataaaacacagcctcttgcccatataacaaaagacaccctagccaaccataaaatataaaaggtggagaaacacttggctgcttattcctgtcccctgttcctctttgaggttgcctttattctggttgtaagacatcagcttctcattcccagggatgtccctgccttgatattaggcaggacccagatgaaggtatgcagaaaatataggcaatggaggacaaagacacctctttaaatcttctttcttgtggaagccagggaacagagactattaaatggaataggtggaacctctaagattttacttctaatgagataaactttcacttattctcaattcaaatgactcattcagatctgatgtttgaacttggaatcctgagcatagttagcctccactttccatattatttaaagagcagctttgctgcagtgggaagggtttgggttttgaactcagatctgattcagtcacagatctgagttccatcctccatgatctttgcggctttgagcaattttcttaacaccttggagtgtgaagcgtgactttccttctccataaagtgtagggttctagccccaagtagaggccatctgcctgtcatgtgtcagccccagcttagaaggttgccgccttgaggctgagcatatctgaagtgccgatgcagtgcctgacacatgataggcaggtgctcagtgttatttatcctctccttaggtaggcattgagaatatgataaaggaggcgaacattccccacctccctttgtgtttatgccctgtagccattagggagcagctttctacccagaaatgcttttatctcagactaactctgcccttccttattcagaagcatgggcttgcccagaaaaaggatcttgagactctatcattttactacctgagctttctagacttggcccttgatatgatttggctatgtccccacacaaatctcatcttgaattgtagctcccatgatttccacgtgtggtgggagggacctaatgggaggtaattgaatcatggggtggatttttcctgtgctgttctcatgacagtgaataagtcttatgagatctgatggtttgatgaaaggaagttcccctgcacacactcttgcctgctgccatgtaagacgtgtcttgcttccccttcactttctgccatgattgtgaggcctccccagccatatggaactatgagtcaatgaaacctctttcctttataaattacccagtcctgcgtatgtctttattagcagcatgcaaacaggctaatacagccctttaaggagaaaattaagtcaaaaatttgacccacctttcagagggtgggtcagtcttagatctttctgctgtctaagctcttttcccccttctccttttcatttggaatgtagcctagaaatgtgctgttggggacaaaaccaatctcctgtcctttcttcttttttgtagctatggtcaaagataccctgactccaatatttaggtacctggctattactttgtgtttcattaaaaaaattgtcatttttttgctgagtgcagtggatcccttgaggctgggagttccaggccagtctggtcaacaaagtgagaccccgtgtctatgaaaaataaaaagaaataaaaataaaaattgtcgtccttcatgctcactgagaccttttgactctggtaaaacttctcagtgagttgttaaatcagggcttctcgaactttaatgcacataccaaactcctggggaccctgttaaaatgaagattatgattcaatggatttgaaaatgggccaaactaatgtatttctaacaagctccccgatgatgccagtactgctggtccatggatcatactttgcttagtgaggatgccctgcagaagctggagggaccactggaagaactggtcaggcatccatcaagatgacctcactgactttccctgaggatatcaaatagtaataacaatacaaatatagaatagatggtgcacagagatgccctttaattggttttggcataaagttggatgaattcaatatgtggcttaagaaggctagggagagtgaacaaaaagtagagacagcagttgcaggcacgtacacacacacagggtggggttatctgaggaatcttcaaaagttctcatgtatcctatttagcttaccagccaaaaagaaagacttgtctaagatgaaattgatccactgtatgtcagtcattgaaattcaatcctccatataaaaatcccttcatgaaccagaaagtgtacatggagactgagtggagattagaagtgatgaaggtttctttttgagtagaatttgaggcagaaattaatggcagagagatcacttatgatttgttgtgaggaagaaacctgaagcctttgttagcattttctgatcagatagcccaagttgcaacaattttgaaggccaggtagtcctataaatgtgaacatcacgttgatgcaaagtagattctgttcagaatcattacccaagtgatttaaccctttggcttggaacaaacctaaccagagcaccagatgataaaataccctcgttttaaagcttaccattctttaggcagtacataaagagtgtctgtatggcccactcattcaggaagaatgtcacagctcaagaatgctcattcacacaagcagtgggagtcagtgacttgcgcttcctaattcgggagctcctgtctcctatgcgaaatgcgcgtcaggaacaaactataaatattggaagagcttttcccacagcttctccttccgtgctgttttatcgaaagattcatgacatctggatgaactagagctctctgcggcacttagaatgccccacactggtggatttagatttggtgtacttagtctaaagaacgaggggagaggaaatttctccaaatgttatgcattaaataaagctctcctggctttatactatttgttcctttggtcttttgtcaggacctatttcttgtcctggaggtgaaggagagaaatttatgtctgcttttctgccttaaataactgagaagagaatgatttggccatacattcagaataatgataattaagatttatacttaaatagcttcttatacctcaggagtgctaatgttagttaattatgcttcccaaagctcctgaggaattgccagagccaatgctattatcctctcctgtcttatagaagactccattgttacagaaaaagtggagactcccactgctatatagcaaatgagtggttcagccagaaaggaaaccagatattgcaatgccaatttcaggcgctgagttcagcctgcccttctgaaagagaagagaagaacctgaaaatcaaaaggctgatccccccatgagtgagaaaatactgtcggcaaagcaaggacagtttatttgaatagaacaaatcttttgtaattgccttatcatatggaattctttgaaatatttttcaggatcacatgatcacattaaatagagtctgcaaatagaatggatagaaaagtcttttctctctctctttttctttaggtagagcattagagggagactaaaagtttaaaggaaggaaacagatgtgtcttcctggcctccccattattttttatcttgttagcagaatggaaaatgaaccctactgtcaggctacctctcttcccacaatatatttttttttatccaacaaacctgtttttcctttaactatagagtcttaacagttgaaatgtcataaagatgttttctctttcatcaagatttacataaagtcataagattattcatgagctataagtgagtttagaagatggaaataaaaaggtcctattttaggttattttgcatggaattaggaggatggtgcagtgcttgggtttgatgctgttggggaaagaggaaagtgattccatctttgatgtgtggaagaccaaatgccctcagggctcatctgcctcttggaggtgcagacctcactggctccctgggaagctttgtcaggagtgcggctgtggctgtgatacagttgctatccttcttttactatttttttcaacttgtattttagaatcggggtgcatgtacaggtttgttacgtgggtctattatgtgatgctgaggatggggatgtgactgaacctgtacccagctaataagcatggtatccaataggcagtttttcagccttcccccccatccgtctctctccatcttcagtagtcccacttggggcacttcaggctgtaccgtggactggctactcactttcggtaattcttgacaacattccttaggtcaagaacaaagtaaaggtgagtatggcaccttaggatgctcaacacgttcttcagaaaacaggatttgaccatcagatctgcagaccttggtacttggccttcaacctctttcagctgaggaggagttgcagcttacatcccagtgagctgtggggatcatagacagtctgctgcttgtttggaactccagtgggttgaatagagttcctggatttcaatattttattccactgtctcccaacatgaagatttaaggcttgacgctacttcttgctacctaaatctgagatttctgatttgatgagcactactaggatagcactcaagaaatcataataaccctttcaaaaccccactttcaggggcatggctcaagtcagatacagcttctttgtctttcattaattctcttcttcttggatttttttctcatagctagtgtttgtctttcctcagtgaccttttagtcctgaatatctccaacagggcttcctaactttagcatataacagtgtgcaacagtatgtaatgaaggaaccatttagaaattagacttaaaaatggcaagacattttcaacatctgaccattgccagaagtctaaaaagaaagtgatacattttttctgtcagcatttaaaatgatgttaataattaccttactgttggagtgtaaatatcatgggaggttttgctaaactaggaagttgctggaagcaaaatacttgatgagctggggtcagctgtagtaatgtgaccctcacttttcataaacattaggtctctatcctctcacgtgccagtctaactaaacctttgtatactgagaggtgtttatttgttgtggtgagtagacctttgtcagacatagtgcagtatgcttgggagaaataaaagcaactctgttatagttcgtctcacattgtctttctgcgagtttcataatcttacactaaatttggctgttgtggacaaaagtaaagtgacagtacttgtcatacatctgggaggatgaaattaggaaaaaatagtgcttttcacaaagtttagatatggcctaacagttttgctggtgaacttggtaggaaaggcatgcgctgatatgggtcataagactggatggacactgacctatttttaattaaattaaattaaattaaattatttatttatttttgagtcagaatctcactttgttgcccaggctggagtgcagtggtgtgatctcagctcactgcaaccaccgcctcctgagttcaagcgattctcgtgcctcagcctccagaatagctgggactacaggcatgcaccaccatgcctcgctaatttttgtatttttaatacagatgaggtttccccatgttgcccaggctggtcttgaactcctgagctaagatgatctgcccgccttggcctcccaaagtgttgggattacaggtgtgagtcaccacccccggccctggcctattttttagattatgggctaacgtctttatttacgattggaccccaaatcccatttttccatacctaacatttgttacagtgaatagatgtgatgttcttggatcttcctaggggcttcgtgtgggtagtgtgtttggatgttcctgttctgcaacgtggcagattaaacctgtatgtcattcatagtcactgaggccgtttaaatgtgtggctgagataaatctggctctgaatcctcaggcttgtcactttcttatggagctgtaggtgtaaaagcgatggtgaccacaggcccttctctcacatgcggtgggggtctgtgggggcctgagaataaatcagtggccaactcctcccaggctaaggagtgaaagccccagaactagaaaaagccctcagtcctgggcagatggaaaggatgtggctgggagtgtccccgttttaaaacttgtaaggaatcctcttagttcctggcagtctgggatggttggccaccctactgcaaatgaagacccacatacttatatccaaatatttaaagattataaatcaaatcagtgaatgtgaattgtgaaatagagtaggttccaccttcctgcaagacaaatgtatagttatgatgacgtggaaggctggatttgaagttgaaaatctcatattgtgttgaaaggcacatcaggaagagggacaagtgaaatcttctaaactaatggattactgagtactttgaagactgacttgctctcttgggcttatagaatctttccttcagcaggggtagtaaattcccatggtgagggggactccatttggtctagggcttttgtaaagggaaaggacttcagaggacaactgagtcccctgcaagtgacatcaggagggcagccactgggacttcttgctgctgctttattcattgagttagccctcaaactacagggcagctttcaagactcttctcagagtgttataacagctataagcaaccctgacaagacatattcacatatgataactcaaaatgagtttgaattggtgtttgggataataaaattcttcaaaatatgattgaaatttactggaatcaatgactttgcatacattgatacagtgccatcatatgtggctgcacagggtgtgcactgcacaatttcccatcacatgtggctgcacaggtgcacagggtgtgcactgcacaatttcccatcacatgtgactgcagaggtgcgcagggtgttcatggcacaatttcaggtgatgttattcacatggactacaacattaaaggcgccccctagagttgtgcgaagcatgcactatacagcagtatgcagcatccctggatggaagtacacagccattcatttcattttttttccctgctaaaatagatatttttctagttgaaatgcgttacaattctaatttgaacactggggccacttttatttggttcttcatttagactaaccttgattattcactggggaatgcatgaacagaaaattggctcatttcgctttactttaatggcattttcctgctaagggttcagaagtgaaatgaaaactgagtaagctttatggtttacaagttttactgtttcacatggcaagtgaggactaaaagcataggaaatagctttggaaattcattttgcaatcacttaaatgttaaaacaaaatttaatttcatttccaagtagactttcatgtagagacccagttagctctgattggagaataagtagcaaatgtttttgttaccagttcttgttgatgctgagttaaaaaaatgtttttggcaagtctcataggaataccttaaagcagaatattttgatcatcttggtgactgcagagccatcctccaaaattaaattgataacttttacatttctctctgacataccattttttaataacttcttacacatcaatgatttcaatagaggaagtacattttatttttctttgttgtgttagggcttaaaaaaggtttcttcagccctagaaactcccctgaagataaggtggagaataaaattgtgctttagatagcattatgcagggtggttaataacaagctcctgaatgcaaatggccctgctacacagttaacagtaaccctcaaaccatcagagaataacaaaagtggtacgaaaattatttgtctctggaataaaaataccgaaactgcaatgaaagtagccaattgtataagagaaacagtaccaaaagaagaaaaatggtaataattcattgattgctgaagttttttcaaagcaatttgtgatctttttttgtgatttgttttcttttttggagggatgaaagtgggagaaccggggaggggaacggagttaatgtggaacaactcaagaacttaaagttttgtttacctgtcctgtgaaagcagtctattaaattgcaaaacttcagtgtatgtctagcttattttagttgacataggttagtaattttttgactccaaaatgcatacttacaaatctttgctctgttttgccttttaggtgcaaacccaaattatcctgatgtaatttatgaaggtagctatcgtgttttctactttgtatttctttttcaaaatgtttgtgtatcatgaagtaaatcaactgaaagaagactcttctaagctcagttaaatttacactttaagcattacataggccaaaatagtatttcaaaaaatcattcaatattgatggccgttttcccttgacatttacagtgcctgtaaatagcactttctctctcataccctgttcttggaagtagtgaatccattccgctggctgtaacagacatcgtatttccttaattgggaactaattacctgtttaaaagccatggctaccaagaaaagggaggtatatcagtttctggctatgacagtaaagccaattcaaaatgatgtttcttgtgtaatgaaggtgtttggctcacagatgggaacctcaaaggtagggcttgatttagggttggttaaagcagcagctccactatgtcatctgggacccaagttcccttcaccctactctctttttcccaccacgccagcttcactgaaggctggtccccttgtggttacaagagaatgtggcgggggagctgctgccattcacaaggatgggagaaagggaagcgctcctgaaggcgtcctcaaggaaagagaacttcccaagagacaagagccaagccctctttgtatccaagtcaagacccaattgggtcatagtccattcttgcccttattactgctaagagggatggattatcccttcagtaactaaattcacccccagactttaagtcagcttccccgaaggtggataggcttaaccccttgaaaaaaaaaatgggattctctcaggaacgtggaaagaaagaaaccaaagtccattatattagtttttttttttttttttttttttttttccgagacggagtctcactttgttgcccaggctggagtccagtggcgcgatctatgctcactgcaacctccgcctcccgagttcaagcgattctcctgcctcagcctcctgagtagctgggattacaagcacgtgccaccacactcggctaattcttatatttttagttaagactgggttttaccatgttggccaggctggtctcgaactcctgacctcaggtgattcacccaccttggcctcccaaaatgctgggattaccagggttagccaccatgcccggcctatattagcttttgatggaatatcgcatctctcctttgctgttttgatcgaatgccaaggatgttttcctaggtgtgaaaacccatatttaacagatttccaagccagcaagccactgtttggggaagtggaaggctacatttcaagacttgctttaaatttaggaatgattaaaagattgattaaaacattacatttatatattttctgtaaaatattctgttccttaattttatatttatatatattgattgatattttattttttctataaaatgagcctgtctgtatgtttattatatgcgtgtgtatttaacctgagctaattttaagttggggaataatattgtctttacctgcttgtgcatgttaagccatatttcttccaagctgtggtttggttgattttttgcatatgatttgtgtgttgttgtgtttgtatttgtcttgatatggtttaaaggaagaatctctcaaattgtttcacagagaaatacgtttgaattgtggttttacatcttaaaattacatttttgaccctttcccagttaattcaagactttaaaaatgtcatcttcctgttagcctcagatcctactttggatcttttggccaaaatgtcatgatactaaactatagacacttgaatgatttaaattttgcagacgtagttggctataacatgaagagggaaaactaaacaaataaatgatatccattagtgtttaaaattaataagttttaagatattcaaaaggaaaatgatgagaatgtggttttggcattaagaatgaaacagcaaacacatagaaaatagatttttttctgttattttttattcacaaaggaacacattgctaataaaaatacaatttaaattggttgccctgaggccagcatgatgattctacctggagaagtttagctggggctgcattaacaaggtagcctcttcaggatggaaattgaaggcagtgtacctatttagaattaaaatacaaacattataaacctcattgtttgcaataagtttaccaagagttttctgagaccttttatatgcaatattgctaataaaaactttgacaacccctgaaaaaaaatcagtcattatttctatcctgacccatgtagactaaaattgatccagaaggcagcaactgcatttgcgacttggtgaaatgagaacagagcgttaacaattctaagtattgtgtggatctaccttttaatcattctgaaactgaaatattggcaattcagaactcttcaaaaaagtttacgtgtggacccaagtttcatactgatgcttgttccacatatcctcttacgtctctgccctttgtgcaaataagttgcacctgtcctggaaatcagtgttgctcatttcaaatctggcgtcacgtgtgagcgctaccatcttcttgccttcacctggtcatgtaactttcctccactgatattcttcagctgtaaaactggtagttatgctctgtctctgaagacctttccgggtctataaatctatgacacgtagatgatcgattccctgtcgtacttgttttaaatatgccatccataaaggggtatatgcttatgtgcaaagaaaaatccctgaaccaggtttggggctgaccaacaagacaatgatgtaaaggtctgggttgaataaaatgtgggcgttgtgcagtctcagcgctgcagtgcattgaactcagcagcctggtcacgtccctccacagccagactgtcgggggtttggaatctttgtgatttgtcttgcttcattctggctcttactgtggccctgtgtttgttggcagcttaatgacaacttcatgttcttcctcattccccctttgcccacttaagattatggaactgcagcgaatgacatcggggacaccacgaacagaagtaatgaaatcccttccacagacgtcactgataaaaccggtcgggaacatctctcggtgagtggaataaataggtgtctgaattggttctgagcattttggatgcctccatgttagaggaatgtagctgcttcaataagacacttttattgttcagatataaatagggtgttaacacctaggttggaagaattaataaaaggcttaacaaaagtgataaaggtgttatatggcctttgacttatttgctgcttttgtgcaccacttttggttgttagtggttcctatttcaattatctgtgctttagaagggtatcaccagaagagcaagaaaccagctttatcattcagggactacaccttcatacctgtctccttaaatttttaatataattttgactgctcgctagatgtagggaatccagtagcttctgaaagggactggcggtggaggggatataatcatatgaacaaaattaagattagttgtttagaattcatcagagaccctggaggtgaatattagcacctcaaatacaaatagaagcagagcaaggcagtacaagagatagaagtggaggagcagatgttttgttccttgtagctgggacactctgaggagcctttgtggggcaagtgactttttgcatggcctgtgcagaagggttgggattttgacatacaggaatggaagagaagggcatttggggcatgtgaacaggagcttgtaggtggagaaacatcgtgaaggtgcttgattggagggtaaggcatgtgcaggacagcagggttggagataaagattgtggccaggttgtaggtcttgacacagagtctcaggtgtgtagatttatggcacagtgaagagccattgaagagggaagtcacatgatcccaggggtctatggtcagttgctctggtccgaacccaacaacttcctccagttgtttcttttcctcactgtcatatgcacacagagcttcctgtgagctctgcctccttataaattccaaatctgtccatatctccttacctccactgccactgtcacaggctaacccaggggttggcaaactatgacccatgggccaagtccagctcaccacctgtttttgtatggttttcaggctaagaatggtttctaccttctaagtggtttaaaacaacaaaaaagaatgatatttcataacacacgaaagttttgtgaaattaaaattttattgtccatgaacagagtgttactggaacacagtcacttgtgttcatttacgtactgtctgtggctgctcttgtgctccgatgggggtggagtagttgcagcagagaccatatggtctgcaaagtggaaaatacttacttctggccctttacaaggaaagtttgcctcagttgttctttcctgcatgaccacgcagcctcctaacccatctccctctcccagccttgtgtttcctggtcttttcccacacagcagccagagtgatctttgtaaagtgcagatcagatcattttttttgttgttataattctcagagtcctctcactgcaattgcaataaaacttttcatatgaaagccacactcttcatggtggcttatgagccctgggtgacctcgtccttcccgagctctctgacttcatctcccacgctcttcttactgcttgccacctgcctttttcatgctctctccagtgctccagtcctgctctttgtacttgtggctccccatcccaggcatttgcttcctgatggccatgatgtggcttcagctaggtggccagcatgcagccattgcccacttccattttcttctgagcagttatcattgtctggaatgaccccatttatttgtttgtttaatgtatttttctcttctctagattctttagtaagactcttagtaggggcaacgtggtcagtgtttttcacagctgtcttcttaagccttcagaatactggctgacacctagtaggcacctagtacattttgcagactggctagacttgcagtgaacagtatagggcagaggaattggaaaggggtgatccattaggggtttggtggagcaataaagacatgtgatatatacttgaaccaaggccacaagagtggaaatgggaggtgcgtaaacagatgcagtgcaactgcaactttatgcatatctagtatagaggtatgcatgcatgcacatgcacacacgtatacacacaaacacacatgcttccgtagatgactatatgcattacattgaaatagcaagaacaaataccatggtaagtcaactggggaatggtatctgcttcctgccgtatgcaatcattttagtttttaattcttataccaatccacttaatatttcttggtgtaagaaagttgtttgtgtacgtaagaaatccaagcagcatgtattaagcccaattacacaaaattatatgttgactttagttttctgggttttttttttttttttttttttgtgatggagtctcactctgtcacccaggctggagtgcagtggcacgatctcggctcactgcaagctctgcctgccgggttcatgccattctcctgcctcagcctcccgagtagctgggactacagccacctgccagcatgcctggctaatttttttgtattttatttagtagagacatgttttcaccatgttagccaggatggtctcaatctcctgaccttgtgatctgcccgcctcggcctcccaaagtgctgggattacaggcatgagccaccgcacctggccttctggggtttttaaaatacaaatgataaatttaggcacctgattggcatatctccatctatagtatagttgctggaaggcaagatcagtgagtttgtatattatgactttgcggaaggctcctaaaatctgtatgagaggtgcaatattgtgttttgtagaatttgtgtggttcagatattttatatataaagagttcttgatcacaggagggatcattagattagaagagtttgagagccaagaagcagatacaaaagttaaaaatgtttctggtccaacaagtgctcttccagcattttgttggatttgcaggggagggcagatctcccttgttctatcctaagaaatatcctcagatgaaaactaacccatcaagcagccaaccaaccaatcaaacaactgaccaaacaaactcacccatgctcatctcccgtgtaaaaaccacctcaacacatgcaaggtacacaaaattctgtatttctcaatctgattttgaggaagtaattcttttcattgtcaaaggcatccttgtttacgaaaggatttaaatttagaatggcttcagtagctttaagtatttgtttacagatccttagctgcttttcagcagtagagcccacttcccattttctaggttgacttacacattctataactaggcagagaagccagggcaggcattactgtctaatgaagaagcagaagcttggataagtgaagcatctcttctagctgtcatgactggtaaaagcaaggtgtcctgtgaacgcagggatctaggactcctaaatcccagttaaggactgtccaaagcagggaagagactgtactgtggtactgctgcatggttgggggactttcaggccaagtcatctaacctcccccatcgcagttttcttatttatcaaatggagtttgactttgtttatttaggtattctccatctatctgtagaagtctgcaatttaataataaagaaacttatagctaaaatactatgatctctttcccatgaaaacattagttagaaataaagatttttaaaaaacacccaaagtcatgaggtcagcttgagtgaaatggttacgtttatccataattagctttgtaggagttgctaccattctgtttgtatataggctgcagagacggagttagatctgtattggctgggcatggtggctcatgcctgtaatcccaggacttaggctgaggcaggcggatcacctgaggttgggagttcgagaccagcttgaccaacatggagaaaccccgtctctactaaaaatacaaaattagccaggtgtggtggcacatgcctataatcccagctactagggaggctgaggcaggagaatcacttgaacctaggaggcggaggttgtggtgagccaagatcgcaccattgcactccagcctaggcaacaggagcgaaactccgtctcaaaaaaaaaaaagtctatactcaaacatttgcagaagcgtttttggggagatatactcacagttaaagtaccagagaagagaatgatcattacttttgctccacactggccaagagctttgtatgtcttctttttgtgctctgtgatttatttaatgctcttctcatctgacatgaaagatggtgtcctgggagaattagccatatgtttttattttcctgccttcattctcaaccacatgctttgcagagacagtgtagtggataaatcacaggatttatacttgggcagacttggttccatttccaagctcagaaggtgtgactgtgagcagcttacttaatttttttgtaaatcttagttttttcatcatcatcatcacagctaacattaatttattatatattgtagtagatactgttccaaacccattacctgcattaactcattgaggatttacaataacctacaaagtagaataattatattctccatcttacacatgaagattatgagatgcagagaggttaagtaattctgaagtcatgcagcagagtgagaaatctagattttatactcaggaaaaacccatggtcttaatctctaccctataatgcttctcactatgagatgggtatatcagtcagaataagctatgctgcagtaacaaaacctccacatcttggggacttaaaacaacaaagttttctttcttgcttcatttcgtgtattggctaggagctctgttcagccttgtccttgttccaggactgtggatgacaaagcatccacatttttaaaggttagcctttttctttatgacagagataaagagcactgtggagcaggtggagcagggttcctcaaccttggcactattggcgtttggggataaataatcctttgtttggggggctgtcttgggcacagtaggatgttaataatgcctggcctctacccactaggtgctagtagtactttccccctcgttgtgacaaccccaaattgtcaagtgtcccctggatggcaatattattgtccctggttgagaaacactgccttagactaagatcttggacaagaagtgaagttctacaccctggcagtgacacaagtctgaactagtcacatgaaccacttaaccacaagcaagccaggaaatgtatcctacaaagagaaacacagagaaaaccagaaatattagacaaacagcattaatgattactatggatagggataataatatccatcttaaaaattgttgtgcagattcttaagccagaatggctctctaagaaatctcagagcaggcattggcgactatgttcaagtccagctgctgccattgtaaataaagttttattggaacacagttatgcccatttgtttacatatcatcattggctgctttcatgctccaccggcagagctggatccttagttgcgacagagactgcaaggctggcaaagcctgaagtatttaccatctgacctttacagcaaaagtttgccaactcctggtttagagaagccaactgtttttggaagcaggactttgggctgagtaagactggaaggagacacatagtgccgctgacaactttgctctaaaatgttaagatgcacttagaggagcatcatgccttggtcagcagcaatggtagcagagtgatcgcatttctatgtgtacctctgtcatctctacctctgggatgggagaggattcacatatatctacatctaccctcttgacttgtgtaatccacacctggcaattacatttttaaacttacttaaacatttttaggcttatatcatatatatgggaaaatgcacatatcataaatttacaacccaatgggctttgacaagtggaactcaccccagaagtgccctcctgctcccttccagtgccactcactgttcccagggtaccctgacttctaagagcaacaatagctaaccttaaaaatagccttttattatggacaattttcaaacatgcacttcagtagagagaatagtaaaatgaaccccattgtattcttcaccagcttcaagaattatcgggctggatgcggtggctcatgcctatattcccagaactttgggaggtgtaggtggaagaattccttgagcccgggatttcaacaccagcctgggcaatatggcaaaaccctgtctctgcaaaaaaacttaaaaatgagccaggtatagtggtgtttacctgtagtcctagctactcaggaggctgaggtgggaagataccttgagcccaggaggtcgaagctgcagtgagccatgattgtgctattgcactttagcctgagcaacaaagtgagactccgtcacacacacacacacacacagaaaaatcaccagtattttgctgttcatatttcatattctctctctccctttctctgcccacctctctttctctctctcctccctctttagatggatggagagagagctgtaatatttttaaaatgccaattggatagccatttttataagctttaacttatgttttctcatttgtaaagtaggcataataatagatcttacatacttcactatagggttgtcgcagattaagtgagttggtgtacataaggctgttataagaacaagtggtaagcattcaataaatatgaactgcctgtatcattatcatcgtcatgatcatcatcaccatatgattatagggaactaattagcaaggttataaccaccctcccttcctttctctaggtctatgctgtggtggtgattgcgtctgtggtgggattttgccttttggtaatgctgtttctgcttaagttggcaagacactccaagtttggcatgaaaggtaagaagggttgtgtttatttagcttcttatgtggatcatttttggcttatgactaatgctaattaccactaaagaaggaagtggctagatttatgatgattaggttttaaggctaaaaaaatagcaacaaggctttgatactacaaatcaagacggagcaaaataatgttgattactcagcactacccacttttccatgagaacagttgtcccgggagacagaactgggttcttgagtatcaagggactaataaagatatgacaaagaaatagtacttgatgtttcttttgctccagaaaggcaggtgagacacagtggggataggataacctggacacatgtattttgtgcagaaaggtctatgctgctgtacatttgattcccaaatcttcagtggtatgcttttggtgttgttcctgcttttccagatcctcattctttgaaatttaaacaacagtgttatgaagcaaaataagaacagctatcagcagtatatagaagcttcgtgaatacatagctttttttttatttaagtggaaaaattagcagggctagattaaaaattaggcactaattgacccaaaatagataacttgtctttttttagaggatggaaaattaattttacagggaaaacttgtataaatttcttgttacataaaaaatgccttggagcagtgatttaatgatttaaaaccatttgctctgaagtttaaacttatgtattggataatatgccagtgttgtattttgtgtggtctcctatagatagacactatttaaaagtgtctaaatgggaatgctgtgaagaaggtttagtggtgtcttagttgtgctggagagtaggtcaggtggattttctttatctgtatggtctgttagaattatgggtaatgttgctaatattgctatttacttgaaagggaatgtttcagtagcaataagttgcccagcatacactgacatctgggatagagcagatctatttctgatgtttcctcttttccctttgttggtgcctgtgaacatttctaagccagaaatgaacagggaggagtggtggtaaattggggcttaaaataactcaaaaaacctcgtcctggttcctgcttggccagctgatccttgatgtttcttcaggggaggaaagatctttcattctccaattataaataaagcttgggagagggaccaccccacagtgattttaattcatcctgtggggtggttctcaaacttgactgtgtgccaaaaactcctataggacttgagaaaacacagattcctgggctacccctagagtttctgctttagcaggcctagtgttcacctgacagctggcatttctaacagtttctggagaatactgatcctgcttgccctggttgttgtgttctctacacaacagtgtagggaatcactgttctctacaataaacatgggctgccaggcccccttcagaatgtgacaagatgttggtagagacatcgcaaaccaaactcacccacagctttgcacacattttgggatccccatatctcaactgcacccaggcccaggctaggcggctgctctgtgtgtgccgcaccctaccatggcatttggcggttctcatgtttatcaggtgctttccttccttagaggcacttggactggatgtctctaaacatagatttcactggaggctaccaactaacattagagtttctggtcttgaagggtttagtttgaaatatttcatcccatgagctttttggagagaggatatacccaggttcttctgggatctcagcaaaagctaagtgggaatccatggagcaaaatttaggaacttcttcccacccttggtttaggaaaatcactggcagaattaccagtaaatggcaacctactccttacaatgtggcaatggaggagaaaaagcgtagacattttctttcagagaagaaaattatgttgcatattgagactccagcactaacgctgaaacagtatttcatttagataatttggggtgattaccactaaagcgtctacgttttctgagtataacctgagggcatccttaatgaattataagaaagagtgtgcttaaccctgccacagagccagtaaatggcttcctacagcagtaactactatacatattgtatgttttgttccctcattcctacacacaaataaaatcatttttagaaattttgtctcagagacttttttttttttagaatagcttactgttctattttaagctacatgtctatctggggcatgatgtgaataaaaagagcctgatctagggttattgttttgcaagtcagatgtcgagttgataaatctttggggatctagaaattaagatatggttcatgtatcaagtgcagatgaaactgcttaaaacgtggtatttaaacattaatgtgagtcagtgtattttaaatgctattagagctgagattaccactgaaaaacatatgcttaaaaaagggaagaaaatgtaaaaacactattatgcttccgaaaataaccaggcaatgtattagttgtggtttcttagtaacaacggtatgaactgtgcatagctttggccaggactaggcaccatgtgaaaggcttgtggctgctgtgcagatgagctgttcagaatgttattcctcccttcctaagcatctttggggagggtctaagctcatccttattctcttttgctggaggcagatgggacaggaggaaggtggccagctcacccataggcactcacagctttttgcccatccctagcaatgcgtggtttatttcgagtgttgactgtttcaatctgtaatggaaaactcgagaatataaatgacagttcaatgctgctgatatgaagggcccagagaaacaaaccccagaaacctcttaaggtcaccacactacagctgagtgcagggcaacacaagctttatggattggcctgagatccaccccttactcctgcaaacattacttatggtattgctcccatggggaggtgatttctaaattccaaactagtgagtgaaacttggatttgtaaatgcaaccagtgaattgcagtgttgtctttgaagatgggtctgcaggtctgtaagcttcgtcgggttttgttccttgttctgtggattcatcgtaaaccaaatgctgatggtccactccagaacaggcagcacagactttgagctccatggtaacagcattcatatttgtggtgttcatctttatctactgagtgcctagcccagagttggcgctcaatacatattaacgacagaatgatcagagaagattttcaactccgtccacctaagttcggtaattggaaaacagttagtatttggaggatggctaaacagtgagtgactaaagagagaacctgagacttttctaagtttctaaaagagacaaagtcccacctcttttttttttttttttttttttttttttggttattccatatgagtcatggccatagataagagatcagtttgtcccggttttgtctcagggtatgtaggttttcacacactgttttcaacaatcgtcattgtttaagtttggaggattcactttgactttttattttgcatgtgaacatcttcaatttctacctccctacctttgaatgtatcgttttggaatatgttgttttttcagttctgaagttggcaaaagtgctagattggggattttatcttgtggtaaacctagaatttatgttttattcttgcttgatagagtttaagcttcttgctgctagtgtccaataggctcccggccctgtttccataaagatgtcaaggggtagaatatctcccagtcagtttttccttgtttatttctgtgcctttacactgtcctattgcttttttggttgatatgtagctaccataattgcagaagccaaataatgcccttctgttagtgttggccatctatgtagggcttattcatacatatgtttaatatgtatgaataaaatgtataccaaatctgtctaaatctatgtcggtatcaatatccctatatgaaaatgcataatattatcccttttcttctaaggctgcctctggtttgttttaattttagttttcactgaagtagggctgaaagaattttccagaacagctccattgccaaaggaataggcaaccatgcctttgaatgctctccttgtgttgtaaccaagtcttgtgtttagctctcgcattgcttcctggctccgtgtcttcactgaagacgtaggagtgcatgtgaggggaaaatggaagcattgaggagcaccagagctgccaagtcttcaaagggtgctccacattgggagccctgcctgtggcattgatggtgtacagggttgcaaaaaatataagggagccagcagggaggagggagcttggcattcatcaccctgctggaggatagtttcggctatcagttttgtgttatttacatttcctgatggaagtccacatatgatatctaattcctaagtactaatgcagcctttgtcactcaagagtgaaatatctaaatgaccctaagaaatctctgtagaagagactagaagaggaagctttcttctcattcagtgctaatagactgcacagatttcctctgcagcctctgattcttgtatgtaaactcccctatccacattcatttgtcctacttaagtgttggaggtttccaactagtaaaggctggaaagctaccctgccttgggatgcagatctgggttttcctaagtccagactgaaggcccacagttcaactttctgctcttataaatgatctctgagtgtctttcaatagcaaccaaaaatctgcctatttaaaaatagtcataaacatagcggggccaaagctaaagaggttgaaggttaaagccttttatatgagctgaaaacaattctgggaaatttaagaggttgagtttaacagatatttggatcaacttttaagaggaaaaaatgtgaccaaaagccagaaacacagttgtagaaacatctgtaaggacaaactgttttccatatgcaccctcttccttcttcttttttttaaagaaaaatgccgtcgaaaaattagaatggtaacaattgaatgcactcttgtttttcaaaatttcaaggagtttagaaatacctaaacataaaaatggatgttcccatcaccttcttctgcatgaccatttccactcctagaaataactttctttaactgtatagggtgcatatagtatgtaaacaatcaaatatatggcttcatttttgattccataaggaaattataataccagtcttgttctgcattttttgggggtaacaatttgccttgcggatttttctttatcagtacctagctatctactacattccatttaatagtatttcccagttgtctgatatcaggctacttggatctgaaacctggctctgcctcttacgagctatgtgactttgagcaaatatctcatcctctcttgcctcggtatttccgtctgtaatgggacaatactaatacctaacccatagggttgttatgaagacaaactgagcttatatatataaaccacttgggaatgtttctgacacttagtaattgctctataaatatgtaatgttgttaatattattgacaaattatgatttatttgacttttcttcttttaatggacatttatgtttttaccaagttttcagaaaattatttcaagtaattttcaaataatatcttctgtataaagatagatacttggaaatgtattgctaggaggaaagatatatatgtttaaatgtgaatagattaccttgcataaatgcctttccaatttagtctcccactaacagtatgtaaggataccctttcatttcttactctgatctatactgaatattatcaatcttttggctatttgagtttaaatgatacattgattaataatgaatgtaaatatctttatcatgtgaaaaataagagtaatgtttatttttattgttgagttatagatatactttgccaattatatatatatatttatttattcatgatatttgtggctcatattttcttctagtcttttgactttttgatagtgtcttttggtaaccaaagagatttacctttttataaaagcaaatctgtccatcttttccatttaagttgtgtcttgcttaggaagatctttcctgctctaaggtggtaaacatatttctaaatatttatttcactagttttttactctatgtattttttaaacttagccctttagtctttttgtaattattattattattattattattgagacagagtttcactcttgttgcccaggctggagtgcagtggcatgatctcggctcaccacaacctctgccgcccagcttcaagtgattctcctgtcttagcctcctgagtagctgggattacaggcgtgcgctaccacgcccggctaattttgtatttttattagagatggggtttctccatgttggtcaggctagtctcaaactcccgacctcaggtgatccacccgcctcagcctcccaaagtgtttggattataggcgtgagccaccgcacccggcctttttgtaattattttattaaactttggtatgaagtagtcctctctttttcagagacgtatagaataaagatatttgaataaattctagtgtgacattttcatagagatgaataataatattttaaatttcttgtatcagaaagccactaataaagcaaaagagaaattttgaaaatctcagtaattaactctttctttgtgaaacaagtaatgaactttgccagttctttcttatagcatgggaatataaaccacacaaaatagtatcagagaaataagttttcacagaaaccctttgttaaactactctcctcccagcttcaagtggagttcaaagtctatctcagcactctcttaagaggcaacaaaatttgtcaatatcaaccaagtcctcagaaatttcagaaaagacattcagttgaaagagtcattgagtaaggtaacaaaatgaaaatgaatctagagaaaagaattagtccaagtgttccttttctgttgtttggcgatgctatagaaagcttttcccgtgtgtttgtgaggtgaggatctactttttaaagtctcttacttctttccctgccaacatttggcttctgtctatctgagagcagaagatgcttattctttacaacatattgaaaatgtgtgtcagacttctaagaattggctagagtagcccagacaggaagcaaaagaatcggcatctctgcctttagccttgtaggtggatgcactctaccttttaattgctggttttacctgggaattcccacaaccgcagcatgattcatgtgagagctcttgttttcctgtaatgtagaaagtgcatgcaatattgtttgggactttccatgctagtattttcactaaaggtgaaagagcctataaaaaattagattttgtacttaaaggtcaggaaatattgttaccacttctttggtcttccattaaccttggggggaatttgctttgacctcctcacatagcttatggcctatttcagacaggactttcaaaatctgaaaatcttctggttttcttcttcttttcccccttcacttctcttttacctttcgttgttttccctgtcattttgtcctgcatgtctttgctttctaattttatattttttcctctcttgtttttcttccatctcattcctaacatctgattttggtggaaaagcttttcagaatttatgaagaagacagataataacttggcttaaattctaacatatgctttgattttatcttactttattttgagcaagaatactaaatgactatgggaatacatttagctctaaatcagcagaattgtcacgtggcacttcagaagacagcctgtttgaataatgcacatccttcatgtttgtaagttgttaactcctgagtcttcaacccaaggaacatataggaaagtaatattgaagacatatgaatcaaacatgcttgagtttaaatcccagatctcccgcctgctggtcatcattttgggcaaattgttaaactctaaatcttaattcctctttggtaaattgagggaataatactcatctcttcaggtgattataagaattaaatcagtgcttagtttagtatctgtctctttaaactaattctctaagaggtagttacttttcagatttatgttttagtaatacattattaaagaaaatattatagggtgattcttgttgaattcatattgaatctggaatgcagaaaaatgtcgcaaatgtaaacagtgaatattagtgtttccaggtttattagttgagtctatagaaaaaaattgtaattacaatgtgtatctactttatgggtatgtatcatgaatacaaatgtgctgatatgtgtgcttcttttaagcccttcagccctttaatacactatgtgtgaattattgcaaattcttaattttattgtcctctgaagaattcatcactttaaattattttggggtttataaaaacttgtttcattgattgattgatttggtatgtaggttttagcagtttttcaggggagaaatattttccaaagtaaagaggtggaaagggcaggaatgggagggggatgggaccccccaacacccactagcttagatctaaaaacacgacctcatggaaacttctaatgtgtttcccttttgtacagaaaggattataactgctaaagtgatttattttaaaaaataggccttaattctgatgtatgtacagcctgctagaaaggaaaagagggattgtcaagaaattaaattcttccttatgcaatagattgtcatttatattattataaccacagaccctgcattttctgtgagaaagccaaggcttggacaggctaacagtggtggaagacctttgtttttatcaaagcgtcagcaaaagcagaaacacattggccttttctgtgatcatctgggaactttagtggcctgaggacaaagagaatgagagagagaatgagccagtgagctagtgacctgatctctatttcaattctttaagtcttttgtagacattaatatcctggattgaagcagaagagtcatctctgtcttcagcgacagtgtaaggaaggaagggggaggtgacttaaggggtgagggtgctgtggggagggagaatgttgagaatgaagtggtgtttctatttatggttgtggttgtcaactttagaagtcctggcaagacttgagtatagtcaaccacccaactgagcctttcctgcacttgcttcctggattgcctgtaaatgaaaattgcataaagaccagaaatattataatagtacaggacagagaatcatctgagcctcccctccagctttaatatctaccaccttgttacaaaaccattatatacaatcacacactcactacaaaagtctgccctgcacttctggtgagatcctttattattatggtgtgtaatgatgtaatctttttctctattgtgtagccacagtctctttactgttgacatatgaaatactgcatctggagccaacactaaatatccctgactataccttcaaatgtgcggtcatctccagaaaatattgcctctaagttatcaatagaaggtattttctatttagttggcattcccagtgaatctgtttactgttaatttgcaggtagcatgcatcttgtcagagtgatatggtttggctatgtccccacccaaatatcatcttgaattgcatctcccataattctcatgtgtcttgaaagggacctgatgggaggcaattgaatcatgggggtgggtctgtcccatgctgttctcgtgatagtgaataagtctcacacgatctgaggttttttttttataaagagcagttcccctacacaagctctctcttgcacactgtcatgtaagaagtctctttgctcttccttcatcttccaccacaattgtgagacctcagccctgtgcaactgtgggtccgttaaacctgtttcctttataaactacccagtcttgggtatgtctttattagcagcatgagaacagactaataaacaagggtacctttgacattccagcttgagagcaaagagaggcagccctgccttagccatctcttcctggaatggtgtggatgtcagggagcagctcaacatgtgggctgtttcttgatcttttaagtcagacttcatagcatggctttgtcattttgtttgaagtaaatccttgaaacattagatgtttctatattgaaatgacatgcattccatagcccaaaagacataatttctgtgttatttacttgtagcctttcctctatgagtgaggacaagtgcaaggtgattttagaggtagatttatgtgcatattatgtaatcgtttatccctcacattatatcttcgttttcctgtgatgtcatggcagagggtggattaatcagtaaaatgtctaggattggattgagaatgagcagacacctatctcaggcacaacctgtgagccatgtgactttatttttctattgttcaatgaagtatacccttttagccctttctgtactgagtagcagaaaattaatctcctaccactctgggtaatctcagacaatggtgggtaatcacaaaaaattccacactttctctgtcacttcaggtctctcactttcctctcccttactcaggttgcatttgcctttctgggaaatagtggagagtgtgctgcaagttcaataaagtgccacagtgtggccttggtggtaatttctgtatgctggtggctgtccatcttcccagttgtccttggccaccactctattcaagtcataggtgtaccatcttgtgttcctaaccaagttctgccaccttcatatgtgtctccgcaagggtgtctttgcagctttggggacatggaaaatactgagactggcccccactgtctctgcgtagacatactatgcagagacatactattcccctactttattactcttgtgccattacaggcttgggattgctctgacttctggacaacttctctcgtcttccaagaaaggggtcctcaggattcttctttttgaaactctaagtctgagtcagggctctgtgtttccttaaccctcatacttgacctggggacaggttatagactcttcctgcctgtatctaaccatttttcccctcactgactctcttcctatttcctatggggacaggaagaacatgaaaaatgattttttctgatttcatcttcttccacatacttttcatcatatatgtggatcttggttttttttttccctccagctttttactgtaaaattttcaatatgaataaaagctgaaagaatactaacaatgaatattcatacactcaacacctagattcaacttctgcttaacatcttgttattgaaaaatacattgacagtatcatgttccttcactcccaaatttccagcatgtttttcctaaaactgaggacacagtgtcctaaaaccacagccacaataccattaccattgtgctcaaggaaattaagataaccctgtaataacagatattacctagactatcttcaaatttccccagtgatttaaaaatgccttttatagttacttatatatcaaaccaagatcaattcaaagttcatgcgttgcatttttttttttttattgagtttctttggtcccttgcagtctagaacatggcttctctttttccctgccttacactggctatttgaagagactaggcagttgtcctgtagaatgtccctcattctgtctctgtgtgattgttttctttggtattcttcaacttgccatttatcctctctatttcctataaactggaacttatttctaaaggtttggtcagattcaggtgagaggttttgggaagaaaacatcacagaagatgatgtgcacttcatctgtgtcacatctggaatcacattgtgtcaggttgttacactatcagtggaagttggatcaccttttgaagatagtgaccaccagataccagatcttttctttataaatacaagtttttccctttggaattcatagctggtttgtagggtgataatttgacatctagcaaatatcctctcctcctaaaacttgaacctactgggcttagcatactttcctaaaagctacttaatttctaagggttgcagaggtgtttttctaatccaatcatttcttctgtttttatttcattaatttttttttaaaggagagctttctggccttggccaagaatttcagctctttcattatagttctgtcttgatgactcttccttgaggcaatgattgggtgcttgggatccagctgcctacactagggagggtcataggattatagaaaaaaagttacagttaataggatcactatatcaaaaatattattttattataagagtatagttggtgggaatgcaaattagtacagccactatggagaacagtttggaagttcttcaaaaactaaaaattgagctaccatgtgatccagcaatcctactgctgggtatttacccaaaagaaaggaaatcagtatacggaagagatatccacactcctatgtttgttgcagcactgttcacaatagctaagatttgaaagcaacttgtgtccatcagcagatgaatggataaagaaactgtggtgcttgtacacaatagagtactattcagccataaaaaggaatgagattcagtcatttgcaccaacatggatggaactggggtcattatgttaagttaaataagccaggcacagaaagacaaacatagcatattctcacttatttgtagaatataaaagccaaaacaattgaactcatggacacagacagtagaaggtgaccagaggctgggaagggtagtgagggatgcggaggttgtgaggatggttaatgagtacaaaaacaccagaaagaatgaataagacctactgtctgatcgcacaacagagtgactatagtcaataataattgtagcttttaaaataatttaaagagtttaattggattgtttgcaactcaacggataaatgcttgaggggataaataccccattcttcatgatgtgcttatttcacattgcatgcctgtatcaaaacatctcatgtaccccataaatatgtacacccactatatgcccacaaaaattgaaaaacaataaataaaaaagagtataatgagcctaaatgctttcaggattcccttttgcattttgtggctggtggtagcatcaaagacagtgagagctagcagcaggtgagaaatcacttgcagcctttattttatagatgaggatggtgggcccagagaacttgagcgacttgcctgagggttacctggtttgtggccaatccaggggcagaagccaggtctcatgactccagcttcagtgttttctgctgtgaaactaagacttgtaagaagactccacaacacaacttatttccatgccatgttcactgcttgagcgtgtcatacgtgactagtattgtcttgcccctgggtaatgctatgtttctcaaagctggggacacttaagatctgtggtaacaagagagttttaggaggtgctcagggactaacattttaaattttggtaattctgttatctatttattttagtgttcattagaaaaaatatacctattacatcatactgttggtttcatcatattattgtttaggatgagactaaattaatataatagaaaaaattaaaaaatatggtttaaacaatttcatttcaacttaaattttaaaaagactattgggtaggactatccagtgcactgcaaatttaaaactgaacagaacaagctttccacctcatggagtttattaaagtttatgggaggggagagagaaaaacagagaaagaaatatagagaaatctacaggtgatggcaaatgctatgactgaaagtgaagcagggcaagagggctttgctgtgtttaaatagttaagaaaagctgctctgctacgatgacactggggccaagagtgagagaaagtgagggagggagctcgctgatgtcctggggaagagtgatctagacagaggaagagtgggtgcaagactaaggtggccagagcagagtgggggcctggggaggagagcagagagggatggaaatgcagctcactgagggacttgcagcatttaggagttttgttgttgttgttgttgttttgtttttttattcagagtgaggagtacttgtcttatccaaggtacttggatacgacagaaattgtgaaagtgtatggagagagattaaatgtgggcagcactgatgtaatgatgtattaaattaatttcttatactgaagcatgactgaagggaaagatatctcatgcggggagagttcctcatacaagagtatggaggaaacttcacttcagggtcatgatcagcttcattttgagaggagaatccacccctcaacacacatacacacactcaacacacaaacacacacacataaaacacacacatacacacaacatacacacattcaatgcacacaaaccacacacattcaacacacttttaatacatacattcaacacacagatacatacataacatgcacattcaccacatacaacacacacacaacacataatatgcacacattcaacacacacacttttaaaacacacgttcgacacacacatacacacaagacccacatgtattcaatatacagaaaacacctgcactcatcccagaatgatggcttgaggtttctaggtgtctgcggttcccctgggtcatagtgtacactcctggcatgttgtaattgttacccatcacatggccatggccacttgagactagaaagggataggacccagactttgacttatgtcttgactttttcttgaaattcttctcatcttcagcctgattccttttatacagtctaatctactctaaggcctgggatattatatcattaattgcaaggctaatataatttgagtaaaattttctcttcttgagatcttagttgctattgggagaaaaatgacactgaaaactcagctgatgcattttcagagtgaacaaagacattgtgagaattttatttttcctcctcacaatggttaaacattaagtagaacccatccatgctttttgcatagcattccttttggctgaaaagataaggatgaaactaagattttaagactcaagatttttgaggccatgtatttgcagagagaaaagagcacttgatttttctgtttattgtcctcctgacaaattattaatagtactttgccgtctttgtctgaattaatctttcttgaatcaccattggtgatggtgatagtggagatctaattatccaaatctcctaaaatatggttttctgtctcacacatttagcctaggaatgactgagtgtcacagtgcttcatctccccttcttaatctctctatattttggaaaatagttgattggctgtcaccttttgggatctcctatcttcttcccacatatttccccatactacgtctctctctcctctggtcctgcatgttgtgaaacagtgtcttctacctcttttcccccaaatatctgggaattcgattcttcttaattcttcattactgtcatatagctctttctctttacaaattgctcaatagtacatatttattctagtctgatttatttcccatcacctaaaatgcttatgggttagcaaactcagagacactaactcagatattaccagaaaaccagcatgtttgaaaagatggatctgctgtgtacagacttgcataatggaaacctaagaatggaaaataagggctatagtcttggataatcccattcattggcatgggctctcaaaaatcaataatgttaagtttgctttgacttctcagttccctctctagccagaatcttacactacagaacagattcttaccaatttcaacaattttcaattacaaaacaatgcaaggaaaaacagaaaagaagtctaatcagattcagaattttcagaattcaaatatgccaagtgtaggaaatgccaagtctaagtagcttagttcaatcactttagcactgattgtagcaaatgtttcaccttaaaatgatagttcattgtagctattttgtaactgtagtaattgttgagaattttgtttgtggaagacactcagtcattcctaggctaaatcctctccccttgccaagcccctccctccgcaggggtttttctttcatctcttgagctactgcagtgtcctctgaacccctgagatggaaaacatcccctgacccttggtggcaggtactgtagttacttattattcacttatttaaaaatggacatcatatctaggtgcaaaaacttaaggtgcccattaatcatcaatatgatctctctgttgggacccccagaaattcatcatgacttttgttttgacgtatctggttattcagtgtttgtaggtgtcaaagaaaaccagagctcaggactattgcaatatggaaaaagagagctcagtatggaactgggctcaactctgcatacagcatggacatgtgggaattcatagccaagaagcagggtgggtggcagtggatgggaaattactaagaggaaacatcaggggtaaggggggatcctggataaaccaatgtaacaggactggttctgagggcaggccagggtgatagacatcccctgcgggacagtagaggatgaggaacctgattagatgtggaggacaatcagatatggaagattttggcttaaccaacttaataggattcttaccaatccaaggcagacgaacgtggaagtccaaaagtcaggcctacttgagaaagagttcaggggagcccaagcagaggttggtcaaggagaggatctttgtcgtagggtgtactctgctcttccagttctagtcttccagatgtgttgacgtaattgccttaaattgtacgtggtcaaattataaacattattgaaaaaattttaaaaggcagtgtatggaactacttactaccctaacaaattaattgcatgtgttacttaaaaatattctgatatctcacatttctataatcattcataatagtacattagttaatcctaaaatcttatgacccaatctacctacccaattggctgtctccattgagtccctgaatgatcacctgaagttaagccagatttcctttctatagataaagatgtagaggcataagaaattctattttttaaatgacaagaatttatttgaataaggcagagtcttgaatctctgtactatagatctgtgttaaccaaatgcattgacgatacaattcaattcaaacagcatcccagaaatctcagagtggtgttgttggttaaatgaatatgcacatatgaaagagccaaggacttattgctgccagtgtttctcttggtttttaaggagttagccagtgctctttcccatgacttcagtctgagcagggtctgtgccctccattagggaccagcacaacgttcttcagcagaaaaccacaacagtagtgggttgaggagctcattttttgatgcctgaaggcaaaccttcaaaattgaattttatactgtcaggaagtattgattgcaaacttattcctttataaatcaccaaagggaaaaatgacttgatttacagttaaatgcatatcatttggtgatgagcaaactcctgtgagctaaaggaagaggtgacacagacacgtttccacagcattttcttgattcatattgcaactgtcgtcagtgctctgctcaggtaccctctgactccctttactggccttgtgtgctcaccctggcttctgcatatgtttgcttctgagggtcacgcacctggaaccttgttcagagggctggacttgagctagtggagctcctccccactcctggcatgtgcatgagaacacacacacacacacacacacacacacacacacacacacaaacacacagctggaagcagctgggagttaagtgccttccactcccttccctcaaccctttgccaggttttgctgatgagtggtgaaggagtatgaaaggtcaccctcttgtcttaagactgggcaaactctgtggtataatttacaagttctctgcaggatctgtggtataatttacacaccacagctctctgtagaatcaggctgaggctgagatttcacctgaagttgcaatcttgcctggcttcttcctcccctccctgttcccctctcctgggagcccctccttaataaatcacttgccatgaacactccactctgggtctacttctgaggaactggccaaagacagtgttggaacactaagaaatttaatatgttatttgatgccttttatcagcatctttaaaactatttctgtctctcatttgctaatttggactttatatgtgcaagtgggggaatcttaaaagttaatttaaaaatgaattgaggtgtagattatagttaccatttactgagagggccgttgtgggccaggtccttgacatatttttttccacgtttcataataatcttgctttttaaggatgagttaattgaagtccagagaaatttattaatgtgcccaagtcacagagctagtaattggtagaaccacaatacaagcccagatcttgtgatgttgatgtgttagctcttccaacctccctgctaactctcctttcccccctgggtattaaaacttctatttctagagctatcaaggaggcattctggcatcaaagtttatgacttactaaaatgaaaggagactgtctctttaggaagagataaaatacattagaaaatgccagacttaatttcccagaatgggagtgattgaaaataatttctaataagagcttgagtcatgtcactttgttgtatacagagagacttttgtgcgatgtttgacagaatctgggtggttcatagaaacacaaaattattcagcaggtgacaacgggacagggcattagcaatgagatttgagagcaggagatggaaatttctttcgtggctctccctttgaggtggtcacgctcggtcctgtgactatagtgtaccacagtgctgtttagaaaatgacttcctcggccctgaaatggaccacagtgtcctgaaagccctaactcatcacatagaagttatcagtccattgcagggaggttctttaagaaaatgaagggataatggcaatgatggcatggccatctagatggacttccttctagtgtccgtattgggacctgattgaattattcactgctgacacaagccctctacacaagttaaaaattcagcaaaaatacacaaaagccatactagagacctttaaagtttctgtatggtgaagtcatcagcatttatcgcagactgtacctagtctttctttctggaatgttcttcctccatccatctgcctggttatttcttacttggctttttaagatgaagctcaggtgtcacttccttcaggaatgcttctctgatccccacaacatggacaaagtccctttttagtaaatttgtgtgatcgtgtgtaatcatctagaaaaaaaatgcttagcttatcatattgaaagaatatgttttcctgttaatcttcccactaaccatctgagggccacttcggggtatcgtttgagaggtcagcattgtaatggtaaatctgaaatggtaaagagtaaaatgaagtattttatttttattgtatttttgcctttgaggcaagatagagtagcagaaggagcaggggctgaggttttactccaagctttcctatgttcttcttctgtgactcaacctctctaaattttattttctttcactgtgaagtcacatgccagcaccaaagttagggaagattcctgagaatggtctaaaggttaataagatactgcccagcaaatatttggtgttccataaagtttcataaagcatacctcagatggacaatgatggggaaataggtttgttaacagtggacatgcatccatttacttgttctccctataaacaatttttttttttgagacagagtctcactctgtcatcacccaggctggactgcagtggcaggatcccagctgattgaaacctccgcctcctgggttcaagcaatttttgtgccttggcctcctgatgtagctgggattacaggcatatgccaccaagcctggctaatttttagtagaggcagggtttcaccatgttggccaggctggtttcaaacttctggccttaagcaatctgcccacctcggcctcccaaggtgctgataaacattttactgagcatgtacaatatgccagccacagggaatctacatgtgtacatcatacctgtgtgatgtacctctagaagtttgtagtctagaggaggcctgacatcccagcagcttctatggtggctaatgtaagaagccccacaaaagagggggatgattcattgtctacagaaatcagggaattcttcacagcagagtccaccctccagtggggtctgaaagagtgagtaagagatctctgcacagacgagatggagaaggaggcagtgttacttactgaggcatgaaggctcgtgttggggtggcatggatattgatggagtgtaagatatgagagaacagtggcaggggacgatgatggagagacagacaagggtcaaggtgcagaaggcctttgtgccctgctgtggggtttggagttgatactgcaggcacagcagagccactgaatttagtgattggtaacaaaatagttaaattgagagtgctagaatgtctaaatgtgaagagtgatcatgtttatatagatttcttagctcctgccaagcctttttttttactttcttaatttggtattaaagttggaagtgattaataaagtgataacattactaatttttaaaacattctggtctcctggccttcacattgttttaatggactgtaaatgcttgcatgggcatgcttgttaaatgactaatgtggaatccattcattccttcaacatctatttattgagagcctgctctggactcttatagaccctgaggatggttagagtccctgcctggtggagcctccattgccatggggcagatggcaagactaataaatatataagggctatagaaattatggcatgggaagaacacagcagtgatggaggggtgaggggagtccttctttaaggaagtgctctctctacctgactatgaagaggagggattagtgcggggttccctgtttaggaaatcttaaatcttactgtttttccattgctgattttaacgttcttggagtttagtaagtagtaggttctcctctcttttctctctctctctctcaaaggcaaaatgaaaactatatttatcaccacttatggggcacgtctgaagttcgctgtaggaaaataaattttctaccttacaaatatttctttgctgggatttatgcagaaggtttatgatagccagtttctaatctagaaatcacagaattggatttgagaataaaagcatcttttttttcccctttcacttcaaaaagaacacttaacactctttctcttttttcaattgagtccctactctgtgcttggttttgtgctaagtgctttatgcatacaatctctcaactcctcaacatgtctctgtgagatatgcatcatcatcttcgttttgtaactgaggacattgagactcagggagattttgctgatctgccaaggtttgtggctcctaacgtcaagtctgcctcaggacagtcatgtcctaactactgtgccttcctgccctcccctatggcctggtttcatttcttcctttgtttattctcctgtgaccctctctgtctaaatattttctttctctccctcattcatttggcaaatgtcatctattgagatggcaaacatacccagactgctgggcagtcactgggaggggatattcaggcttcaatggaggggactggacccatattgagttctgaaacatggacaaagtcagaaacgagggccaatggccttgtctccaagagtggttttcagtgagatggatgctgccccggccagttttcaagggacacagattgacctcacttctgaatctcaacagacaggatggagaggggtctccatgtctggcacttcatgtactttgtctcgcttagttttatccatggaaacatttggtagatgtcattgaccctttctgcacataaagaactggaggctcagagaggttatgtgacttgcccaaagctgcaaggctgttccaggtggtactgatttcaacacacagctcatttccagaatccaaaatcttagtgctggagctgtcattctcaaagtggatcccttagaacactagcattggggaaaaggctggtttctgtagtccagtgtagcaaatggagctttccatagcccgtcttggagaaacacattctgcgtcagcatattatagggtccataggaatcttttaattctatttaaaccagattcacaaagtgtatttaaccacagaaatcttttcaaaagaaatagtcactaacataatgagaaactagcgcatggaataatgacatacaccttactgtctccccagttgtaattttggtagagagaggatgaagagagagaggttaggaaggaaaaaagaagacaaaaagaaaaaaagacagtggtggaaggaaaagggacacaggaggtactcaaatatttcacaataaaattctaaaataccttgtcagtttttcttttatttccgagccttctttcttgtgcttttcaaattggtacacaaatgtttccctaagtatataagatgagatagaaagattaatctctttgggctgatgacagtcttaaataatggtccatgaggctgagagaggccgtctgtgcaggtgaccaagccctaacaccaagatgtgggagctgagaggtggcatagggcctgggcctagaggcacctgctcctctccctcattgcccagagagaattgaatctgctttccttggctcccacagcaaggaggtgacagagcggggacaactccagcctcttgactcccagcccagtgtgtttttccctgcagcacatttattttttttcagagtctgtcttatgctcacatattattttccctgttatgcttagcccatcagcatttgcttagccagagatattgccagcaacataaaccataaagattgtaatttgcctggtttattgcttgctacagtccacagactcttggcgtaacctaggacgggcttctcctgcatatttcttttgctcttggttctttgaatagaatgtgtatataatttggaatcaagacaaatttataatcaatattgatatttttctcttataaatatgcatatattcctaatcagatatttaaatggacttcctgggttgttatggatatttttattaaacattttatagtttatgcagatataagagtgacaatatgtatacagtttatatttagttgctgttagacccttgctctcaaaatgtggtccttggaccaatatcacttaggaactttttcaaaatacagatctggggcctcatcccagacctactgaattcaaatctgaattttaatgaaattctcaggtgatttatatgctctttaaaatttgagaagccctgatctagagtacacaaaaaacattaaggccagtcttcgttttgttcatgcccatttttcccagttgcacatttatatctttgacagagtgcaacagctctgcacttttcatcttagaaacttcattgtgggctgttttctacattattacctaagagagtatctataaagcatctctgaggcacacagttggtacctgtctatctatccaactagatggatagataggtaggtagagagatagatatagatataaatataaatataaatatagatacagactgtttaaaagctttgttatttatttatttattttttcttttgagacagagtctcactctgtcgcccaggctggagtgcagcagcatgatctcagctcactgcaacctctgcctcccaggttcaagcgattcttatgcctcagtctcctgagtagctgagattacaggcatgtgccaccacacccagctaatttttatatttttagtagagatggagtttcaccatgttggccaggctggtgtcgaactcctgacctcaagtgatccgcccaccttggcttcccaatgtgctgggattacaggtgtgagccaccatgtctggcctgtttcttaaaagctttattaaaaactatgaaatgtctaagatcttaccctactttcaagctaacaagttagcctgccatgatttcatagatgatggcagaagacatgagattttggggtcagagacagaggactctattacttttacacagcatgtggcatgaacagcatatttgtatcaattctctcttccaaaaccccatgagtgtgaggcaggtgggacccaatggatgcctgcacattctctggattgtgttataggagaggaaccctgaatttagggaatctgaatcttttaaaatggacagtaattatgcctgctctttgttttggagacactttattttggaaggctgttcactatacaaacatctttgaaaagataatccaaaacaaagggcagtcagtacctttctttgtgagatatacagaagtgctagagagaactgtctcctcctaataggtattagaacatctttatcattgggttttaggaccaataaatattttctggtggccatggaagatatatttcctaatacctagattgtactcatggttgtttctatcagaaactttgaggggaaacttccagtctgggcattcagttaagccccttacaggaaaagagaagttatagaaaggaaacaagtggggttgtgcatcataaatagtagagtcactggtagctcttcctagtgttggttgtcccattttagtacagaacctcctcttattctcaagatgagagatgtgacaccgttcagagaactctggagaaactctaacggatgtttacaagattggaaaatagtagtaggaagaaaagcagagataaattggggttaataatcattttctaatacagtagtcttgttgtccctaaatgggttatcatgcaaaacagttaatttccctttgctctgggtgtccacaaagagcctgaaactttcagaaatattgtagaacagatttcttctttgactcagagtgtttctcagctctcaaagaacaagagagtttggagaaggaaaaacgaatagttttacacagcatatgacaatagtatgctgagaaatgttcaggaactagtactcaaggatacagtggggttggggtcctaatttgtaatgtttgctgatttccgcggtgtaaacattcccaccatgaagtcagccagctcaaaaaagtcctgaaaattagacaaagaagtacgagctgtctctagcaagccattgcaaaacagtcataattagcaatttttcgacagtaaaggtagtttgatcatgcaagaggtttgtttgtagaaactcttttttgcaagaccttttaaaataatatatgttctctttgcccccggtgattcaagctagatttaccttaaggtaggatgacagcctacatgatcttttgaagttcgtttcaacagtgcaatttgatttttcgaaaaagctttcctgtctggtgcagtggctcacgcctgtaatgtcaacattttgggaggcagaagcgggtggactgcttgagctcaggagttcgagaccagcctgggcaaaatgacaaagcgctgtccctacaaaaagttacaaaaattagcccagagtggtggcgggcacctgtcgtcccagctacttaggggactggggtgagagaatcgcttgagcctgggaggcagaggttgcagagagccgagatcataccactgtactccatcctgggtgacagattaagaccctgtctaaataaacaaaaacaaaaacaaagccttccttaaattgtgggtttaactagctgatttgcttcctttaaataaattggccaccagctcagcttatttctctcctatggaagggcctgtaggtgcagtctgattgtcactgatatttttagagaagcaggaggttattcagacttaaccaaccagtgatgattccttatacttgggttatatgtagaaccgtagtgaattacaactttggacacaaggtgcctgcatcgttggttggactgagatcatggtaaatcttctctgcactaatgaggctttgtgcctcttcaagagacttaccctggaattccctctgggctcagtttggctgtcgattctgtaaagtccctctctggagggctctattgctgtgttgacagcaacattttcccagagaatataacagtggcccacacactgcagcttcagtgaagctcatgatgagtaagcctccctcctgcctgaactgtgcagttcccgctggtggactgtgccttcacggacaccgtgcaatgtccctatcttctggtgtgtccgtgcctgtcatgtggagtttgatacagtggactgatttcttctctgctgtgtcctctccctcctcaatgttgagggatatgtggagagagcaaacttgctgcacttagcccaccccagtgagatgcccttttcatagccttaacaggctggtcttttcttctcccagcatttaacagaagggaggacctcgactttaatgcagatttgagtgcctccttccctctcccttgggtaatattgattagaaggcttcaattacttatttatcagatttataaaatgcttatcttgccaaggtctctgggcacatggacaagagtaaaaataaacaacaagcaataataataataaaaatccaccaaacataggtgctcattctgaaggctctacatgaatgccattggaagcctggtgacattgatttagagcttccattaccacttgactttttttttcttttctttttataaaacacacccacgtccaagggggcttgttctcctgcataaagcaaatgcattaacaagcaaagagatggaacacatagatttgctgttgaggctaaggccaaattgcaaagaactcatatgccatgttgcagagatcagtttccaaccccctcatcttttcttttgtggtgaaggcaaaaatagaagtgaatcttaaaagagggctttgtattgtctgtcccaaatttttgtctagacacactgagacaaattagcttcaaaagagttttcttgttctgcaaaaggggcagaattctctgaggagggtgtgctatgtcatgccgtagggttgctgcacctttttttgtttttttgacactgacacaagaacatcacagtagttgtgggttgtttaaaggcttagctgtgtgctgatgatattgtttctcctcaactgttcaagatcaagaaggtgaggcatttaattagatcagaaaagagtgagcaagtttgaagaacttttctcaacgtgtcagatctgaaatcttaattccatgctggactttctctctggagaagcctccttctgtattcctgtttacttctgataagagtaaacaaatggtagaaatgctaaaagggaaccaagatactctggaccaccaacacgtccagcattaacaacccacaccactagtgggtcaggttagcatttctggcagctagcctttatgattagaaaataaggcattataatgggactctgcggttttttttttccttaaaaatctggttttgattattaacactcttgccattagggaacatttggtctgagctacgtgttagagttccaccagtacaagggaagaaaaaaaacctgagctatccccttaaaacagttgtcatactatgaaccccaggctcaatctgaccagttgtttgtttttgtaaataaagttttattggaatacagccccattcattcatttatggattatctatggctgctttcatggtacagcagcagagttgagtagctgtgacagagaccttatgtctcagaaaacctaaaatgtttactctctggcccttcacagaaaaggtttgctgacccctgccttaatggaacacataagcaaaatatctaatgaaataaccatccacctcccggacttccacatattttgtaataggttgtggagatggggatcttgcccggttcagcttctctgttttagtcaggccagtccctaaatcaacgtaggcagatgcacaagcagtgagatgggagcagaagttcaaacttaggggaataccaaggtccagctctgcgcaactttaccttaagagtctgtgattccctctgtgtacacttccatttcatatactaacatgggtactgtgtaaaaagagaaagagacaccttcaaagctaccatcaggggtagcgaatggtgctagacctcactggtccatagttcctacttgattaggtctcagttaagagctagtatattagatggttatacatggaaacataggtggatgttttttcctctctaaaagaaagctatgagctatgaagttttctggcttggatgggtcagtgataatttcaggggtatggcagactttgtgatattttcttgggaagtaaaagaaaaaaggtatggttctgataaatattctgtcaggaattctatatttgagtcttttttttgttataacatcacactaattttttttatacaaaagactgtcagggttcagggtgcaaaagggtaaatgtgcagtctttgtatgttccattgtcttttcttcctctcttcataacttttgcagagaaggccagccttgtttgtatgttccggtgtccaaaccttatgtgtacaaagtaactgtgtggttcagtcagaagaaaggtgataggagttttgagaaactggcattttgaaaaagggcaattcctgcctctgtaggagtcttagtacttttaggatgtcttaggagaacatacaactgaacaccacctctaaaattaatttctacttacagctgagtgtttttatgtatatgttttgttgacgcttcttaagagttcataacattctctggtatatcatacttttcagatcataagtatacttttttcttactcatataataacttttcatatatacaaacatctaattcaagaattacccattaaagacctagccttttttgcttcccgttgaaaatgtgaattttgagattaataaataatgtattttagtcatttcagtataacattcttaactttgccggttaaaaacaatacctattttcaatgagatgaatgccccctggtggaaacagtggcaaatatttgcactgatttggggggcccacagacaacaagaacaagcatatcaagtgtaatgatggaacaatgtaggcatataattgacatagcttagagagtgtctttagttttttaagtctatacttcatttaaatgcagtaaatagaagataacatcaaattgggagggtcaaaacattcaacaaggaactaactaaacccttattatggcaatttctctagcgtctttcttttcagcttgggaatctcttagctagtaaagtcatttatatcaaggctcttcgtaacgattttttaatggaggaattttcaataataccttggagggtgttctaaaactaaatagttgtataagagagaattgcttaaaggattataagatggcctccaagaaaacacacacacacacacacacacacacacacaaacacacacacccacaaacaaacacgtcagtgggtgagaggagcaggttttgggatttaagcttcaccaatgacaactttatgttgtttgtctcgttaactgccagacaatccatctctggttccatagggaatgcttaccaagccaggcatgtgagcttgccaggactcatgtttttatagaaagctttattttggaaatttctaatctgaacatacttgaaatctaattctcagaaaactttggaaaaccatttaaaaggaagcaggaaaagggaaaagcaaaagtgaagtatgaggctgtatcccctctataggaaacggaactgtgaagaagcagaggttgctggcacgttctgcggctctcccctctgccccgtcatacctagctttgctgtggctgtcgctctagcagaaaagctgtggtattttttctgcctctgcaattttcccacttggatggagcctttggaaatgaaaaaaacaaataatcaagagccatcttgtattgaaagctgatgttctgcatacttaatgggctgaatcaccctttcccttttcagatatggctcatgtccattaagccgtggatatggctgataaataccattgtacttgtcatatcaccaagtgccacattttccgaggcagtgacgtttctttacctcagcatttgtgagagattgcactctggagtataacggttcaggctgaagttgtctattaacttgaaaggacttagagatatgttaatggctgggtgggaactcagttctttagaaattcttcttaaaccagtacctttcatcaagtcacgatgcttaatcttatgttatccgtggcttatgtcctgaagtgggtgggaaatggggcttgacttccccaaatgtaagaagtgtaatatacaatacttctcacatatgagagatcaagagaaactactgaagcttccagtagatattccagaacttgtttctttgataagaaataggctgttctcctactgtgaatgtcctctcgctgtcccacctcccagcatgagagacccctaaaatataatgcaacaaatgctcttaatgacattgcctctcacagatgtttatttagaagaactgtgaagggtgacctgtgaagggacattttgtgtgtctagggattgactttcccttcttgacagtgctctttatcacaatgtatttttgtatctgtatcacatttttgtgtctgtattgcaatgtatattttgttgaaatggttttggactctaaacagggttacccagcttgatcactcacgttctttacttgacttggctctgaataattctcagacatttcctgagtcagattcatccctgaagggttagtatctactgtcagggatttcaacttaattttattcactttcagatatgtgtctgtatcaggcattgggttagatggtcctatttcccagggaatgacactttggagggaaaatgtgaagtcagtggatactttaaatagagtttgaaaggtgcctagaaaatggtcctcagagatgggcattgaaggaggctttgggatttgcagagtgtgagagttggggaaagagcatggagaagagagagggatggattccaggtagaaattttatgtcccaagatgtgaaagtgtaagaaaatgtgtggcattcatacatttgctaggagtctggtttggcttgagcagagaacgggggtagagaattgggagaagagactgctgggttgtgggggcagggcatgaagggggctagggagttgacagtatggacagaatttatcccaaagacttcgcatggaggagtaccctaattaagtgtatgctatagaaagaagacttggcagcatgaggagatggaggttggaagactggggtgtgatgggaggtgggactgccactgggttagatcaagttcaaataactcagtctaatattagcaggctgtaaaggtaagattagaaaatgaatcccaaaaatgttgtgggcaaaggcagcaaggttgaaagaagctgtatggcctgagggaaaggcagaggggagtcagatgagtctgagttcaaaacctagcactgccggttactagttgtatgacctccaatagtctcacctgtctttaaattttttaaattgagaaataataattgtgcatatttatgagatacatagtgatgcgtgatacaaataatgcatagtgatcagatcagcatatccatcatctcaaatatttatcatttcttcatagtgggaatgttcaatatcttcctcccagctatttgaaactgtatgttattgttaactctagttccagtcctcacctttctttgctggctttccatcttctggacaatgggaatggtactctttcttcatggtgctgtggtggaagtgaaattagattatgcatgttacaggggtagagtttgatagtcactctttgaggacacatgagtgtgcctgtgtacatttgggtacgtgtatgaagaaaggagagacagaggacctccattcagacatcgattttctctgtgcttatttaaaactcttcattcacatgctgcacactcaacaaatacttatttagtggtacacacatgcaaggtgccagctaaggactctgttccctttagtgacatctcctgagggggtgagggcagaagatgtttaataaattaatgttggtcaactaattcatgcccacatatgatgacaaaagtgtctaatagccagtacaagtcaaaatactagaaaaccatccatctgagttattaacattttaatttagatcaatagggaaaaataagtccttagggggtttatttatatccttagtgagtgtttttttcttctcgcaatttagtttccttgagaactgaacatttataaagtgtttttggtgaacccatttatacagtagaattcattttctctaggaggttgggaactacagagagaaaccagagagtcataaattctatttaattcaagttcatgcatttcactagagaaagcaccttctttatcctcttattgtacttcccctgagacctctgaacagatgatgttagcagtgatttaaaaatgcaaatcatatcacagaagtcctttaaaggattgttcctcactcctcctcccaccctccatcacacaggcccttaaacaacaggaatggtaaattcaaaaccaaaacttgcgtcataggtaaaaaccaactatttgctgaaataggctgtaccagtctggctattttgatcacccatgatagttggaagacagaggatctatattctaaatctgatgaatgtatttactattcacattacatgtttgaggtgagcctgctatatgtacatgtggagaaagaagtgtggttataaggcaaaataaatagtagcccttgcagtcaagtggcttccgtggatcaagagctcgtataactcattttccagaagaagggcagatgcattgcagtgggagttcatagagaaagattactcttggctcatgctattgagatacttttatggaggaattagtttcaagttgtgcctcgaaaatattggcctgtagaatcttccagtttgagaagtccctaattacacagtgtttatgggcatgatttttaattgtgtactgcaccttatttcttcctatgagatttttattcattctttaataactcacactacatttgaaaactgttcttgggaggtatttaagaagagttgtgggactaactcttcttaaaacataaattttgagagtcagggatggctagtcattgtggacaaaggatgaactgaggttctttcattcccagccaagctggtgacttgcacacaagcgccatgctatcagagcctctccccaggcagtgtgcaccagaatttattgcaacctcagtgtgaaaggaactgagaaatcctttggcaacatgacctgggaattccaaaagtcgcccatgcctttgtataaaaccaaggaaaccagagcacattcagccactgtatgagcctgcagtcccttatgctgatccctgccaatcccatctcatctgagcctcacattcccacagtcccctgaagcttaatcaagttggtaaaatttatgtgtgttccttagaataaccatcacaacaattattgctattatttatggagcacttgcttgtttctaagcatgtttccatgcactttgcatgcattatcccatgtaataccctaaacaacctcatgagttaaacaatgagactgagatacgaagaggtgcagtaacctacctggcctcacctgtgtgtagggggtgagtggcaataccaggatccaagcctaggcttacaaatttgcagcgatcttcaagattattatttattttaattattcatttctctttgttcttgttgttattttgatccatctgtctctacttctggttcctttttgctgtttttctccaaaataggatatgttgttttctttatctcagtagacatcttttaattattttagcctaataatacttaagggggaaaaacaaaaaccctacgaaaagaaaagtattatcttaaaacttaaataggttcagtgggaaaaaatcttggttcagaggaaggctttatgttgcacatgtttgaattatggacttaccgctcccagtggccaccacgtgtgtgtgcttgcaaactcattttttgctttgagaaactgtggacatgtaagagtgaaggtggcagctctactacaaagaattttgcatgagtgatcctgaaaaatatgtcgaaaatccactctcgattttcatctttttaaattgacattttattgtccttgaaccaagaaagaagccattctgtttctctgctggttagacttttggaagcttgaaatggtgctatcaaagacaatgcagattaaaaaaaatgaccagtcaggtgggcgcggtggctcacacctataatcccagcactttgggaggtggaggcggatggatcaccagaggtcaggagttcaagatcagcctgaccaacatggtgaaaccccgtctctactaaaaatacaaaaattggccaggcgtggtggcaggcacctataatcccagctacgtgggaggctgaggcaggagaatcgcttgaacttgggaggtggaggttgcagtgagctgagatcacaccactgcactccagcctgggcgacaagaggaaaactccgtctaaaacaaacaaacaaacaaacaaaacaaacaaacaaacaaacaaaaaacaggcacaaaataatctcctgggtagcaacagagacaactaaacaaggtcaactcagtagactctagacccgggggacatgggttctagactgagttaatcactggctctttattcatccataaaattaggatgacatgaactgatccctcacttattcagggtaccaggtcatggcgaaatgctgctgcataaacagtaatgactctgtcaatggaggtgtcttagtaaactctctatattctttctcatctcatcttctcaaatattagaagtcaggcaaaaccctcattttcagttctaatgttcaccttattagctatgtgacctatggtgaatttcttaatatctcaaagcaaaataagtatttcttcaattgcaaaaataaatggtgataataatagctcctactgtatagagttgttgtgaggattaaataagggactatctataaatcccttggtatggtgggcaatatagtgtatggagaggtgatctaacttaccagtgaagagcaggactatggagacagacttctcgagtttgaatgctagctccagcatttaccaaatctgtggccttggtcatgttattcacctttctgtgcctcagtttcgcacctctaaaagggcataatcacaatgctacttataaggctattatgaggattaaatgaattaatatatgataagcacttagaagaaagctaaaaagcttggcatatggtttgtgccatgtatcaggtattactatggtacataataagcataagagtaacatccaataagtatattatcatcatcacgatcatcattatgttattacgttgtaattattgatcttggcgatccaaagcaaagtgactcatggagaatagttatacttagtagggacatgaaaatgaaattttaaaaattgggaaaataggaggaaaatgaaaatgaaattaacaaaaaagtataaattcagtagatgcagatcagagtcattgaaccagcctgtcatttctcaaacatgagctaagtgctgggactatagagaggagaaggtcatctttgagaagcacctggtgagtttgctgaaaagcaaacatcagagggcaatgtgacatgttgtgtcatcaatgtctatctgaggggttcagatgggggctcttccaccccagtcctagagaccagagcttgctttatgtagaagaagccacttgaacttggatgtagaggccaagagtctcccaggcagaacagtgggacaggaaattctgtgcagaggtttgagtgtgtgggatgagctcaaggtggggtgttctgtgggaacagcgtcctggatgatggagacacagcatgcatgaggagggggagcaaatggcagagtgggtgggggaattcgagaggtggcctgggatgggcctaaagtggatgttaggtagaagagggcttcctcagctttgcgagctaccttgagtttggtgcagggttccactcctcccagaccaggtggctacctcccaggcagtgagaaacaaggaattagaacacagcccacacccatccattaggaagtcattagcctagaggtaagtagcgcatcctctactttggctctgctgcgtgctcaccagagccaaagcttccgcttgttagctgggaagggcatagagaaaaagccattgagaaattgcttttaagggctttgtggtggccattgagagggtatttcagaggagtggcaaagcagaaaagccagctctcaaaccaagttgaagaacagctaggttctgatttgccaagagctgaggtatctgcctctcattcaatggcacgcagggggagagaagaaacagtgaggctaacagggacacacagagaggctactgcctgtcctcaggtatggctggaagagatgataacaccacagattggcctcaattcaagcaggttgtgaaatggctgagctgctggggaacagccagaagcctcggtgaggtgtactgaattaattgtatctgctccagatcttgagagcccagagccaattgtccagagcctttgccttcaagagttggaaggcagaatgtgctctgctgacctggccctcagaggcagctgcctacctgtccaccagcggaaaacaccgaggctcaaggtttggttagcaaagaaagacaagtttgaatgttagacctggaaaggggagtccaaggctgcctaggacagcttccttggggaagctgaggcccagcgtgacccatggacttgttaaaatcagcctggagtaaatagcagacctaaatccagaagaactggattttcctgatgctgcacatgtttcactatatgcgtctctgcagccttatccattctcccttagcccctctctctggtgcccttttttgccctctggccgcagagattgtcagtcaaatctaccttaaccctaagctttctgatcccttttctatcttcctacccataagagcatttcctgctcttttctcagagccttatttggtgattggtaactaaacagcttaagtgctagggtggcaatgtagtggatgtaggggatatgacattctattcctcctgggcaatacatttgccttttacaagataccttctcgctggattttcgttcaaatgttccacttattctcctgtctacattccaaactctatggtattgactggtgatgaagggaggtgatttgagaagggacattttttagtacggacatcctcctcagtgcatagacagactcttggtctgggaatctaagtggtctatatgccagtactctctcagagaacacttttagtcagaaaaatgaagtcaagcaaacgtttagtttaaaaaaatgaagtgcctaaagccttttatttgtcattaccttttaagtaaatttttaaggcagactaatcatcatccccacaaaagaggcaaagattatctgtctctccaaggcagttattcagttgattgtggatgaatttttgtctggctgttctaagcagtggataatgaaaaaaagcagagccttcttattgaacattttgacaagagaaattttgctgttactcaccaagatgtaggagggatgcagagtcctggcttgggtgagggacgaggttgctgaatagacgaacataaaaggaatccattaatgatttagaggactgcttaatttccctacttctgtaaccaagaaacagagcttgatcaatactctcaaggtcactgttgctatttgctatgcctgctggtcttttttagagttttgaaaaccatcctatgcatccatcctgataaatatgctcagttttggtacagggagatatggttttaagtgtggggcagatgagatgcagaaggaagaagtgtagcctttctttgtgggaatctgtagggaaatctaccacaaaattttcagttcaagatagaacctggggacacaagagagaaactctccttgtgatagccaatctgttctgataaggcagttattattactaaaaggatccctggctataacgtggattttaaagaacattattcaatgtgtttcctcttcaattacttctgtgtcataatttagctagctgtttgccttcaaatgtggcattggccccgtgggcttgcctagtagttcacatcatattctgtttgttcacttttgtatttgttggctaagttgacttttttagaataaagattctctaacttactaatgtcagagctttttaacgctgatactgaccaaaataagtgaaatgttcttttggtaacttatgcaaaaagttttaatgactgcacaacatgacattcaaaatggcaaccaagacatgaaagggggcctgtcctgtgacccccatccctccaaaaaatggatttccaaagtcctctcattacttgaggactttgaccagaacacctagattaactcttggagttaattgcctttgcaattatatgtataattgcaggtatatataatatacttatattttcttatgtctggattaattaaaaaggaaaaaaatgagtcaactgactattgtctctgtagcattctaaagcaagccttggttccatgcagcctcagaagctaacagaacccgcagtggtaagggccattttaaaaagttcatctgcatagagttctcctagatgtgggcacaaggtgtttgggggtggggggcacagacaccctgaaaagttccagagaacacatgtggtttccagtcaaaatatcatgcaaatattttgaaatattttcttgaccacagtatttcttctttatacattgctcgtagaagtaatgttttgttatttatttagaaaaaaagcaaatggagaaattcctctttctgattggattttatggtcctatgtggcaacaccctagagattagaatctcatagtttagtgagaaagacttttttagaatgatctctgaatttgaaagacatctaaaacacaactcaagcttgaaaaatgtctagacttttttttaacagacgaggccactgggaatatggtaaaacaacaagagatggtttagtttcagatgggaatttatttcttttaagcttgtcaatgagcagacaggcatttgagggggagtctctttgtcctgtgattccccagcctgggaagagaaagttatttttattcccagttttcatcatggaatgtgaaagaaaatctgactgttctttcattgagtgttgctgaattatcctcctggtttcaagtgtgaactacagcagcaattccactgtggaatattatgaacagagttaattataactgtttaatgaggcagatcccaattttcagtagatcatgacccttaatacattaaagaagagagacagttcacatttttattcaactgacatttgattaatatgcttcaaacaagttttggatatactgagataataatgaaatggactttatcctgttcataaaatgcctgtaataaaataaaaagtatcagtgttgttcttgttgttgactagctttctgatgtcagtttcaggttattaagggaaacttcagttaaaaatatcattggatttccctgaaggtcacaaagttagaacaaacactagccttcaccatcagtcaaattcagatgaaaattccttctctgccacctacttttgtccttgtacaataacaacaagaataatactaataataccatttactgagcaattatgagtttgagccatatgaacttgtcatttctgtaagctaagacagtggtcaaacgtagacattttcatatggttcagcctaatacatatactgaggcactgtactaaggctgtgtagatgtcatctcaattgattctttcaacacagttttaaggcaaatataataatcaccatttaaaaataagaatatctggccttacacaagattaagaaagttgcccaaggtcacaaattagtaaaatgaagacttaaaactctgagctatcttaggacctcaattttctctagtcacactataaaatagatattatataacttcccctagtcttaatttcctctgattgggaggtgcttctcatggtgaccaagatgtagtggttgctacataatgtgtagctgtaactaccatcagtatcatcaccatcatcaccatcattatcatcagggcctaaagtttcacttgctcaaggctgtgtacagagcgtgcacagttagagaatgaagagatgcaactggtgtgtacgtgtgtgttggtgggggtggttgctgagaggtcttttctctatttgcagtcacttcttgcaaaagccattgtgtttgagctgaacacttgcacatgcattttgcccactttgctattttcaaaacaaaagagaaattggaagaaaataccatattgagaacagaggtgcctgtgacaaattggattaattgaaaacaatccaaaaaaaaaattgccccagttagtaggagagtggagatcaaattagccatggagaatctaagtagaggattttattgattgctgtcggcataacctaaattgcagaatgtgagtcatcatgaaagcactactatgtctgcactgataattgagaggctgcatttttcatatggtcaagttggagatagtgagtgtggccacctggaatcttcccaaccgagtcccacaaacacctcactgcctcagccacctgccccatgcattcgcttcccaaggcacaaacacagatgataattttacaaaatatagtttttaaatggttgttttcctggatttgatttgatgtgcagcatacatgtagacttacactatgcagactgagctattttaatgagaaagaatgaagcatttccattttgttctatttcagagggagggaagaacaaataattctgttgttgctcgcagaaatgactataagacaggggtcagtacactgcagcccatgggccaaatatagttctataaataaagttttattggaatacagccacgtccatttgtttacatattgtcgatgcctgctcttgctctaaaacagcagagttgagtgactgctatggagcacatatcgaaggcagaactggaaatcctaattatctggccctttgcagaaaaaactgtgctgacctcttctatgcaaaatggagtggttttagacaactaagttgactttgtacaagctcaagctgcctttgttttgtgtccagtgttgcaagtttggcagtgaggtttggggatctcaggtgttgacgtgtatatctgccaggacgctgaaaatgtctacatccaggagtattttagccttcacctacagcatttggcagtagatacgaaccacatgttcagagagagagatttaatctatgaaaatacaaaattacaaggagattaggaagaagttgcctagaaataggcaggagccatcacccgaaaatgggggcatccttgtccgtggccgttggtgcatttgcttatatggacaggggcataggttgcaggttgctcttcattttcctttctgggagacagagaggaaacaggattaaaaggcagttcagatgagttaacatcatggcatagccaaaaaaccccagtgtaatgcaatactctttatacttagatatagctgagtttttattggctgtttggaattgggcatgttacttatcatctcagcggttttctcatctccaatatggaaataaaatacactttaaatgagctatgtataaaatgtgccttgcgcaatacagaatatagttagatgcataaaaatgttagttactctccctttttattgtctttcctctgtcacacacagagctttataattatggtagaggggcatatagtcaaaggaggggaaattcttgcatataaagggactttgggagtctaggacagaggttgaacctaatgctaagtaggttggaatttttttctccatgtcttgatctaaaaagaaatcacagaaatctcacctttatgtgtttccacctctctatatttggtaagaagataacatctcagtaaaatgaaatggtagacagaagcacaatctcatcaaagctgtgactgggaaaaatactgaaactcctccctagcctgggacttggaaacatctactgtcttaattccccctgtgccctccaccccccaaattaatgtctaccttgagctctcagctctgtccacgacagagagcttcatgtagtcgtttccaggtgaattggtcaaaactgggattatattccgactgcaagcataggcaagttcagggatctatctgttctctccaaagacagagggaagtgggaggacctcctgaggggtggtggcagctttcctgcatctactgaaacctactttgtcctgctgccaggtctttgctgttggcctctgccctaggtgcctccactgctgacactttcagacctgccgtgacccccaacactaagaccacataggctgtcccgtgtacccctcatcccaacacgcccagggacagtcttggccacgtctgtgcctcttttggggacagaggaactatggatgttctaacttactgccctgggctcttgggaaacgcgagggctgagtgaggtccctgcacatgctggtgcaggccgagcacagtgcagtctttcttctttcactggcactgagaagaggggacctatgtgtggctgctgcttcccagaggtctttatgggaagcagccccaggtctcttcaactctcaatcttcaaatgtcaagggggttctattgtttctcactgaccccaggagttagcctgagggttcgggcccccacagtgcctcatcctcagcgtctaactcactaaggtatctgctcacagtatagcttttctctgtgcagagctctcctctcccggaccccaaagtattttggctccttgctcatgcacctgagtacatcctccctctcttggccactgccatggccctttaagggaggtttggctgctctcctatggctctgttgggctgcaagtatgtaatatggacccttgcaccttgcatagagttccaggtgctatatagatgtcacaatgtcacttcaaagctgattacttttcttttttttttttttggtagtagctaagattctttaatttatagttgaccacatccctgctccctatctcacagaactgacgccaaggcctccatgaattgtgtcacatgggattgcattagctactgcaaccaacaaataaaaacagcaaccacttaaacagataggtttttttcgcacagcaagaattctgggatccagggttattaaggtggcttaatgttatcagggacattctggctctttccacctttcatatctgctatcctcagcatctaggccttctcctcttgtttgtgacctagtggtctcaaaaaggctgctttgcctcaagaccttaaaactatatcccaactagaaagaatgaagaaggataaggaggctttttcttttaattcaagattagaagatccttcccccttaccttctagctatatctcagtggccagagttatgtcacgagcccacacttagtttcaagaggtgctgggaaaaagtatattggatcctttccatccagggtagaggaagacaaaggaaagggggtttgtgaatggattttgaacagccaatctacaatatctgccaaaggtcagacagaggtccttagacagagagcagtaaagctatttcaaaagatggtattaatctatgatgtcataggattacaatttatttagcttttctgaaagttcaaaaactcttgctgattcagatcattaatttagtgaggaattgggttggtggaatattagggtatctttcatgaacaaaggaatttctaaattaatgactagtggaaacaagatgggtggtaggaatcatatatcaccatcttaggaaacaaactttttaagcattttcaaaggaatctcatgaaaacaattgatgaatcatataatcttaaattatttttttcttttgggtaaggctgaattaccccctacttgccaaaacatgctggaaatgttttattggcttaattttgattcctttatatatatgaaagtaataaagctgcatttctttaaatatatttcctaacttagagctttcataaattcacactggcttttatttctagtcttaataaattagattctaccgcatattgaatataccctgttaagtatattgaaacagtacgatgttcactgaaggaggaagcttaacatgggaaaaattaaagaaataaagagagcatcaggcaggtggttgcattacccaaaggtgagcaaattacagcccctgggccagatctcacctgctatctatttttcataaatttaagttttactggaacacaccgactcatttctcacatgttgtctatgttgctttcatactacaatggcagaatgagcagttgtggcagaaatggaatgacctgaaaatttgaaaattatttactatttgtccctttgcagaaaaagtttggtgatacctgcataactagttatgggggattccgtgaaagctgaacacagtgactggatccctcttctcttcatgtggaaattactttaatgtttaagtaaagtaacataataattactattattattactataataatgtatatataatatatatattatatatactatatattatatatattatatatactatatatactatatattatatataatatatatactatatattatatattatatatactataataatatatatattatatattatatattatatatactataatatatatattatatatactataataatatatatattatatattatatatactataatatatattatatatactataataatatatataatatatattatatatactataataatatatatattatatattatatatactataataatatatatattatatattatatatactataataatatatataatatagtaataattattattactataataattactaattactattaatatttactattagtaaaatatataaagtaaaatgtagcagtagtgtgttcaggactcctgggtatgagccattgggactgtcttagtcttgccgctataacaaagtatcacagactgggtggttgataaacaacagaaatttatttttcacagtcctggaggctgggaagtccgatatcaaggcaccagcagattcattgtcaggtgagggcccattttctggttcatagatggcaccttctcattgtgtcttcatctggtggaaggagcgcatgagctcccttgggcctcttttgtgaggacattaatttcattcatgagggctccaccctcatgacctagttattatacctcccaaatgccccacctgttaatatcatcacactgggaattaggtttcagcatatgaattttaggaggacacacacattcagaccataggaggggtattaattttcatatcaaaacaatgggttctgtttctgtcttcagctttagcctgtcatgaaagatggtctcaccatattgtatttcattctagcactgagtctgctgctgacacaatgacaggggccctgagtctgcccttggctggccctgtgccctggagcaagttacttaacctctcagaaacttaccttccttatgtcctaagtgaaagggtgatattgactgaagaaaatgggctatagggtctccaaatttcctttcttcacaaaagttcccggatacagtgataagacagcctatttcttatctgacacagatgattatttttatttacaatctcaacctgaattgtcttttccgtttggtgcgtatgttgaccagtgtgtcctaacaaagtagatctgtttcattcatttgcaactctttgtgaacataaagcatttgccacttcaaggacaaaagctgagacctaggtctgcagataatggaaacagctgatatttactgaacacctgctatatgccagacacttctaagtgctatatatatatatatatatatatatatatgcttatttaatctgcacatcagccccaaattaactattatcattagctccattttataggcaagaaaactgaggcaacttgcccaaggtcacacagtcatttgggtattccaccttcagggcccattctttcaaccactcttctttctgcctctcagtgggtcaggctttagcacagtggctgttctccatcttcacatcaatcaaggggaaaaacaggtatgagagatgcaggttggcattcctagaaattatgacacttgaaaattagaacaagactttcattcaccaaagatctactctgtgccttcaagatcatgcttcaaggctccttttctcagcctgctgttctcctaagtcagataaaaaaaaaattaggatgatagtggcaatgcaggttggaaactgggtcatttttctgaaatcatctttctttgccaatgccatttttgaattctttctgagaattaaaaaacaaacaagcaaacaaccgatgtggaacaatctgtggcagatggttatttcagctctaggtgagtttttgtcattatattctgggaagtggaaattattactttagataatcatctgttattttagtgaactgccagctaggaactattgtagctatacgggtttaggatggggattttttttttttcctagagattaggacataaattattttcatttgaattctgtggaatttttgatgttcagcatgggagggcattttcactatagttccttgctatgagaatgatctctggcatagaagaattggtattccgtgccattctactgaatataaacaagaaatctaacagttcagttgggggtgggagaggtgagatgaaattaggcttaaagaacaagttagcccacttttcaaggtttagcttcccctggaaaatacagcaataaacatctaaaccatgatattcattaccaacgcaagtccctaattaatttattttatgttaattaagtttataattatatagtaaaacatttactttctccctcaagaaattgactgaatcttctgaaggggctttgtgactgtaatttaggtgcaattagccagttaaatttagttagggtttggttcatttagctgctgccggaagatggaaacaggcactgtctcagaagcaagcctggatagagaggatgtgttcctggaggcactcctctcgcctttggacagctagttctgttgtctagaacaactggaagccgaagctctatcaagatatagtttctttctttttttttttgagatggagtctcgctctgtcgcccaggctggagtgcaatggcatgatttaggcccactgcaacctgtgcctcctgggttcaagtgattcttccggcctcagtctccggagtagctgggattacaggcacctgccatcacaccagctaattttgtatttttgtagagatggggttttaccatgttggccaggctggtcttgaactcctgacctcaggtgatctgcctgcctcggcctcccaaagtgctgggattacagatgtgggccaccgtgcctggccaagatgtagttttataattaccacctatgtgtatattcctcagtcgaggaatgcagagtcaattccacaataaaggatagaggcaaaccccttttgcaaaacatttccttgtggtcccagaattggaactaaagccatggaacagttctcagaccctttctaccatgggtgtgaaatcactggcatttgccagcattcagacacagagtgatatcagcagccaggacccaccatttggctggaaggacatcttacctcccgagaggggtcaagagggcacgagcccaccctgtaggtctctcaagctggggttctggggccttcctccaggaacctaaagacttctttcagtttgggccacccttttccaggaggaaattggaattttggggccactctttcagtttgggccacccttttccatggggaattggaatttttgagcaaagttcctttccatgactttttgcttcataactcatgacaaagaatgtgttttggcccatgatttacaatgcaattgatgtgatcatttgcagtggctgctgagctactgcaggcagggttggtgttcactgctcgtgcctgcgaatggaaagctggaaggcactaaggtactcacattagttctggttatcagaacctgttagattttttttcatctctattgtaaagttggataactgaggttcagagaggtcccctcacttggccagcatcacatagctcaggagggaaagggataggatccaaacgggtgtttctggttgtagactgcttcttgctgcctaaccagcggcaggtgggtttctttcaggcatcactgtagaaatgaatcctttagcacgaaatgcgtggaatgactgtactttttaaaattcaaattccagtggtactagttagtacagacagtccctgacttaggatggttcaacttagaattttttaactttatgatcatgcagtggtgatgagcattcagtagaaagtggttcggtattctcctgtgacgctgagcaggggcagcaagccacatctctcagtcagccacaggattcagagggtaaacaactgagaccctacaaggttttgtgttgccgggtgattttgcccggttgtaggcaaatataagtgtctgagcagttttaaggcaggccaggctatgctatgatgtttggtaggctaggtgtattaaatacattttcaacgtactatattttcagctcatgatgggtttattaggacataatcccatcatcaattaaagagcttctgtttagttctgggatcttggacagttaaatgatggatggtaaatggccataattgtgatgaatgaaaggaaaattaatatataatccagtcattcctgctatacccatgtaattacactgtgtcttttcatctatatgacattttaaattttttactgctttcgcagaaggaaatgcatttgtccatcacatgtttttcaaggcctcttgttctttaaggagatgatgattccttttttaagctaagaatttgcatcaggttatgaagtagatcgccttttccttttaatcactttgacttagccaacaacttcctgtaagttttggaaaacatctcttaaaataatgtcagatgttttgggtacattaaatttttattttaaaaaatctaaaatgcattttttttccagtgtcttaggtctggttgatttttagcatggtcaccataatttctaaccaagctgttatatttggaatgccttagctggccctccatactttaaaaagaaaaataaactgcgaaatctggtgtgtgtatatagaaatttatgccctttacaatccagggttttcctcatatataaattccacttgaaccaaagaattatgaagggacttcctgcgctccaacatgaaggagtcgaggagaagagagaatccttcagaaagaggtgttgctgtgtaaaaccactgaggttggcacacgccccgctgctgtaagacattgttgagcattaggaaagacagtgaggtgggatgacttagcagcatgggcttattccaaaatgagctctttgagcaaataaaaatgtccctgacagcagaggcttctagaactgtgggttaatttaactcaagtgaggggttctgttggctgcctcagtcggaacatatataaggctgtgaccctgggattggctttgcacttttcaagtttcctattgagaatctgctttcagatagagtaagctctctgttttaatggggctttttgaaatgggtcacctgctaagcttaaggagtgtgcatagtgatctgccgttgacagtatcctgagggtgccaccagatgtggaaaagctttaggagcgtggattctgtgctcgtgacgtgaatgagtgggttctcttgaagactgatgaacaattcagggatctgcccttataaaccttgctgggataagacacgatcactggggtttaagttgggtatgcctcccaggatctgatctatgactttcaatttctcttacagagaaatgtcaattaatgccccaggtggactgacaaagggcaggatgatcaccatttcaacctaagcttccccagataccaacagagtgccaaatgagtctgtgcccaccctgctgtggaggagaggcacattttaattctcactgtagctaggtaatgtctgagatgatggaagttctactaatggttgctcctgggaacaggcactagagaaaaaggggatgtctgggtaaagaaccttctttcttcctcataatcctcctctgttttcaagtttgggcacatccatttctttggtaaaaagctgaagccagagaagtgtctttgaagcctggaagctccctgctctgtggccaccctccccatcaggggtcacacatctgcctgcagcagcgtcagaagcagatatgcggccctaccttggtctgggagcaggagctggagcagtgggctgttaatgtcctcacttgtgggggtgggcagtgaggaggaggcaataaggcagcagcacatggggagagggataccctccgtgggtctggggatgaccacttgaactaggttccttgaaaagccacagttcagtcctctgaatgaggacttcagcagtttcaccttgtgggctccagatcataggatgttggcctaccttccaagaagtccctggccaaacggaacccaggccttgcattttatcccactctcaggcagagttgggtaattcatgttttttgtagtcagttcatggggattattagccccacatatgtatgtttcgcattccggaatacttgctgcttagctgaggtttcattatcttttgctcttagctaatttaaatggagatgggatttatcaggtacctgtattcaagtgagggtaatttgtttgaccctcttctagcttaattggtactgctggtggatttgacttttgggacttgcagcaataggcagagacatcggccacacataagcccccctgattgttgctatcttaacacgaatcctaaatgttaaagagctccaaactctatttctgaagtattgcttgggatgcctgatgaaaaagtgttgcttcatgacaaattttattttcacctacactctttcttctagggtcagcttaaacttggacctggatttatcttcctgttttggaggcttattatctctatttttactcttcaataattgtgttcagtctctgaacatgcttgaggggtctgaggcgcatcaataccaaccactttaaaaaaaaatttctcctcctcctcttcctctttctatctcttgattttcatctcccccacaatcattatcgtcatcctcacacaggcactggctgacctatgtgtacttcttttatgtgttttgttgtacattatttactttgtacaaattgattcccagatccactttggtcaatggcctacagtttcagccaaaattgggcagagccaagcaactcacattgtgtatatctgaggttcttgcagattttatatagttataggttgaattgggtaatggatttatatcattaacctcttgtttggactctgtaagtttcagcactctggcttcatatactataaagaactggctagagtattttgacgaaaataaattgaggcacaagatctatggtggcagcagcaactgcatactcttctgtgatgacatatattgcttatctgtactgactatttgaatcactgataagcccctctagacttagaattgtggaatgacatctttaagaaaatgtcatttcactctacagatatcgaccctatagatttttcaatatatgtttattgaagcaagacagaaaggctagacacaccccaggagaacaatagattaatttgggtgtctccatgtggtagtagtaaagccttttgagcatctgagtacctctcaaaccacaaattcttctttctttttctctactccacttaaagcaattttaggtgattctgtggatggggcaatggtatcagtctttggatgcattccccatcctctgtgaagtctctgaaatggtagttgttgagtcctcggacacttgtcatcagagcctgctgattagagcacattccccttagaattgttgagttttaactgtgcaataactttggctttccttacaaattccagctttgccaagtgtgctttctactttcattttcagctcataatgaaacttcattttgcaacatcagaccagagcttttcctttaaaagccttcctgaccatctcagtaattttagtttttcacctccagctaataaatggaccacgtttttttccctttgtcccgcatacactactgtaattttgatcaaagtgagaattagaataaaccaagtctagcaccttttccccagtagattaaaatgctccaggaagtactcactgtgtgtccacgtgtctaactctgcagccttcactatacttctgagaaaaatgtgatttcgtactggaagctttggaatgcctggactcacccagttgccaatgagaagcagtagatcctgcattgtgttgcatccttcattctccttcaattcagttgggttgttgagtacactgaagtttgctatggtttgaatgtttgtcccctctgaaactcatgttgaaacttaacccccaatgtggcagtatagagagttgaggcctttaagaaataattgggtcatgaggcctctgccctcatgaatagatgggttcattcatggctcagtggattaatggattgtcacaggagtgggactggtggctttatacaaagagtaagagacagctgtactagcacactcagcctcctgggcatgtcatgccctgtactgcctttgaactctgcaaagatttcccaccagcaagaaggccctcacaagatacagccccttgaccttggacttgtcagcctccataactgtaagaaataaattccttttctttataaattacccagtttcagatattctgttataagcaacagaaaacagactaagacaaataaaactcaacatttagaccttactattgtgaaaccaaaaatgccttcagctcttggtatttgtgtgaggccatgttgagcatagaaaatgtatagatgtgctccctctgtcctcctgtgggatgaagtctgagatggagggaaatcaaaataaaataaacacaagttttaaaaggtacaaaagaaggtccatgagtggaagtgaatgcttcagaagtttagaggagggtgaagtaggtacttgcaggagaaggcttttgcactggatcttgaagaatagtctgagcgtctcaaaggagagctcatttggtgggaggagatccaggagaagggataatatgtggacaaagtaaatccttgggaagcaaaaggggtgttttagggatgtttaagcaacttctggattgagcacagagaagaaaggaccaggaccaagaccaggacctaaatttatatatggggagatttctgctacaggtgcagatgatacctttgccaaagagggactgacaattccgaggctctgagtttagatttcagctctctcattcattcttgggtgaccttggacaattcatattcaccatgtgagttgagccagttatctataaaatagaaaaagcgacaacagcaagggatagttggtgcagcaaccaacagatataaagtgctccacaaatatcaaattaagacaataggtgtttaagcccagatgctgaacaaagcacaactgtaccttgctcacatctcactttgtgatggaaagtttttgaacccactgtattctagacacacgatgttatgagaacataggagtttattatttcattttacctagtaaacattttccagaagacttaaaaggcatttgttttgctttccaatgaaggtgagctgctaccttggtgccccatccaccagatcatctccaatggcaccatgccacgcagatgctcaagttggcagttttctgcttgaactctcccaatgacaaatgtgataagatttgcttttttagatagcagctgcatctttcttccgttcccttcacttcctttgggctcagcagttttcctttttgctccagataaattgctgttaatttaaatgtactgcagatccttgccattttatggctgattgcttctgagtaataggaggaaaatgtgtgcatgcttgaatgtaaataaatttaaatgggttgtgagccaatgataaaaaagcagagcacttcgctgaccttcaactcccttcccttcccagtctttccctttgaaaaggtcaatgagtagatcctaaatcagcaaatagcagaggttgagtttcaggccacatccagtttcttccttctctgttttcaactttacatcccatttctcagatagcacctgctttatccttgttcctatatagctcagctagtgcgtgcaatggtggcaaagtttctctaaagttgtttttgataaaggagctggtctcacggtaactaccatgcaccatcggaatgctacaaatgcttcagaatgtcacattgtcaaaatatctatatttcaggctcataagctagacagctcgtttggctgctaaacccacaagatgttcagccatttgttgtggtctaaaaactttccccctcacaaggagaaaataatcttctattgttttgtatcattttgtggtcttttgagttttttataatatgagagggcaaaagttatgagatcctgataggtaaatcgtggcctggattgaattttgctatcagtctctcttgaaatcaaattaatttttcaatatgtagtgaaatatctttagtctgtccacagtatgggaagatcaagggtatgaaagagtagggtgacttgccttctttgaggtgaagggggtggaagtgatagtttgaatgcatattgcttacaattgcaacaggctggcttttcctcagaagaaaaatgccgtatgtgtttttatggcggcttcacttgtttttattgcatgggcgtgtggagctgagatctacttctttgggaaggatggatcacaaaaggcaagcacaagaaggttgcagagggacacttgacatcaattgaaataagggccagggcagttgcatcctgagtggatggcaatggtccagtagaaccgtcatctggcaaagttagctgtgtttccaactgtaataattagtgagcctggaggggcttgtggcaggaaaatagcagatagaaacaaagaaagagaagcctggttaagttcctgctgtaaacatgctgggattagtaaactcttggagttcctgtgccataaacccattggaaataagcctttataccagcaggttaatcgtgttattgagtcaacaaatctttttattctggggtcatgctgtctctatcactaagtttctcctgtttttattgacaaagttgacatccttatattaatactcatattgtttcagtgggaaagaatttgagctccaccctcttaaaagctaagaagtttgatttgttaatttggcatgctcattttacatgccatagtgcactgttaaactagctcagcttctgtttgcctggaggcaaaacttttagaaggagactggagacagatatgaaggagaattaatcagtgctactgagtacttcctaaattcttagggcttttgtgggtgattaaatccataaatgatgtttggcatctgtactgagttcttttggaagggcaggagggagaaatgccatggaaattaagctccatagactcttttagcattgttgtaaatgatgacacagattggtggtggtacttacggttctggaggcagatgacactagcacttggcagaccagacaccaggtggaggaagatggagagtctacatggttgggcttagaggcgtcttccaaagttgaacttgaaaatgtctcggagatttctattaccacatggtctattttgccacttatggatctaataaagattcatgcaaattaaacacagtattatgtatactagaaccttcactgatccactgggtttccatgggcaagttcagtgaaagctcactgtcttcttcttgcagaacttatctcatagggttattgtaaaaataaaaaagaatagtttgggtgcaatgctaagtagagaacctggtgcaaagtagattcactgtcatttattgagcaaattatttactcatctttctccttctatgggccaatgaagtatttgaggtcaaggaactgtgttttctttatttttgtaacatttatcacagcgtctactgtttggttggtgcttaacaaatgtaggattacttaatgttagatattatacatcatattatttatatattattatatataatatatacatatactatatgtcttatagatataatatatacatatacaatgtactgcatgttgtatgctatataagttatataatgaatactacatctccatatgtgtcatatatttgctataatacttaaagttaagcaactaattaattattttatattaggattcttagaaaagaatagctgggcttggtggctcacgcctgtaatcccagcactttgggaggccgaggtgggtagattgcttgaggtcaggagtttcagaccagcctgggcaacatggtgaaaccctgccgctactaaaaatacaaaaattagccgcgcgtggtggcacatgcctataatcccagctacttgggaggctgaggcaagagaattgcttgaacctgggaggcagaggttgcagtgagccgagatctcaccactgcactctggcctgggcaacagagcaatactctgtctggaaaaaaaaaaaaaaaaaaaagaaagaagagagaagaatctaactatttgtattgtctagtatttcaccagttaaagttagccagttctctgggccagttgctgagtaactaatcagttcttttagaaaagatttgctaaaattagctggggaaagaaaatcaggatttgggtagataggtattgttgaaactaattccccccacccataaagacaaatattaggttggtgcaaaagtaatcatggtttttgccattgaaagtagtggcattacttttgcatgaacctatatataaaaattcttcaagggtcatttgtattgtacacagatgtttcctccttaaagtaagctgctaacagctgacacagttgtggatggagctgtatgcagaaatccttcgcatttcttttccttgtttcatgtaccatgtaaaatcagttttaagtttaaaactaagttgctcaataatgagatgcccatttcccccaacttctgttctgttattatatattgctctatggtttaaagtgtattccatgttgtgtctcatttttgatgtttatttattatgttcatttgaaagttattgtacttgtatgttaattttcattgatttttcttttgagcatgacttatgttttattttgtgtttcttttaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatccccaccccaccccaccccaccctgttccttttttatcaggaggacttcagagccaggcctgcagcattttgtttgaaaacacaatcagctctgacagttagacatgcacacagacgccatagctggattggaaacattgatgttttaaaaatttattttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtgggctgccagtttattacttttgtcttaaaacatgatcattgttctctcacggtatccttctgtcttcccgttgcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccaccgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcataatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaatttttatttttagtgctgttttaacaatgtagatagatcataaatgtacttgctgaattcaatcatttttaacaagccaataaagtttgataattcatctccatgtgtcttgcattctctgtagatcttgtgtacttcctcacacttcctcaagtgtgtgctgtcacctgagtgcccttggttgtgttcagaactgaagactttagaagaaacagtgtgagaaatgtcacggagagtttcaggggagtaccaggcccatttcagattctgtgataaattatccccccaaaaaggtcttttaaaattcctgtcagtatgaattgtccattcattgtttactgattcttgcatcagaaatattttatttggctaaaaggcaatccttaaaaaaaaaaaaaaaaacttatgcgaattttttttaaaaaccctaaattctatggcaaagccctttggtattttaaaaatttgaaatgacccaggtcacaataagagagtatactcaatgctctgtttctctattctaaatgactttgtggacatataaacataatgacttgtacttgaaagcgagagagaggggaatatgttggatgtagagggaagataccatgagaccataactgttagcatggtgcccacacttcatgtcccttttgtctctatcctcaggtcagctgcatggttcctgccccatttttcccattgaaaacaggatgtaaaagtgaggtttgtaggacctcaggctccaattcatttgagcctgccattcccttctgttgacacccaaagggttttgctctaaatcagacttagggattggaaaaactaatctagtgtgacctcatgctttatcaagtcaagtatactgcccctcttataaaagcccagtgttgggctgggcgtggcggctcacacctataatcccagtactttgggaggctgaggcgggcggatcatgaggtcgagagttcaagaccagcctggccaatgtggtgaaaccctgtctctactaaaaatacaaaaattagctgggcgtggtggcgggcgcctgtaatctcacctattcaggaggctgaggcaggagaatcatttgaacccaggaggtggagtttgcagtgagccaaggttgcgccattgcactccagcctggatgacacagcaagactccatctcaaaaaaaaaaaaaaaaaaaaagaaaagaaaaaagcccaaacttcagtgttagtgacttgtgctttttccaaactcccttctccatttgttgaacgaagaacaggttgcatctaacatctgaaggtcatatgataatttggagtggcaggcatttgtcacagactatgcaggtttgaatcccagctatgctcacgaacaatataatcttgggaaagttctttcactgctccgtgcttcaatttcttcctttgcagaatgagatgatggtaataagaatagtacaatatttacctcactgggctcttataagagttaaatgagatggctcaggtaaagcccttggcacattgcctggcaagtgggacactcggtattgctaataactaatacttcaaaggagctttggttggcgagtcgttgggtgtacctcggtaaatgtccacgaattacaaacccactcgcatatcttggtcatatgcagattgtgtggttgcaaataatggaaaccaaatgaaaggaaacttcactcactgggtcatcctgggtgtggcccaacctgtgaaggccactttggaattgtttcaggagttattaggattctgctcttgaattcttctctttatccaagccaattcttacacactgattctgcctcaggtttgattttgataaaataagaggatctgatttatttggccaatattctaatagttccatgagtttgaatgatggtctgttatttgcaaattcttggagaaatagctctgaatgtcttacactgaatacagctggcctcactagttctcattttgttaattcagatttctttttatcatttcaacagggaatgcattaactttactttttgaattatctatttaaaaatctttggctaagaatgtaagtaacaacttagccaaaagattgtttcaaagaaaagacagtttcaagttccctcaagacttagaaacgagtattcacaggcaatgagttatgaataactagattattcttttccttcctgaagttgtttctggtaatagctctagaaggccacacatgattggcctagttggaactacttcatgtttgaagtcataaatttcatgttattaaaaatacttcataatttgcacttttttcctatcattaaatcattttaaatgagtggcgttgatgtatttctagcacttaatttaggacaattttactattgctaccacctttcctaatacatcctttagtgagctctaccacaggacctaagagataatgataggtaacaggtattgacttcaaacttaagtgtttcatgatcctcccaacaaccttatgaggccaaagctaatattgcctgtattgtaacgattaggaaactgaggaatggagccatgagggacgtgcctcaggttaccgagctaacaagttaacactaggatttgagttcaagcaggctgtctgtaaagctggtgctccgtatgtgaactggattcttgaactgggctggggctagagcgaggccagccaggtgtctagggcacaatttgaaagacggtggtaactcttaggttcatgcaagtgcccagtggccactcctactagcactggcagttgtgttattgttgcactaaagtagaattctaaagttaactgaagtcactggagaggcaccccttgatcccagcaagtcttcaggtatttgtgccatgaacaaatccttttcagatcttgacttgcaagtatgtggcacagtagtgaaattggcacatacattttaaatttcaccttgtgaaaaagagaagttgcatcaagtctgtaattcagcgctaattagttaaccccagagcacgtttgctttgtccgttataactgaagatggatttgctgttttttattgccttcaggtgaattttctcatcactcttgaactttagtacttcccattcttttggagtagtccctactctctggtgagtgaacttgagggaaaccttgcgagtggaaagggcctggtgggaaggggtgtggaggacacgtcctgccatctccatgaacagaatccagacatcagaacaaggtggtgaaaaatgcctgcgctgttccttgcctttcgaacacccacaggcagagcagcgtcggagctgcttggtcacttcaatgtgcctgtcctcgaatgtcccgtctggcagccagtgattgagagagactgctgagggcacatgctaattttccagtcatttggtcaagccccatctcacacgctacaagaccctggagcctgtgtttactgagttaaaatctctgcctgaccataaattaatgaacagtaagttccctccctctctcttttagaaatgtttatcctgttgccaagaaggaaaggagaaacctcttttgtgtttattaaccacgcttccatctctttttaaaaattatcatcatgctgtaatcagtcttgctgaattattatatagaaacataggccacggctgtttgctttaaggattttaattcagcctcaagtaaattcatgcaatttcacctcaagccccttgagtcggggtaggaagtacagagtcgccagcactgttttaccttacctgtggagagttctaggtttgtcacctgaactaggacacagcctctgagggtgcttccaggcttttcaaagactgctctcaaggcagattttcctctttgcgtttactccaggctcctgggtcttggggaggttgattgattacctctccatcacgcttcactcaacgctgttgaattgaatgccacgtctaattacatgcaggtctcctgctggcttctcagggtgtctgacccatggggtgcactggcaggtctcaggcagaggaggcgttcagggtatgtctgttgtgttccccctgtggaggcgccagccttaaacaggctcagccctccctatctggagtcctgcagaatggcgccttctctgtggctccagctctgtctgggatccagcaaagctattttcccttcctgatccctggagttggtaagggcttcccactgttgtcagttcctgagtgcctatttcctgtttgtttctttaccccgcccgcatctctctgtgtggccctacaatatatctcttcatttgaaccatatggggtgagttatttttccttgacaaaaccctgagacatatgttatattctttaatgtatgatctcattttatcttccatcaaatctcttccaactccagtaaatatttattaagtgtcaattatagttgaccctttaacaatgtgggggttaagggcaccaatcccctgcacatttgaaaatatgagtataatttttgactgccccaaaacttaactactaatagcttactttttttctttctttctttctttttttttttttttttggtgacagcgtcttgctctgttgctcaggctggagtgcagtggtgcgatctctgctcattgcaacctccgcatcccaggttcaagtgattctcctgcctcagcctccctagtagctgggactacaggcgtgcaccaccacgcctagctaatttttgtatttgtaagagagatcgggtttcaccatgttggccaggctgatcttgaactcccgacctcgagtgatttgcctgcctcggcctcccaaagtgttggaattacaggtgtgagccaccgtgcccagccaatagcttacttttgaccagaagtcttactaattccgtgaacagttggttaatacatagactagtatctacatgtattttacgcattcatgacatatttaacttttcgttaattttttcaatatttctatgttacaaggttcatctgttaattttttcaaattgtttcaaatctcctaaaaatttcgaatatattcattgaaaaaaatttgtgtataagcggacctaagcagttccaacctgcgttgttcaaggatcaagtgtgtatgtcggccagtgagctaggtgctgggaggtacctccacaaaccaagcaactccatctttggccttatgggctatggcctaatggtaatgtgtataatattgatactatcactgcccataataagagaacaatggcttaaaaagttaaatgacttttccaagggcacacacatcagatttgtctgcctataaaatctctgcttctggcattgtttctctgaggccaatgattttcctttgtctcttgggtgtctctaggctgcaagttctgagctagccataagatctctgctcttcattttggtggctgtaattcttcttgacttggtgtaaatgcatgaagtatccctgcccttgtaacctgttttcttttttttatttctcttttatctttttttaaaaaaatcattttcttctcttttctttcagttctctttttactcaagacaaacaccataaatatgctttgtcttttctttaattttcacactttaaaattttcaaattggttgggcggaatgtacttagcttgcatgtttatgtgtgtgtgcgagagagagagagcaaggaaagggcacaagaatttacacacacacacacacacacacacacccctatggaataggaataccatgtattttcagttctatttgatcaaatgggaatgtaatcccagtacatacaccatttaccattatcacctcctcagtgcttactgtgctgtaacactcccagctcttcttaaaaaactttccatgttgtattttttgctctttgtttttacttccttataaatagcaagaagttttgctgagaagaaataattacaaatcccaaaaggttggtgttccgttctgagctccaagatgtaaggattgagtggatttcaaacttggcaaaatttctgacttggcaaatgcttccatccttatttatgacagcttggaaacttccattttccagggtttataaatgatgctgctgattttgtctcctttttttattttgctgtgaattataaaataaccagcctgaaggtttccttataatattaaccctcttagcagagagggagagaagtagagagagagagagagagagagagagagagagagagaagagagaatgtgtgtaaattgctgtgttctttcttttcttggttatgaggtgcattttacatatttcataagcccatttacttccctttttctgcctttcaacaaaatgaaaatctagaaatgttgaggtttgggatacagagagtgacaacctgtgtttgtcattttcaccataaaggacttcttggccagcagtcctctaagggatgatacatttcatctccaaattgcaatttagcatttggaattctggagcaagataggtaatgcataaagtatcagagagtctttttctagtggtgtgaataggctatttcagggggtctccatgcccatattcttagaaaattgtccaagtggaggaaaaacaaagaagttgtcaccttcttttcccttgacactcctcccccactgaagccttcttctttttctttttcactttcttacttctatactcaattcctcaaagcccactcatcttaggtttcctttgtaagtgctttttcctttcgattcatgggaatatgaagaaattaggagccttcatttattgggtagagtagatagattttaccaaatgtgggcaataggaattttgcagtgcagaatgtgtcctctcagaagcagacaccaagatggaattaaagctgcaaagatttttatcctgagaaactcttgggtgagagaaactgggaagggaatccgagagcaaggatctgtaagagcatcagactgcaatgcaagcaggactgtgggtgaataagagagggatggaggcttaggtcaagcaccctcgactgccgttcactctagggagttactggcgaggctgctggggagtatttgagccaaatcagccatcagaagacttccttgtctcccaggagggttctgcctttatatttccaccactctcactcattggctctggagcttggcctctgtgcaaatgaggcgataaattcctgagttcagcatttggtacccttggtcaactatgttccctgtccttgaaggtctacgaggtgcattctcaacagtagacactgtcttatctgagctccacttaacagatatgctcattaattgctgcttgccatctctctgtaaaacacaatgaccaacctacaccctggacactcctggctgaacatctgggttgagtgctttcggaaactccacttccttaaatgacctactgtcagtttcattggttaaaagggcttctactacaatcattttttttttttaaaagtacccaggctgggcaagtcaacattttgaaatgtttaaaaaatgtaatttttgagctgtagctacccttttatttatggcaacataaaacaacatctgaaactaagacctgtttttgtttttctcgcctacatactaaaaccacgagtgatttttatttcatttcattttgtgttccccatcaaacaaatttcctatcatgacagctcttgttattgattcatattctttcagaagagtgtttatggaagtgtacatcaatgccttgccaggcatgaggaccaagtcggagtggtacagagcgatgcatcctcttacacaattactcactcctggacttcagcagcccttgcattgaattgttttcaaggaaaatgagaccttattcagatgcaaccaactttattgagtactttctatgtggtagaccataggttcctgattcaaatgactacaggttgggacagtcctgggcgtcagtagctggggtggaggagaatgccccatgcacaggatagggctgcccctagcccagcccatgttggcgtgcaggaatgaaagcctagcgtacccaaatcttctgatttttttaagacaaggggagatccgggtttttatgtgaaattttctagtttttaaatgttggcaagacccttcacattttttaaggtctctatgagccaaacataacaagtgttgatgccaaatgttgccgtttgtgactttctggctggacattctgctcgtggctttcagacgtggttcctttacaacagccctgagtagatacttgtcttaagtcaggcttcctggaaacagatgctgagatgaggattcatgtgcaagtaatttattaagggtgtgcctgggaccggtatggggaagcaggacagtgggggaggagctaagcaggagtatgatttgagccaaagccttgtggaggtggtttcagccatttagtttcagtggtttaagttgcccttcagagttgtcccaccctgagcttagggagctgggctttcatatgtgtacacctgtcagtcattagctgcaggttgcaacaggcaaaaatgggctccaatagctcaagggaaggcctccagaaaagtgacacaggtgctggctgttggcactgcagggcacacaatggcagtaacagtggttctgagagaaccctcacgacccaccaccagcaatctgtggctctccctagtcgacaggctgagccagaattcagaaactgatcttttgactctgtggccagtgcttgttggcaccctttccacctgcttcttactgagatcagcatgcagaattcagatcatcttagaccctggcaaattggtatgttggccctgggctactagctcttcttttcctctagtaatgcatggagagagggtggcatggctattcagaggtggggcagcccaacaggagcaagaaaggggctctggagcccccaaccctgtaggcagccctaaatgggctcccaagagaggctgaggcagctctcagttctaaatttttcttgctaagtttggcaatttcttccctgagatgcagacagtgtttctgggtgctctgtgtcctggtgagttctgggcctatgagacacacttgtccgctgctggaaaggtggaccttttggggaaataggccagcagcttctacatcttgcatcacagtgccacagtatgtaggctgtttcctttggagagcttaaagctattcatggttttaatttggagatacaccctctaaaatccaaccaatttcccttgaaggaaatctatcagatctgaggagagaagacagaagctacagcaccatctgctaaccaaacacctctggattttgtgggttccagaggcaaaaagatcagtttttttttttttttaactgagttcatcacgtgttcccagacacacctgccccgtgccttctgctgtagtggacaatttgctcatccttccaactcctggattacccaggacagctttcctctccctgggctcttgaatgtggttccaaaatcaagccaagtcttcctcacccaaatctttcaaacctgtccattttgtgtacccccaccctgtctaccatcctccaggccctttgtaattgagagggccaagctggtcttctctctccccttctcaccatgcttccaccccctgagccccacattatcttcccaagatgcaggcttgagccttaggcaacttgcgcagctgagtagattaagtccaagcttctcaaaagagcatcccaagttcaggacattgtcactccagccatgcttccccacccaccacctctggtccacttccttaagctgcctactccacttggtttgaccctcttcctcccaccaccctcaacttattgattgggtgaccttgaacttggcacttaactctccaagtcttagatttgtcctcattaaaacaagggtggggtgactaggagatttaagtggaaaaaaagtctggcaagtcattcagacagcatggcatgcagtaacagaagcaatgaccataacaatgattatcatgattgttacctatcttcccaccctcctagaagctggcacagaattctgcacacagagtggcaccttctttcctatacccccatattaataattgtgccatagtgttcatctggtgagaggagcttgggtctgctgttgctgcattaaactggattgctccaaagcattagaccacatgccactcctgtcaaaggtgctactgggctttcaaagaaacagatgaaaaagatgtgattctcagttgagttcacttttgttgagatgtgtgaatgtttctgagtaaagctatgtgggacctcatagctgaaaggctgaatcagaaatagggagcttctgaggcacggaagatcagtaaagctttaggattctgaatgaaactaaattccaccccccacccgccatggacagcagaagcaaagatctctggggaacttcttcaggatgtgaaccaggggctgccataacaagttaccacaaacgtgatggtttacaacaacagaaatttattctcatcattgtggagtctggaagtttgaaagtgaggtgttgacagggttggttccttttggaggacctgagggtctctcttagtttccaggggcaattatcggcatcctttggcttgtagctgtatcactccagtcactgcagctgccttcagctcgccttctccctgagtctctgtgtcctctcttcctcttatagaaattctcattagatttaaagcctaccctaaatccacgataatctcatcttagtaatttttaataacatttgcaaaggcccttatttccaagtaagatcactgtcacaggtttcagggctcaggattggacatatctttttttacaggccaccatgtaacccactacctggagaacagagttgaactgagaggttgatagcacaatggaaggtacaggatgtagatgccaagaagatctgagttccaatccctgtttggcccatgatgtggacgtatcccctaacctcactaaatctcagtttttccttttctgtaaaagggggatactcatttccaccacgtagattgtgagaataagttaacaatgcatgtatctagtacttagtagattcacaatatagttattgtctatagctattaccaccactcattcattcatttaataaaaatttaaatctctggacatcaaggtgaaagagacatatcatatggcttttagtcataaaaacactttgaaggagttttgtgtttgttgaatgaataaacaggtgttcagatctgaagcctatcagaagtatttgctttgttccaagcgaaagaagggggtttggcaggtcctcttatgcactgtgctgcctgcagggtgaatgatgatgatggtgatgccagactttaaaggaagctcctattttagactagtgtttataatccttaaagaatatcattacattatcattcacttcaatggtccacataggtggtcatcagagtgaattctatggggaactaatatcaagaggcaatgtgaggtgtcttaactaaagaaaaaaacttacagcacagagcaaggtggggccaggcaagtaacagttaaagggaggagagaggggcagccccttggagagtgtgtgtcttatttaaacagggcagctgatactcactcgttcattcaaccatgcatttaacccttctccttgccttggactgtgccaagtgctggggccacagggtgagaaaagcaaagtactgtcttcagggagcttatgttctctgagcgcaactccagctctgggtgccacgtgggaatctagggctttttgctgccaaatcatctgctttttaaagagaagaagccagaggttatgtgaaatctcctgatttttaaatgttggcaaacaatgtacatttttaaagaacactgtgcaggccagacaaaacttgtcttttgactcaattgggcctggcctgtaggctgccaatctgtaacccttggggtggaatctcatgacttttgccttaagaaacatttttcaaatgtctgattttacgctaattctcatttttcctgacttcattgcaagctgccaatgcttactgcttgttgtctatgtcctcctggatttaacgattcctaggtgcttcacctctgcgttttcagctgagctaacctcagtctatcagtttctcccttgcaaacctaagccccatatctttgattacagtttcgtgttctctcaagcttccagaaaggctctgagcattgcccatttttccctcaacatttcttctcttgagaattggaatctagtccaaacccttaactaaacagcttatagattagagctgcttttaagcctttcttttgaaacttgcccttccaattttcatacccattgagttgcattgactcccaaccttaggtgtgatattaatttctctcagagggacatggatttaatagactttttaattaacattttgcagaatcggagctgtcattctttatggcagactgatacaaatgtctataattacatttttggcattacatctggggaaaagtctagagatgtttgttttaaccccttcctaaaacatactgatttatgggcaggcctctttgtgcacacctctaacaggcccagttgccatgacaacgcagaacatcatttgtcaaagagctataacttcattatatgttgaagctgaaaatttatcttttagaatttatttttatgacagggaaattttgcatttccatagatatgcttcttctccctaattctgcttgtctttagggagattcaggattcaggtgaatactttctagagaacaagacaaacctcctacctttcattctctccccctacccccagatgaattattgtattcattccaaagagaactcagatggcctcattagtacaacaacacaacaaaggtgaaattgtatgccaagtgtgtctaactaaatatgatttttgtttcttttaaaagattaaaattttattggttgattatttttggcagtaaagttcaaagaaagggaagaaagaaaatgtctgtaaatccttcctacaagctggagaaagtgaaatatttagttattatatttccttgtgtgatgtgtgattcatggattgaaaagtcaaagccgattaaaggggcaggcaaatatataaattagtgcagtaggctcctggggactgtgtcaaatggaatgctacatgccttctctgaagatagtagcttgttagtgtttactgacaaatgtggacccttgtacaggattgtttgttttgttttttttttaaagaagccagaaatctatggtgttttttttttgttgtttgtttgtttgttttgagatggggtcttactcttgtcacccaggctggagtgcagtggcacgatctcagttcactgcaacatctgcctcccaggtttaagcaattctcatgcctcagcctctccagtagctgggattacaggcgggtgccaccacacctggctaatttttgcatttttagtagagatggggtttcgccatattgtccaggctggtcttgaactcctgacctcaagtgatccgcctgccttggcctcccaaaatgctgggattacaggtgcaagccacagcgcctggcccagagatcaattttcacatgaaattttctaattttaaaatgtcttcaggtcatatgaattttgtttgtttgtttgtttgttttttgttcttttttaagcaggtaatagtcaaacaaagcacatctgagggcaggttcactctatggactcctagatttggtttctgccctaatgaatgctacacaacagcttagaatggctttgtttctctaaacgaaatagccaaatcaatcattgtgctctccaggccttctcaggatctggtgtgttgagtgttctgtctgttggcctcttaaggggcgatgttccgcctgtttgcatgctgggccgttgttggactctgcaccacccgggagaggacacagtgagagaatcccacctgctcctcgccgacatgccaagatggatggcgggggtccatcagatgccttctgggattgttcagggatttatgatgctcactttttgttcttgatggatggggtcatttaatcctctgcactaaaccccatctttttcttttgtattgagaactcctggactgctgctgcctttccacaagggatagcaaagattttctttcctcttactgcatttgagagtgttttgttactcattcatcaatgagggaaaaacactagtaattcttgggaataaaccatcaaaaacatctggggcaaagcttccctgtgggtattactgcaccagagtaggagcagtttagggaacacccccttctctccaaatcatcctatggtggacatctatcacctatcatctcgctggttgaaagttagatttaagacatgttggcattcatgtagacttatgctaagtatggaagcctcacagtggctctggcaacgacagcaggtcaagacatgcttcatgcttcttcccacctttctcaggccctcccatgatgcctttcacacaccctaggcacaagtctgtccttgtttaccctcacgttcttgtatacagtttcctgtacacagaatgttgtgcaccatcgtatctcattttaacccaggcagggctttattgatcctttatgggcatttaaatattagcaccactggttagaagtgtgatagaaacagtttcccaataagtagctgttagaaactggcacaggtttgggttccttattattttcctgtctccttatgctttagagcagcctaagggtgtgtgtgtatgtgtgtgagcatgcgtgtatgtgtatgagcatgcatgcgtgtgtgtgtgtgtgtgtgtgtgtgattttggcttaatttttctttctttgaactgttcttagcctataagagagaaaggagatgttatagattattgaacaaaatatgctcataccctatgccaggtagaggcagtttaatctccaaagcttttctcaatatttttttaaaaaagtattttgaaataaccatagaatggtaatgaactaattatgatcccatattctgtgtttacttcttccctcaagtgatttttaaaaatcctactggcattgtattttttaaacaatatatgaattacaaagtagtaaagatttcctataatcctgccacccagaaatatttcatttagttttcctaatgcttttctgtgcctataattgttctgtgcttgaatcatattgtatataaatatttttatttcctattacatgtactgaacagtatatttacaaggatttcttcatggagttaacatttgtcataaataaacttttccatcgctctgtaatattctatcctttgaataaaccataatgtgtttgatattttcctagtattggatgtttaagtaatttccaatttcattgttaaaagtaacactgtaatgggcatctctgtccatatctctggattttttcctaggattgatttccagatataacatttctaaattatgaggttttgatattaagacccttataatatattgccaatttactttccagaaatattggcacagtcacaccagaagagtatacaaatgcccatttgttagcaaccttgttaacattgttttgctaatttctcccctcatctttgctttagtgtttatatgctgttttatatacaagtctaaccgaagggagggggtcagggaaagggagagagagagaggatcactgcctaataagaaaaaattctagttttctatgcccgtggtacattggtggtcagttacccaggagaggcactttagcatataccagacagtactttaagtgttttccatatgccaactcctgtaatcctcacaacattcctgtgaggtagataccaccattatccccatccagagaaagaaagtgaggcccaaggaggctaaatgacttactcgaggtgacggagctaataaatgtcacagcaagaattcagacagggcctttgggatccagagtctgcattcttgtaagagaaaagaagagacttcagggcctaggccacatgatggataatcaacagaaggggtggtcagcacaggtgatcacaggatgtaagtacacttaggagattctcacagttctcttttcttagtgactggaagagtaggttctgattcaaagtaagataaacctctaaaaaaggcaagatattttagctcagacggaaagatctttcactgccactgaaataaaatttgtaaattattcttcatgatcatacccagttaactccaaaataattcagaaattgcatttgttttatgcctaaaaaacatagttgttttctaaatacgaagaggtgttagggttttctttccaccttgaccttcagaacatggaatctgatgaagcttaatattcttgtattctcttgttacccgtttctctccatataactggaaacctagtggctttcttagattcttaataagttacatgcctgtgatgttaagttaacaatcacaatttaattcaatacacaagcaattggcacccacacagggatgctaggcattttaaagaggttcagagatatgagacataccttcaaaggtttacgtcctcacagggaattttaagttcacaagaaaaatataacaaggtagagcaagataaagatattaaagaaccaagtgctacagtgatcagagaagctatttcttgctgcagagatccagggaaggattcctgggaagctgacatttctgctggtcctgaaaggagcagtaagaggataaaagcagagacggaggtgaggagcaacctggtggaagtgtcagggcgagggaggtgtagaagcagcacaggcccagctgtaatcacatgatgcagcatcgttgttgcgtgtgataaacatgcattaatgtctatggctccagctgtgtattacgcaatctttaacctagatagaaaaccccaaaccccttgaaccagctgcgaaaacataaagaggacctgccttctccttcatttcactgtcttcattcacctcagtatgatttgctgtagtctttttcaataaaagtctgttttacggaagtgctcctgagctggcccagtgtgtttgaatcgcagggaggaggacgatgcgggagaaattggcttgaatccttggttttcttatttgggccatagataatatcggcagccacccccgcacctggatagattggatgcgggcactcctgcacactctatggagccttgagaaggccgtgctgggctgagtggggacttctgtgtcagaggagcccacagctgaggctgcccttcttcaagtgtggcctgtctcagaatcatccagttaaaggtgcatattcttgggcctcattggtggtggtggtggtggtggtggtgggtgggtagggagggcaagagactgcatgttcaaaaagctccctacagggttctgatgcacactaaggtctgacagccattgttctgtgaagtgcttctcagcttgggctgcacactaaaaatcacctggagagatttttaaaatatccatgcctgggatccacactagaggaactaagtaagaatatctgggcatggggtcttgacagcagtctctttttaaaataccttaggtgattctaaggtgcagacaggtttgagaataacttgaattggatgagagtaacctaatgcttttagtgatttgcatgagaaaaagaaaggaaagaaaaaaaggaaggaaggaaggaaaaaaggaaggaacaggaaagaaagaaagagggaaggaaggaaggaagggatcactctagtagatactaagaaaggaaagaaaaaagaaggaagaataaaagaggagagacagaaggaaagaaagagaaaaagaaagaaaagaaagagagagagaaagaaaggcaggaaggaaggagggaggcaggggagggagggggcagggatcactcctatagatactaagatgagtgtccaatccattcttactcttgtattttaggactacatataaatctttggagcttcatagcagcttcccttgataacccaaatcaagtaactcactgacactttatttcttacctggagcactttttaaaaacccaggctatatcccagacctaagtaaggatttctgggggcaggaccatcaatgttgttaaagttccctgggtgattccactgtgcagcaagggtgagaattgcaggaggatgcccgggtgaggatgggcacagaggtgtctccatgtcttagttcatttgactttcatcttccacttgggtagctcactacaatcgccatagccactgtgtctgtggtgttatactgtcacctgcctaaaattctagcttagctggagaggtgggcattttcatacagaactttacaaaatacaaacggagaacctatcaaaagcctatcaataaggttgccagatttagcaaataaatacaggattcccagctaaatttgaattttagataaacaagaaatgatttttagtataattatgtttcatgcacaaaataaaaaattatttcttctttgatgaaatttaaatttagctgggaattctctatttaatcctacctataaaggaagttaaatcaaatcaatttaaaatagcaggtgtctgattctacagttaataacaggtctccaggattgctgtgccctggaggctgcccccaggataattaggcctgagccccaaagtgttagtccccctttcttaagtcactgttaacaaggagggagttgaccactaattacattttttcccttgatgatctaggtcaacacttagtctggagcatctaggaacccctagaagcattgttctagtcactttccatttcaaatcggaggggtgtgtctcatgttgagccagtataacaattgacttcatctttcctggctcgggttactacctctgcgcacatgttgagagttctagttcaagcccactgactgcaggcaacaggaaaggcatctgtaacattacgcacaaaccattactcatacacagggccaccttcatgggactgagatctgtgctgtcatatagcttagcagggctgcctgcttggtttaatgctctgttgtcaagattttgaaattcttaatattttataaatgaggggtctgcattttatttagcaatggacactgaaaattatgtagctggtccagctcatgcaacaaaacatgggcaatatagactaaaagcagtggcatttttgcacagctgataatttacattcctggtagtgggtatggccttagtcttctctcttgggtaggtgatattcctttggcggggaaaaccataacaactgcctacccatgccttctagctatttcagggatgcctgccttaacaaagacttctgccatccaaatccagacgttttatctgggagcttgaattcacctacatatcatttcaagtgtggctatctttcagagtggcatttagtaggtgtcgccattcatcaatcagcaattattgagtatctggccctgtgcaagacatctttcctcgcttgccccttcatcattatcaatcatcacagtagatgtatccagtgcccatctgtgcatgaccctttgtttcaagatggtgtgtgctaagctgtattctgtcagcgaaatgagcccccactccaaaaggcagtcagggttgtctttggaacagagagtttctcctcagctaaaaaaggatgtgtctatcaagtgctaaagccacgggatatgttttctggccactactagatttagacagagataacaacaacaagaacaacaagaacaacaacaacaacaacaaaaatgcacaaaactccaaagatggcccattgggttggcagaaaaccaaagctgcccctccccccttctttgtaatggtcaggttgtaaaatcaggcagttgtctctcaaaatcattgctgaagatagccgcatgggtaacagcagcgtgaggctgacccagggaagccagctgatggaaaactattctgaaatcctgtgtgtgaaagtaacctgaaaaataaaatgtgtgagagcaacgtaaggcatttcttttcttatttatggctcatagagcttgcttgaggcatttcggcatttcccctgcaatgccagcaaatcctaatctaatataaaactcaaaacaattgacaagacagaacagctccagaaacataaggaggccctcgtggttgaagagtaagacaggatttactggcatggctcgtgtattgtgccaaggcataatgctagatcccatcacattgtggggccgtcttagaacagaaatctcagggaaacagagcttcttaccattctagcaaacaccatagttctgttctttgccaaaatgtttttaagttagccttatggcagaagtaaaattgttaaaatatgctgacatattgtgaacattttattaatcaaagagttactattcaggtatttaaggccgtgcatgttgatatggggcaaaaaaatcactgctaggtttagagaaatgcaagaagagggcagctcttcctatgatctgccctgttcttttgccctagttggttgggaaatgatggctatgttggtgcttttaagtaagagaagtagccctgcaaggaactgaaacatcttgaatgagggaggatgctcctgagttgaattaaatggagtggaatgatgggcaagaacccaccaggtacttggagcatgtgagttgcagtagggaaagtgggatgagcaagtacagtcaatgcccttgggggacttgcatcctcattgagagaataaattattatcctattagattacactctaatgtaatgttattgttttctagcataatctaatattatcatctagtatgcaggaccacagtttcttgtccaaaactcatggaacaggatgccttggatttgggggatttggaaattttggaaatgctcactatggttcatacagtgattatcactaccacctccgctggggccttggggagctctccacagtcaatgatatttctgcggtggcactgaggctggtcccagtaactgggatcagtaaagtctacaaagaaccttacaacaattcaagtcagattttcctgccaagcgagtgtaactttgggttttcagaacatcttggatttcaaaagtgcagataatagattgagagcttgtcgtagagtataatataatataatataatataatataatataatataatataatataataatactggaatatactataacagaaattcaatgagggcattatttcccaaatacccagaacaattcctggcacagagtaggcattcagtaaatatttgttaactaaataacaaaagtaataagaagaaatgttacttgttattttattgagtgtctataccatgtcaggcatagagaagcttcatactaatcctttcaggtaggtgttgttattcctattgttattcttattttagagatgaggaaactgtttctgagagaagttaagtgaccaaagctaccagggtggcagttgataaagctgtgattgaaactagggggtttggctatggggatcaagagcccacttggaaatgtcaggctgcctgggatctaagtcctaattctgccgctcactggccaggtaaacttacactaatggtctgactttgctgtgcctcaatatcttcacatgtaaaatgagaataataagttctatgttatagaattatttacagatatatataaagtgcttacaaactgtgtttggaacttagatagaccctcaatgaatgttagcttaaactgatgctttcgagggaggctttgtagcaaagaattttgtctgattgaatagagaataaaaagataaaactttagataacctcatatataacccactaatcaaagaataatcacatgctactatgataaactcaggatccagtaactaagtctaagtcacaaaagaaagtctatttggttgtctcaagtgatttaggtgttgctaaaactaaataacttttcttttaaaaattggtagactaagaatagaagaatgcttcctttatatgctaaagatgccatgtcatataccaacagtcaccatcatacttactgataaaatctaagaaattttcccattaatatctgaagcaacacaagaatgcctatattattaccattattttatcacatcctggaagttctggctaatggcataagacatgaaatggttataaaaggtttgcttatggaaaaggcaaatatattaataattatagatattatgctttcttcaaaaatagtggagaatcaaattacaaatccaataataaaactagaggtcctataatctggctggataccatatacaatatttagtggctttcccatatgttagcaataatgttagacaatataatggcaaacgtgtcactcagaataggaaaacaacaacagcagcaggaacagctatagtacatccagaagaaaatagcgacagagatggggaggaagttatgtggacaagattgttagtctccacagaacttacaatagcaaaaaaaaggaaaaagaaaatagtgtgcagtaataccagaataattaaccgaattcattgagtgatggtaaaattgcagagataataaaataaagtacatgctcgccatacaatgttaagaaaaaatgtacaatattacactattttcagtgtatattgtatatgcattatgatcccaaacttattttttatgcagtaaaaatgatgagatcaagatgttattatcagacatggggttgtaggtgatttttattttcttctttatacttaccgcattttccaaattttctacaaaaagcaagcacacagtcatagaatacaacatgttactcaaaagtatttaagaaaaaataataccagaggaatcaatgtacctactattacttttcttccgatatagtatattgtaattcactattataatagttcactattttgtgaagttttattgccaatatataatttaaagcaaaataaatggtggcttatttaccaaaaatagataattctggactttaaaatataaaataacactacataccttctgcttcattgatttaaaaaattgaaattctgtacagaagccttaatgattttttttttttacaatgttttgctatgcaacttggattcaatttctggagtagagggaatgccaagatgtgcacaaaggccttgggaggtgaaataacatccatttcattaattctttgaaaaataaatgacctcactttctttatgactatagtaattaacactcacatttgcactgattcagaacgatgctttgtattatttattaccacccatttgtggtttggtggtcaacctaatgggtatctttgtcagaaagtttctgtttgtgaaacacattgaagttgttctcatctgcttgtccaataatttctcatcagaagagtcaaatacactttaaaaaacttgaaataatgcagaccacagatgagggcagattttaattctgacttttaattggcctgtcttgtatcctgttcactctggtaaaatgcaatattgattaatttccatgaatcccttagtcccttgcacaaagcttagtatgtaacagttgttcaggaaatgtatgtggactggatagaaatgagaataaaaaccagaggcttcaaactcttggacccgtcctcccatttcactgtgacgggtcttagtacattttgattctcatctaaagacattaatccttggggtcactcttactctgtaaagagcagtgaccatcttgctgcattaggtcaacaccagatatttatggagcgcgtacaggccatgtgctgaatcgggctgagcgttagtttttatgatgtggagctgatttcagagcctctagcagatgcagagcaatctgtgcattcttcaggccaggccccagcgtgcctgtgggttttctctgctttgctgcccgggagctatgctgccgccttctccctaatccctgcaaacaggcagcgtgtgaggagtctgccagcacatcaagtgtgtctgcaaaatgcagacaaattgctgctctttattagaggtacggatgaaggactctgggaagctctgaaactacagggctttgggtttcttggctacttttttctcaagctctactttcagaaatacgatgttagtaagtggtacatttcactgccaacatccctcccttcctcctttcattcctcgttctttccctttcttcctcctcctcctcctccctcctttcttaaaaatttagaaataaaataagaccttcttattgctttttcttgctgattaggaaaaatagccagccagttctaagtttggtcctttgtgagaaatgtgtcctctgcctggcgtcagtcatgctctcatgtgaacattcccttgaatttgtcctgtttccagctcatcctctgctaccttgatgcattccaggaccacaatcattgacaattctttttttttttttttttttttttaactctttctcactctgctcttgtcttcgctttgtctaactttgattctgtggtcgctggttataaggtcactgtttttttgagaaaatcaaagctgtctgaagaaaacacccacaagcctccccagaccatatgccacctttatatgcatggccatggctctgccttctctcctgatacaaggcttctccccaggaccgccctccccatgtgcactggctggactctgacctcttttgcctgttgaaagacatcaccccagccattgtccactctctttcctgcagcgttacattttcttctgaaccggatcattcccatcagtttacaaatctggaagctcatattcctctattcctcatgtctgaaaaaacacactgctcttgacttcccatgcaccatgccccaatctagcgcgctgttctcctttgcctccaacaaccttctctcgaaagggttctttctttctccaattcctctctttctcctttctctttaattccctcaaatcaagctttcattccaaatgctgcaccagagtgtccccttcagaggtcgttgcattgctaagtcccatagcccctcccagttcttatcctacttggcctgttggaggcacccagcgcagcttcttgtttccttcttcactgacttcactttcttcactggctccaggctgctgcattctctcttttccttctacatgggtagtagaaggaaactaccaagtgggactgttgctgagccctgaagctcagtctttgagaccctctcctctccagctgctctccctcatatggggattttatccagtctcatgggtagaaacctcagatgcattttgaatccgtctccatgctggcattgcccacctctcgtttccaatggagacctgtcttccgaactgtaggctcgtatgccacctatctgctcagcagctccacttggatgccaggtgagcatcttacacttggcatgaccaacacagagcgctgagctgtcccatgagatgtgaccctcccacaatcaaacccaactcaataaatggacacccaggctgaaacctgtgagtccttgtgacccctctcttcacttacacccccagcctatattagctctgccttcaaagtatagctagactccaactgctttgcttcaccttcacagctactaacctggtgcagtcttctctaatctctcctagaatatctggccacattggccagagtgcaccctgggcaccgtactctctccctacagcatttgtatctgtggctccctctttctggaatgtttttctcctctccttcaggtctttgttcaaatatcactgtctcccggaggccttccctaaccattgttttcaattgcagcccttatacctgctagactgtcccggtccctcctcccaccttacttatggtcagagcacttgccactctcagatgtgctgcagatttccttgttgtcgttggtaattctctgtctgcccccacaaaatataagctacattcacggcagaaattttggtccatttcttcacttgtcctaaaacagttcattgtaataaatatttgttgaataaatgaatgaaagaatgaacatcccaggttgaatctagggcacagcaaggttcagagccatgtgatgagacgcatcccaagaaaagtgtcactgttagtggcccagatgtttccacatgtgcagatatgttcaatcccatagacaaaacattgaagcaaccagtggaactattcaccctttctccagaagtttgatgacacaagcagtgtgaatgactctggaatccctgctaatcccctgttttcatgtccagccagtcttgcataccattacatttcttctgctcaggaaaaggctgactgagctttgtctgggtataggacgtactttgggatgcaactccgttcctcgtgaagaggctctgacctctctatctgcacttccttctttactcttcaccctcctgatctaagtcttgccctcctgcaaatcatactccccatggctgccagcgttatcatcataaatctgtgttttcttatctgagggaaagaacgtttttaaggcactatgtgagaatctcattctggttctggatagctcaacagccagctctgaacccagaggaatgccgttggctgaagttactgatctgcttcaggattttacctccactgcaggctcacaggtatctgactgctccagggttgggactctggccgtggctctgcctctcctcgttttccacccatagtgctgcttccctggcctcactctgggttctccagcagaaaccggcatgctcatgggtgctcccatctccctggggctgatttcagtgatggttggggcttccctccgtatgaccattggaacctcacctcatccacagtctggcaccactacttggctacattaattattcaaaccctcagttttttaatgccacatttggagagaactagatctgagtgaacatttgggaaaactagacccactgttagagccaatgcaaaggccttagaagaccttagactgggggaacccagttttccagaagtttatgaatgaccaggagtgtctctaaggagaggaatgaggcagagtatgtacctagaggacctcataatctattcccatgatccagtctttttgaataattcttggcatctaagagcaagaactacatattcactttgcttcatttgctgtctgtgtggctgaatgaattccccagcacctcagttccctcctgtaggaatggggggtcatagcatctactggatggtattacggtgaggagctaataaaatgcctcatgcgtataaagaactcagtaggtgctaattcttcctactatatggcacacagtaggttttcaatctcaacattttaagttagtgggttggttccctgggtctacagtagatgagtagttattatgcctgcaggtgctctggatgccttgtaaagtgaatgaggcatgcgacctgtgtttctgctcttctctcagtagcctcccctcccagcacagcattctctcagttcccaggaagtcccctgagctgcaggcctttctcacctttcactttccttccgttagaggtggctcccactgcccttcactcccaggacccgactgagaggtgagccagctgcccaccagcagtgcttggtttgaatggttgtgatggtttgatgtgttctttttaccagggaaagttgcattttccctggagatttttgagggcagtgttagaactcaaaggtgtggctctccaaaggtgggtcacgtgcagcttggccctgccctcagtcagagaactgtagggggcacaagtcagggagtgttgcaacgcctcagccctgtgcagacctgctgtaggggtagaggctttatgctatgcactatgtagaataaagagttgaaaaactagaagctttcttttaaggagtttacaatctagctgaggacatagatgagtaaacagattgttataatccatggctatcaagatctgcaaacagttttatgtgagcagacaggagaaacatttagcccagtctgaagtggtcaggaaggcatcctgaaagagctgatttttgagggaaaaggattttaagggggaaggattggcattgacaagacatagaggcaagacacagcacaatatgaacattgagctaccaatcactactgcagttgctagggtgtaagaggggagatacgagaagaaagttggggccaaggcctaggtgaggagtttggattctaaggcagtaatgtgaagccattgatccattctaagtaacaatgaggggaggaagaggatcctagtggcaatttagaaaggtcttttcagctgcagcatggcggatggaccagaggagggaaagagggaggcaagaggctagaataggccatagctgcagctgcctgagagctggagaggcctgggccagagtgctggctgctgccttttcagccaaccttagtccagccatggatggttcactgttttgaataaattaatgggctttatatttataaacatattacagactcctcccacattcagaataagtcagagaatttttgtaaggggagggaggtcaaatttttgtaaggggaggggaaaaatgactccctattcttctcttgttatatttgctgatgtttctgggtaactttcataaatctgtggtcttttcctgcccttctgttataaacagctgacatttctgaaggggaactgagaagcacagtaactgtaagaagctataaagtgttaatcatgagggaaatgcaaatgaaaactacaatgtaatacctcactcacacacacacacacacacacacacacacacacacacacacacacggctatcactatttgtttctatttattcgtggctattgctattggcttctattcgtttctgcccattacagaaaggaaagtcttctcaaaaatggctgttataatttcttgggttgaataaacccaaagaggaagagtaaatactaaagaattcatccatgtaaccaaaaaacacctgtactccaaaaactattaaaatttgaaaaaaaaaataccaccttgctcctcaagaatggccataatttaaaagtcaaaaaacaatagatgttggtgtggatgcggtgaaaaaggaacaacacttttacactgctggtaggaatgtaaactagtacaacctctatgaaaaacagtatggcgattctttaaagaactaaaagtagaactaccattcgatccagcactaccactaccaggtatctgcccaaaggaaaagaagttatttgaaaaagacacatgcataggcatgtttataacagcagaatttgcagttgcaaagatatgaaaccagcctaagtgcccattgaccaatgagtggataaagaaaaatgtggtgtatacacacacacacacacacacacacacacacacacggctatcactatttgtttctatttatttgtggctattgctattggcttctatttgtttctgcccattacagaaaggaaagtcttctcaaaaatggctgttataatttcttgggttgaataaacccaaagaggaagagtaaatacagatgtctcatttcatacaattctcagtttaattgaaagactttaatcttgctaacttctgaatttgacaacgcttaattgtgtagattcaagcttccaagctcaaagattcttggctaatgataagtataaatatatgccatggaatactactcagccataaaaacgaatgaaatgatgtcttttgctgcaacttggatggaactggaggccattattctaagtgaagtaacataggaatgaaaaaccaaacactatatattctcatgtataagtgggagctaagccatgaggatgcgaaaacatacagagtgatataatagactgtggggacttggtggggtgtcaattgagaagtgggtgagggataaaagacagcatattgggtacagtgtacactgcttgggtgatgggtgcactaaaatctcggcaatccccactaaagaattcatccatgtaaccaaaaaacacctgtactccaaaaactattaaaatttgaaaaaaaaaaaagaagccataaagtgttacagaatgctaaggaatgtgcttctatttgtttctgcccattacagaaagggaacccttcccaaaaatggctcttataatttcttgggttgaataagcccaaggacataaatagagatatctcatttcatacaagcctccatttcattgcaagactttaatctggctaacttccaaatttgacaatgcttagttgtgtggattcaagcttccaagctcaaggattcttggctaacaataatttatttggttgggttaacagttaaacctgatgtgaacatttaccctttgaaagtacatattttcgtattatagtttccaaagggatctgagaaattgtccttcctggacagacctctcatcgtcccctccatgtgatcaatagaatgcagttttccaagcaaaagctatatttctaaatcatttaagaagaaacaagtggaaatttaattttaagctggacactattttttccttttacagtcagctcatttttcatgattctttatttttcccaccagcatctttcacgttagtgttttaaggaaggagtgttttattgccaaagtcttcacaacatgaaggcctacaagcagttataaagattgggcttagatgatgtatattaaaagtgataaatcattttccagcctttcattacattttgttttctctggatccttacctcctctgactcatgtacctgggctgatgaatgcccgtctctccagttacactgtaatccagggcctgtgtttcatttgcctgccaatagtgatagccaataaattaatcatgcaaccacacaagccttgccatgcaggctgctgccagcgtaaaactgcccatcaaaagcctgcaactctgaatctccatttatctagtaccctcaagactcgcatcgttcccagcaactggagctgcaaatgctcatttcttcataggcatgggctgggaaaatgagagaaggctaattaatgcattcaagagatcctactgaatcagcaagccccttaaaggcacaacagacacaaacaggcagctgcagctccttgggattcaaaacaacaacaaaagagctagttaaatatttgaatagctaaagtatatgtctattcattcccatggaaattgctaaaataggctgtcctcccatctccagaggagtcaaagtcattgaaatcccaaagccttttatcctgtcaaacatgcctttgaagagcaggacatttacatctccataacaggccaattcaacattagtggtaataaaacttgggtgcatgaaaggactccagaatgtggtacccattcactctggcctctggggatgcagaagtaactttttgaaaataagactactattgcccaatccctgtgttagtttggcattttatagttgcaaatggtttgaacaatagtggagatttattgtttcacataaatataccatccaggagtaaatacaagcttgtatgtggcttgatgcaaggcccaaacactgtggccaggatccatcttttggctcttttccatttgggtggctcaacttgaagacaaacatttgtcttatggttgcaggacagatgactttcatccactcttgatgctatatcctccagatgcccatccagcagaaaagaaaattacggcttatgtcaaccttcgaacacacatcatagacttcgttttgatcaggccagctttatggtcacatgctcatccttgaacaaatcagtgtgggcagggattggaattatgttgatttatttatgtctgagccattggttccaccttgaatcacataggttgcctgggagttgggtgaataaccaaaggaaaatcattaccagttgaggaggaggaggaggaggtggatactggttggcagtgaaaacaatagacaaataaactatattagtctgctcaggctgccatgacaaaaacagactgggtggcttaaacaacagacatttattttctcatagttctggaggctacaagtccatgatcaagatgctggttagttgggttcctggtgagggctctcttcttggtttgccaatggccaccttcttgctgtgtcctcacatggccttttctctgtggctccagtagagaggggcagagagagagagagagagagagagagagagagctcaagcatatgctctggtgtccattcttataaggaccccagccctactggattagggacctacccttgtgaactcatttaccttaattacttccttaaaggccctatctccaaatatagtcacactgaagatttcaacatatgaattctatgtgcacacaatttagtccccaatacaaacaaaaatgataatccgcagctgtgcatctctgattaatcctggtttaggtgtgattttatccactaggagtccagttgtagttgtttctatggagtctgagaataaatgtacccaggtagcttcaaatgtacactgtgaagatcacctagttatgtacccaatcatgttgtttctatttaccaactatgaatttagggaccaagaagattcctggagactgacatttagttacgattctagaactatgaaaaaatttgacaatcatcaggcaagagacctttatggaactcatctttcagtagtgcctttaatgaaaacttatgagatccacaagaaagccggaagtctgagactatagaatcagaccctctgacgttttgaattatggtgatgtggcccagcttaatcactcatgtattccaacatacccggcgccaaatgatctttgagcacgaaaaaaatcaaattttctctccaataataaagatttgcataattggtaaactctagtacattaattcaaagataattccccaaggggagctttgaaaatatggcaaaaatatgagacatcatctttggaataaaggtgtggccttctaaggagatggcttgtcaatatgagttagagtgactttttataaacttcttgcttccctttgttgtaaacatttatatattacatattgacatacacacctacatatgctttagagactacatatgtactttcttaggcatacatattggagtctttttataagataaaaggcctatatttttatagatgaggctgctttgcaataagattcacttggaacttcactattacagaaaaagataacccttaaaacagaaaagatgatttctcctcctgctgcacatacaacacagtttggcaggggggactctattcatttcagtctctcaggaacccagaacctcatgatgctgccttctaaacaccaggcttcatagttcactgtggcaggatgaagaggaagcgaaaaacccaggactgactattcaattttctgcctagaagtgctgggtcatttctgcttactttttcattggcaaaagcaagcaccatggatcggtgggtgggggagtccaattatcttctgggcaaggaaggagaggcaagaagagcaacatctaacgtaatcatggatccgtgctataccaaatttggttctcaattgaagaatgcaatggtgaaaagttgcaatccatccaagatttattcatttattcattcagctctttagtatctacaatgaaccaggcactgtactcaatgctagaaatacagtggggagacaagacagaaatatgtattgcttttaaagaacttacagtttaggaggaggttacaagtaagtagatagctaaaaattcagagtgggatggaactatgacagagaaagaacagggtgccttggaaatacagagaatgggagacacgactaatgaatgttcctacggttgtctatctctgagctttacaattcagtctctactattttgtgggcattttatgtcctatttataaaacctttcaattagaaattgagacatctattgagtacctaccatgtgggaagtgccctgcttgatgctgttgtatcttatgaagcttgcggaagagagtacggagttgaataagacacttttctttttcccacacagagtgcttaaaatctaataggagaaataagattacataaataatgaatgcagtgcagaatgtggtgtttatcataagagacaaaaagcccaaatgtcaatggaggtatttctgatttggggaataaataaatgcttcatgataagagtaacttttaatgtgaattttgttgaataaatgagtttaatggtcaaagacaaagcatgggggttacatgtctggtggggaaaaaaaaaacaaaaaaacaaaaacaaaacatcaaacgcaaagacaccaaatctgaaagctgcctataggcagagaatgtgattattttattctactctcattacatccccagcatttatcacactgtcttgcatccatcaggtgatcaatgaatagttttcgaatgaattaataggaaaatttgaggcatctttattaaaggtatgcaaactaatagtttaactggaatcttaaggtgaaattaaggtgataaagctggagccaggtcatggggccaggtaaagattttgaatgttattgaagagtttggaccttattattcccttacccctatatttacataaaccattatgttcaccaaagctcacatgacctcaagacggtccaatcaggtggtcaggacagtaattattgccccacccaatagagaggaactcagagacagactaagtaattatggaggttatgtcaggaaataacgaatctaagactcaacacccaaggtagtgcaaactctgtttctgttcctttgtactgcattacccctctgttctgaggcagaaacgcccttttggtgttgggagcagtagaaagaaatgacgctgtcagagctgtttctaagataaactgggagagaaaggggctggcagccaggtcactagggaggagaacattaaaataatgtgggagaagaccaaactgctgtagtgaccatgagcataggcaggctaggatttctttttagcagggataaaaggttttagcataaattctacccttgttggtcaatacctaggtcagggtttcgcaatctcagtactgttgacatttggggccttgaattcattgttgtggagactgtcctatgcattgtccctgacctctgcctgttagatgctcctagcacacactctccacccaccccaccattgtgacagccccaaaatatccccctggccaaatttcccctgggaggcaaaaatcgcccccgtttgagaaccactgacctaggcaatcaattttgattagtttccagaaaatcagtggaccctaaagagcacattgggcatttagtgggaaaacatcaaggaaagaaatgcagtctcatctgatgggtttagtttccttccactgacagtgtgcatgatggcccatagttaattcgtttgaccagcattgcattttaaataatgggttttcattttgtcctatttatggtcattttatccaattatttttattcagcacccagctttataagtgtgtataatcctgttatgttctattccattatgggaacttcctaacagaagagtacacagtaatacaattaaataaacattttggctattgtgttggcctcacacatttcctgactttggctggattcgaatgtggttatgggatgggaagggagacaatgggtcactaaaaagaaagacaaaggtgctgaaaggtgacatgaaacaggtcaccatggttcccagattggtgggaagaattcaggtaccacttaaaatggaaaatatcctgtaatgagaatggagctaaaaaccttaccattttcttcctcccttcaaaattccataatacaatggcaaaaagtttcctgtgcggtgctttgcatgagctacaacaaatgttggtctagaaggactaaaaaaagaatttgcatgttttatatatgtgaatataaataatgtaagtataaatatgaatataactataaatacgtagcagaaattgcaaaggcgtttctaaacacatttaatgtggtaacaaagcttatgcaagaaagaatggagagcacggccttccttcacgctgggctcacttggtgactgggcataatggacaggtctgggcaagtcagccaagacgtgagtcattgtttaggttttccttggaaacaaaagctcctgggaatttgacatcaagtgtttgccagactctgcggacttgttagtctcctgcagggccactaacatcgcttctaagatgattccctgagaatcagccagcttcctccgcaaagacttgccctgagtgctaaccagcatggctttgcagagagaagggaatttgggacatgtctcagggagtcattcatccaacattaagacagtgttaacagggaaattgtgtgtgtgtgcaaccagacatcacctgccttccctgcagggagcttcgacagctgagaaaatgtttataaagcattttgagctctcactggggtggtactgtagaaaggcaaatctttgatatgactttctcacgtctgtcaactcttattattaagcagaggttgcccctgcctttctcaaagttccaatcatggaaactaattattaggagttgcaggttccatttttcacctacccagtgaagattgtgaccacctctgttaaagaaaaaatctttctggaatctacaagagatgtaaaaaactcagtgttgtatgtagtttaattgggaatgaataaaatgtagactcactaaactgcttttgaaatagtccacatgtacaaaacaaaagagagaaatagttggcaagtttcttctcaaaactaaatgtttgaaatatgtgatcaagacagcttgctatgttccaggcaagtctaatttcatctattcccacttgaggcttctgaactttatgggatgtaaggcttttatttttaaaatgctgcaacagaagctgattaattttcaaattaaagcaatatctgacctctagtaagtttcctggcatatagcaagcattcaataaatactgttttttttttttaattgcttttgcagagcactggccttttctcttaagatgaggatatagtggccccaaagcctctgagtattatttagcaggagaaaatctaggccggttgactgagtgcttttccttatattgcacatgatctcacattcccaaaatacccaggctcaggaaagctatataaggccatgtgtcaatcttctcagtcatatatgcctaatgtttagtcctatagactttgagaacttgaataggcctcagatgccatttctcaaattttcttttatggagtaggaaacagagtccatgaagggggaagtggctcactcaaggtcatgccgttcacttctggcagtgtctagagagggcccacatcttctgacattctagtccagctctttattccacactactgcctggagtgctggattctaagaattgctcagctttaaatactgtcttcagtcatgttccattggagagccacaaatcaggagagtagcaaatatatttgcaaaatacataatggtttttatgttgtatgtataatttgcatattggcattttcattacatttgctatatttaatattgttacgctttttcaaaattgttgttctcatccattccacaagtgtttattgagtgtttatgcaaagcattggagatagtggtaaattacacagacaagatccctgtagcaaatgctgttggcgtcaccccctgcccgtgtcctctcagctctcaccaccccagcacttgactgcagagtcttgctgcaaccactcatgactctgcataaggaccttctctggtctgggggtggtggctcatgcctataattccagcactttgggaggccaaggtgggtggatcatgaggtcaggagatcaagaccatcctggctaacacggtaaaacctcgtctctactaaaaatacaaaaattagccaggtgtggtggcacatgcctgtagtcctagctactggggaggctgaggcaggagaattgctggaggcagaggttgcagtgagctgagatcgcaccactgcactccagcctgggcaacagagtgagactctgtctcaaaaaaaaaaaaagaaaagaaaagaaaaaagaaaaaaaaaagaaacaaacaaaaaaaggagcttctcttagctggaagccttcagtcaatgacaggtgggagttggagggtaaatgacccagcttcctcagctttgggatgggataactctaaggttcattctactccatcactccaagttccccaggcatttgaactccagttgtccacagtgtaacccactggataatgtatccattacagacttcctacctctttttgtttcacttcttgactactccttttgtgcttcctgggatctcttcttagtaaactacttttgcttgaatccttagtcagggtctgtttctaggggagctggtctaagtcgctggcttcttgaggctcaaattctagaaaaggatgcagataataaacaacaaatcaataaaaaaggtcacatatgggtacctattgaaaagaatgagatgatagagagtggaaaggggttcagagaaattctgattgaagtgtgaagttggggtccctctgatagtgtgatatttgacctgaaacctgaaaaacaagaagtagttataaaaaaagagcctgagggccgggcgcggtggctcacgactgtaatcccagcactttaagaggccgaggctggcggatcacttgaggtcaggagttcaagaccagcctggccaacatggtgaaaccccatctctactaaaaatacaaaaattagccgggcatgatggcatgtgcctgtaatcccagctactctagaggctgaggcaggagaattgcttaaacccaggaggcagaaattacagtgggctgagattgcaccactgcactccagcctggccaacagagcgagactccgtctcaaaaaaaaaaaaaaaaaaaaaaaaaaaagcttgagaagaagattctgggaagaggcatgaaaaaatgcaaagtgagcaggaataggaaagagaacactgggctgtttcatggggaatgaggcagggagggggaagaccgagtaggttggccttgtcatgagagactctgtagtaaggatcagaagtttatactaaatgcaaggagaaaccgttggaggatgttaagcaggtgaatgcaataatctgatttatacttgaaaatggttactctggcagctcatgggaaacagattgggggaggaaagaatgaagcagtgagctaagttagaaggctactgaagaaatctaggtgagagatgatggatgcttttcagtttccagactcaactgttgatagagaacagaagtaaatagaatacaaacacagaggacatacatgtttatgtcttcgtctctgtgggtatttatatgtattgaagtggttcttagcatttgggggtgagaactctttgaaaatctgatgaaatctgtggatctcctctccaggaaaatgcaaatgtgcaccgacacacaattttaaatttgtgctgacaggttgggaagtcatggagtcagttaataaaacctcaagcatatttttttttttttttttgtctacatctgttagtagggataggctctctataatggtaagtaagtgccaaagtggatcacagttcaaacacatatttttgtttatggataagaattgaaggaaagatagctcagcatcattggccctctggtagaaagactctgagatgcattctactctgtctacgcccacataacaataccaagagaattcgttgttccttgaaattgccctgtgctatcttcaagccataacttccaagcttgccctaggtgttatcttaattctggccaggtagaagggagtacacagaggaagtcttaataggcaaggcctggaagtgggacccattgctctgctccccttcattgactagaatttagccatctggccacaactaaccacaagggaagctgggaaatatcgtgtagctattagcccagcagggtggggaaaaagggaaatacgaatttcagagaacagttaggaggttcagccaaatacacacatttttctttatatttgtcacataggagttgctcagtgttacatttttagagaccagtggaaatacctcacattgtaagtttgatgaaggacaagggatggagccaagtgaaagttggtcaggaggatacaataccctttgtgtcatgatttccagaaccagtttaactcaaagcaagctctcttcctacactgtggagatggggctttcttttattaaggatatgtccttaagtaaaagattaagatcaaattgaagtggaaacttggccccaaactacactgttctgtgcccggagggactggaattaatttgaagcaaactattactcaccccgattatgtgccagtaggaaagggagatgatgatactgtcaacaaggcgaacttttgcattcattttttctcactccaatgagcagtcattctagatctcagatgtgacagttcattggctactcaggcaagcacttggcctgtctactctggactcaactctggtccattctctccctgaagcaaagcagcccggggactcctctttcaaatgtcctttagggagtgggtgtgggcctaagaagttggaggtgaagtccatttttattagtaaatcatattttaccgtttgattccatattccatgacaatggtaaagtcatttttcttggggatggagggtggtgagtcttaccttaaaacataaagaaattacatttgagaacatggcaaattttaatttcttcagcgttaaaagagaggaaagctgattttctcttaacatagtaaaatgatttttctgaaacttaaaaatatccagaagctgttctctcttgagatcagaacctttctaagcctcatatttaatgtttgctcaattcagtacctacagggaaggtcaggtttcttccacgttgcctgttcccagctccttcctctgattctctcatttacatcataaatcttccttttcaaccccctatgttttagctctttcctttaagagaaatttgaaaaagtgttttttttttgccatttattttatttaatttgaattccatcttagagttgttaatgtgtttacatgctattttttcctacattccttctctccggtcagggaaaatgttgagctttcttcaacatgagatggatttaattggttaatttcataatttagagtctttcttggtctacattccaaaaggaggggattctttaagctcagtacagctacatttacttttgaaggagccctttattttgcagtgaataaagtgtctcttattaaacagaaaataaaagaaggtttggcaggactctactccccatggatgaaacatcacaggaaattgagaaattgtttctttttggccttgtgggaaaattttgcttgtgaaatttagtgttaaagttttaagacgactgcttaaatccatcaagaaagagctgttgaatgaataacagcttctagggaagaggtgccaacctgacctttctatatctggtcttttaagtgtttgaggaagtgtgcggtatgatcaagaagattgtattctctcctacataatgactgagttaattttaaacagaacttagacatagttcatcaatttaagaataattttgtcaaaagttggcctcagctgggtgctccttcatttgtgcctataagacagggcattgtacaggcccaaatgagaaacgaatcctaggtagagagtccagtttccattctcagattgatctatgggctctagaattttgatacgaagcctgtgtcttgagcttcagaccatcctgccaactgagggtgttgccttccattttcttcacataggcaccttgtttgaaatttgtggctaaaacccatgttcttggtttgactcctaaatctgttttccttctaagttccttagggactctgtgggcagcataaccacatacttagttgtccaaatctgaaaccttcattgttttctctccacactcccctcaatttgcaatcagtcaccaagttctgctactgtccctaaatatgcctgcagtcatctcctttctttcaccttccccttccccaatacccagttcaggccacaattctctcatgccttgatttctctaaaaacctccttaaccaatctcttgccttaatttttttcctcccataatcctgatttcaccctgcagccaaaatgatttctctaaaattaatctttacaatgttacttcctggcctgagtgttttttttgtttgtttgtttgttgtttttttgcctaactgtgcgattttcactataatatccaaactcttgacttggcccttacttgtacttcccatttccctcccccaaccccccttccagctgcatcagcctctggacacattcagcacttctcaccttagccagagctgtattctgagtgcagtcagtgttccttcctctgctctttcccattcttggctaattctaatctattttctagaaatcctctgagccctctttctcgagccgcctcccaaccctccgttggaatagaggcttcttttctgtgctcacacaccctggactgacttcttggatggctcatcctccaccgagagcttctcaagtgccgctttgcagctcatttctctttgaagactgttctgcctgataaataaataaatgagaatgaataactacttagtgtttttctatatttaaaattgaatcctaattatactgttttaaaattcagttaattttggtgattttggagcatgggaaatgcaactaaaaaagaatgaaaaaaaaacccactatgatttgacatcagaagatatgaatcctggctcagtgaccacgagctgaaagatttgctaagtgtatcagcctccctgaatctcagttcctcgtcaataagcataggataatttctcatgtaaacaaaggttggctgaggaccaaggaagaagtgcccggtgggtaggtggaggcactcagtgaactataatgacttcacaagtgagaggaattcttatttgctttgtatctgcaattctcattgtacctgtgcaaaactccagcttgggagaagcggggtgtgaatggtttcatggggcacacgatgggaggggaatatttgtgaggtctcttcccagttaggtggagccacaccaatggtggggaattcagcaattcctgtaaggggaaattggaaattgtgcgtctttagttttcccgttgggtagagctcaaaaacacacttctaccctctcaaatactgttggtgaaagtgagacctggcatagtgttgtagcaatttgataacctgtattgagaaccttcacaatattcattccttttgaatgagtaattcaatttctagaatttatctaagggaattatttttaacaagagaaggggagcacttaaggtgtgtaaagatgttcattgcagttgtttattatagttaatgatcaaaaataatctgaaatgtgcaatcagtgagggaccatgatcacattgcccttcagtgagttctctaaaatgggaatgtaacattgaaaaacatcttaagtgaaaaaaacaggcttaaaaaattcaatctatggtttaattaaaagtgtttaaatcaaacaaatttaagaaaacaaaagatgaccagtgggaaaatacactttgttttaaatggggttagttgtaactaagaaatccataggcaggactctgcctccctagactaacagctccaatgactgaagttcactgtcttctgtgcaaaggaatctttatttggctttggctcaaggctaggccttcatctcatcttctaaaacctagaaggaagctttcagaggaaaatatagatcagaagtaaaattcggattagaagttggggggctgaagttgtaggatacgagggagggaaagcctacctttacccttgaacaatcatcatgacaacaacctcctaagtcatcttgagtgtgcaaagtgcttttctgtacattgttcatttaaattgattcctcttcagtttagctagctaattatccaaaatgtctgtaaaaattatgacagaggagggaaacacagttactgatttggggtccattccctttacccttctcatattcaggtatttccccactgtgcagaattcactttgaatccagcggaaattacctaggaggaaagagctgggctcaggaaggaagcagacatttcactgtggctttattcacgggaggctctccagacgtttggcaggtcttttcttacatgtgcctactggaccttgtgttctaagaggcacagaacagctgtacacagcccagtgtcacacagcaagtcaggagcgagaatccatgtagaattaagatctttttttccctccctcctgaatctctatctagcccgtgtctactctcccacgggattttgtgttgctttttttaccgtctgtctcagcttcaaaaaggatctgttttctcttattattttcccacattgctgcggttcagaaccgtagtgcatttgtcaaatgcattgtgtgtgtcttcacccctgcagcttccctgtcagatgattcaatacaaggcaatgatctctccactaagggggaagaaagaaagtgagaaagaaagaaaacagctcagagcccttaaccctgggttgtggctatttttctcatagacaggctgctctctcttatctgattggagcctccgtgttctctgaataggaaataaatctctacacaaaaatccaagggttagtttccaggtgtttgataggaagctttcatcccaagtggtttgtttatttatttatttatttatttatttatttatttatttatttttgtcggggggagtttgttgcattatttgaccaaggacagtgttgaccacctccggtttctacttctctttcgaagtttattttatgttttgttgtggttttcagatttctcatggtttggatttgggaaagtaaaatcaagacaaggtgttggtaagtagttaactcactccttctttggataagtaatgagtctatgtttttattcggatgaaaatgcttagaccctctttacattccacggtctttgattcattttctgtgttcctggtttttgatttgttgaagaagtaggtctagaatttttccagaaaaggcattactgttgttaattgagtttagtacatggttttacatttttagatttgactcgtttttatcctgtgggggaagtgttaactgtcgttccagttctagtttgtgatgcatttttaagaaggttaaggaaataaatacaactacatttcagctacatgtacagggaatagctgactgaatagtcaagctggacaagtttaggtcttaactttcttccattggccaagatgtaatagagttctgaattggtaaatcagtttccatttatgaccattcctctttcaaaacagattctaacgtccagacgctgtgatttctgcttgattgcattctattccctgcattcagactatgtgctgacaattgaaaagcagtttgtagcttaccaagtgaatgcagatgatgtagctcctcattagaattgaaatcaggtgtgatctcttgggacctctaatttgttcagaattttctatgggtacagagacaatgaacaggaattgcttagaaggcatgaaaagacggcattcttacatctttcatgtgggtttccaagatccgaccatcttgggcatctgttggttagttattcttttggtagcaaggttggccataggtaaaatggcaaagtaggggaaatgtaccaatgtcaggaggctgctcaattccaaaccatccaccctatgcttgttcatcctggccatataaggagctgtttcctgtcactttccatcctgacgtcagaccttgtcttgttgggcagtctctatcactgtctgtccagtgatccaaaaatgaccagccggctgaggcagcctggccagatggggcctggagggggaaaagtcaccttgactctcgctagctccatggattccaaggttaaagttcttaaccagcaaaggggaagtggagacttggcaaagttagaacatgaagctcaagtagtcagggcttctaggcagctccctaggggcaaatttcagacacagctgatcatagtcactttgccaagatatcagagggatgatcctgcctgggcagtcttaaaggtgttctgttttacgggtttgatgtgtatgcgtgcgtaggtgtatcccgtgtgtttttggggaaggtggtaataaactctcccatgacagtcctataagacagggtcttgcttctgctaaatagcaagtcattgcaaccacttaaatatttttccaagccaatttgcactgcagaagggtgcttgttcccggaaagctgcaaaaatgtggttttactgttttaggccacagcagagagctcttcagaattattcttccggctgcagtccagcagaggtgctgctcttataaaacataggtttcattatttttcaagtttggtgagaccaacaatttaggagatgattgccattgagaagatagtgtgtcactcgtggttcccaaaagaaaggggcacaccatggcatgcagagccacgtggggaagtgctgggatccattaaaaggcagaggagggaagggagaacttgggcaggagcttttagtgtgtttccaggtaaggaactggggagggagggtaaacaggtttaggactggctagtctgagtaacttcaacaggctctagggtacaggagctatctagagttgtcaagtacttggccctggggtggggagggcaggtggatagtggcctagagtgtgagcctcacatctggaaggtggttggggtgttgtctctggattggttggtttgcatttgaaaggcatgctcccaggcagggtatttaccatctgtaggaactgactcaccaggggtgggaggggccattcctccaggattagcacggccccagatgtcaaagcaccagaatccagaatataaaaaggcttgcttagtacagctgctcaagagtactaacccttcccctcaccttgaaggcactgttggtattgagagaagaaaactcccccagatgaacttcgtgattcttatcacaggaaattaagtctacattaggcttagaaatgtctgtaaagtcatagtacaggatgtgtgaccaagcagacatattaaaataaaaatgggctaaaaatgtttccagacttaactcatgtttttcagctgagtaattagaactatttaccctaaatcagccaagtgtgcacctacctcgccatttaaaactttatatgaatattataatacattttttcaagtcctcatatgaatttcgtttaacacacggtgatgtgcccctttattcttctgtctttttcatggtgcctgctcaaacacatgcatagacatacaaagacacatcctgtgatatgcacagacaggctgctgtcaaattatgtagacattcattgtcccgctgagagcttcttctgccttctcaactttgctgtgctttgcattccattatatcaaaatgttcacagaaaaatgggcttaaaccctgcaaccttgccagccatatcaatcttctaggttttggaacatcaataatgaagaaaacagcacttgaattaatatcccccttgatgaattgttgaggtttatgtgttactcacatttgtcaacagtgatttttctggcaaagtgaaaaggcttttgaaaaattacctgtggtgctttttactgcttctacgcttaatcctcccctcgctccccaaacaagagctcattcccttgcaatctgttacattggagttggggggtttaattggagaggtttaggaaaggaaagggtatcccttagtgaggaaggagaagcagagagcaaatcacttggttggactctttaagtgagggcttcgctgtgtacttggcagaagattcaaagtctgaatttgggaatctcaagttgtcttctaggtatcagcctcctcaaaaatgattgaatgctgctctgatgttcatgaacttcagagcatcctgggccaggggagagtcagagaagaaagcaactggggtcaatgcatttctaatggttccaggggctccagaaggaaatattgctggatctctgacagcacgtggagtcttttaaaatgaaactcctgtacaaaggcataagaatgataccaaggacttccgggactgtggggaaagggtgggaggggggtgagggataaaaggctacacattgggtacggtgttgctgcttgggtgatgaatgcaccaaaatctcagaaaccactaaagaacatattcatgtaaccaaacatcacctgttccccaaacaactattgaaataaaaagaaattttaagaaaaagaaactcctgcatttctgggggtaaaggtggtgcctggaatctactgagaaacatgcagccttggctgcagtccttcagggagcgcaggcagtagcatgttttagtaatcttgcaggagggaacagccatgccgggaaccaaggaagggagtcagtggtgagaaggttttgttgacaagatgcggaaaccttagcataacacatcttaattttcttttttttttttttttttttttgaaactgagtctcactctgtcacccaggctggagtgcagtggtgtgatctcagctcaccacaacttctgcctcccaggttcaagtgattctcctgtttcagccccccgagtagttgggattacaggtgcacgccaccacacctggctaatttttggacttctagttgagacagggtttcaccatggcggccaggctggtctcaaactcctaacctcgtgatctgcctgcctcggcctcccaaagtgctgggattacagatgtgagccaccatgcccggccaacacatcttcatttttaattgatggccagaagctggatgatctaggcctgtcagggagcaagtagcagaacagggatgattaggagtattggaaagaacttgtctttgtagttattcttggcaggatttctgctgtatcctaatgcaggtgaactaggcacaagacgaacacaactgatgggtttgcctttgcttttgagtgttctgtggcttctaaattggctgtgtgaggacttgtttgcagaattgagccggagcgcatcattaaaggcagcttcaatgcacatccccttgagagaatgcttcaaaaattacctataataagagttggctgtctcctgcatagtttgtttaagacactgcttagctggggaatgtccaactgttatcactacaaactgtgataatctccatatgagggggaaaaatggatcttggaggttgggggatgagatattattatatttcataggggattcaagactggatgacaaaacaacttttgttttcagaattgctgtgcttctcactaaaatagttaagtgtgagggaaaaggtaaaggatggaagtgctgaaacatgcatttagtagggggggttggaagaaagcacatttccttgcgtaggaagtagcaattcagacatttccctggcatggcatttgccttggctgggcatttgattctgccttttcactccctattgtcttttctctttattctttctctgggcttgtgccagtagtcgggtcagtggtctgcttccatgggaccctgcctgtgtaatacatatcttgtgcacctcccacgtagacagtgcctgtcatgagccactgccgtcttcgttggtttgaagctttcacgtagacctttatctttgtgcatctaattttggttgcaaacagtatgagtttagtggctaatgggtaaattgtttagacaagatacagtagactgtatgtgtgagcatatacattctgagactttgggctagaaaatttgtcttgtacaaaaaatgctatgattattaatttagtataaagacaccaagttatgactataaatagtattacagctaacaacaaagcaggtaactttgccatgggattgatccattattgttataaaagtattttgtagacaaaagtggtgcagatactcacagaatatgaagaaagaggaatgtagtcataggacagtcaaatgtatatctggtctaccagttaaagttcatttagtaatacctagtattaatacatactcatgaagcatatttaaatttataatacattttcctgttactaatctcgttctagtgtcataaaataagcaaatattattttgcatataagtcgatgtagaggtccaaagaaagtaagtgacttgtccaaagggtagagaaaggaaactcagatcctgaaattcccagaacaactttcaatgctctgtgaaatagggatcccagattcatgttgacagtttcaatgacagagtgttctagagacaatcatagaacagagaggaaagctacgtattatcttacaggagaaggaagtgaagaaattggagctctcatacactgctggtgggaatataaaatggtgcagccactttggaaaacagtttggcagttcctcaaaatgttaaatatagagctaccatatgacccagtaattccacccaagagaaattaaaacacgtgtccacataaaaattcgtatatgaatgttcatagtagcattattcataatagccaaaaagccagaacaacccaaatgtccaccaacagatgaatggataaataacatgcaacatatccacacaatggagtattattaggcaatacaaagaaaggaagtactaatacatactacaatgtggatgaatcttaaaaacatgatgttaagtgaaggaagccagttacaaaagaccacgtgttatatggttccattcatatgaaatgccagagagatagagtgtaaatctgtgaatgtctacggctgaaagtggagagaatggggagtgagtgctaactgggtgatgaaaatgtcctacaagtagattatagtgattattgtactactctgtgaatatactaaaacccactgaattgtatactttaaatgggtaaattttatgtatgtgaattacagctcaataaagccattgattacaggagaatatatatatttttccatctccaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatgtaagtacagctgtttgtacttattgtcccatttgctgcatagctgtatcaaccagagtgtttatcagagcccctgatagggatgactggcggggaacagggtgcagtgaaatgtttgaggattcttgcagcttttggcccaggaatagatcctttagtttgttgcttatggaattctccgggtgtgtctcctgctgggaagggaactgtgggcagatactgactctcttgggatctattttccaaaaccatttgtcaatgtgaagttggaatcaaggcatgcttatcttgaaaaagagagacagaaaccagaagtgtcatttgaatgcacatatatcagttatagatgacaagcaatgaatgtaatttaaatttagcctatagaaagtaattgaaatatgcactctaggtagttgggaaggcactgtgttgcccacaggtggtatcagtttggggagtcctgtattctttgctcagtccgagttcccagcatgaggccttgttgtgttgccacaatagcaaagagacatggcagcagatgatttgcatattaagtacacttactttcatttttcaaaaacaaattaacccattaatctctgttagcaagcttgagatttttctaagggccttttgtgctatcttctgcaccactgctccaatattaaatgtgtagcacagccttaaagacaacaaaaaataaacccacagtggacaaacaggcttatggcattgcttccaggccttccttcatatgtgaataaggggccgtgagggctatgatgtcagatcccagagattccctgccactaaggagtgggtatcatgcatgttcctatcctgtcttaaataccattctcctaccttgtcatagaggtaaggtagaggattactgcaagattaggctttgggggctgcctctctgttgagagctttcatgggatgaagggccttagcaatgagtatcagatctgtgcatatataaggaaatatctgtaacttcatcctattcactcaaatttatcccaaggcatgtttaaggttggatatgagtttaaatgttaggaagaacagtattatgagcttttaatgtgtgagactggaatccaccagagattttggttgactctgtaacatgacaagataaatagaataatgtgtgaagaatattgagctccttgaaataaaaggtattagttgaaattaaggtattattaatcttaatactgtcattgtggtgtgaacaaggtgagtagaggcattgcttaaaatgtgccttctttgatggggtgagcctcctccaaagatccttggaatgccctgtacacagaactgtcaaataaggagtaagactaagcaggatactgtgatgggagcatctgtcatcattttgattgttctccctaggaatagagtactttgacattgacacctcagtcaccacccgaaccaggcctatgatgcatttcaattagcctgaggctgtagtataattgaggctgataaaatcaacataccctcaaaaagttgctttcctttgtggagggaggaaagataaagctgcataattaagtagacccgatcagcccaacaagtccagtaagagaaatcgaacaaacgagcaagagagcaaacaaacaaaataacaaatgagatcctctagtcaaaagtgggctacatgtctggaagtgctttcttcccttagaaattcagaaagaaagatttcaaaggttatttccttaatctggagtctgtggagattttttgcaaaggtttgggttccttttggagcagtcttgattgtgtggctcagtcattctgtgcctcctgtcagtttctggcctctacccaaatggccaacctccatttggtcactccttctgtataaagtcttgctaggccctgcacccaaccgcaatgtcccagcttagtgtcctcagtcactccacaccatatatcaaacgagattttcatttttccaggcaacaagtcactatactctttcatgattttaagaacacttaaaataacaaatcttccatgaatcctttttcaaataaatgagaatgaagaagcgatttacttctttccttcccttcacccttttgtaaatgtcattttttatctcataattttttttcctttatcttcggtgtatctgtggccttttgttaagtagtgagtatgagcactctcatgtgtttctgcagtctcttttaggttagactgtaagctcttggagagcaggatctttatctgttgaaccattccttcatagcacaggacgtggtgtacctttgatgtcggccacatgttgaccagatgtagctttatattactgaaatattaatttctagcagatatgtaacaagaaagatgactcataatcattttcattggttttattcctatcaaacttgcctacatagttgtttatttattagacatgtttttaacaatatattagccaatttaaacagatttagataacaattttagcagaaatagactttggacaaaaaaatcttttctttgaacattctaattgtagtcgtgcagaaattaaaatatttcaaaatgtatagacctgacatgtagatgaatctgttggtgtaggcccatgaaatgttgagaacttagatttcaattagataattcccattgactatatatatatatatatatatatatatatacacacacacacacatatatatacacacacatacatgtactgtatatatacacacatatataagtatatgtacatatacctatatgcacacatataggtatgtgtacatatataagtatatgtacacatacctatatgcacacatataggtatgtgtacatatacatatacatgtacatatacatatatgtggggtgtgtgtgtgtatatatatatatatatatatatatatatatataaaactctgtcacccaggctggagtgcaatggcacaatcatagctcactataaccttgacctcctgggctcaagtaatcctcttgacatagcctcctgagtagctaggactctaggtacacaccgtcatgtctggctaatttttttttatttttcgttttcattttttgtagagatatggttctcattatgttgcccaggctggtcttgaactcctggactcaagtgatccttcacaccttggcctcccaagggagggaatgcaggcatgagccccattgaatattttttacaaatgagcttttaaagaacctccaaagaagggctctttcaagaagttgcaatgataaaaacatttgagaagatctcagagagagtttagaacactttcaatgtgcttacagcataatatcacatggacagtacaatatcgctattcttatggatccaacagagacttgagccaaaacctggcctatttacttctctttcctaaaactgcatgctattcaaagatgttgactttagaatatacatatggtcttacgaagatcgctgaattgtaagaatctaatatatgtaagatctatatgtatgatcttactcatctcactgaattttaagaatctgacttatataataaagacgattcattacatatttatttataacactcttttaatactaggaacgagagatctcttgaaaatgatggcttgttccctgctctcaaggagtctcactggcaaggccaatggttagatcatcatataatcataatgcaatgtgatagacattacaacaggataggttagagcacgggtccaaaaccccaattaccaacaacgatcaggcacgtcaatgcaagaaacaggctgaaggaaaaatgatatgggctagtgagggccatgctggagtatgggcctggtattgacagatactataatttttccagagaaaacaggtgtttattattttatgtggattccccaagatttaagacaccgggtgagataaataaaaatatatcagtgtgagtcaggtttggctcacagtctaccacctgggtgtgatactctgagttagacttgaaggatcaatgaataaaaacaccttattttataaatgatgctcaaaagtggtttgtccagagtgacacaagctcaatacttgcatagtttggctttaaaaacaaaacaataaacaaacatgatcaaattcgacttcttaaaatgatgcataaaatcatttaagtgaaagatggtgatcaattatatcccttgaagtatgttttcactatctggagtgatatgagggtttcatttacaaagtccagagatggtttgcaggattgtagagcaatctgaacagggctgaattcctcccgagcactttccaatagcaagtctgtctactttattgcagggcccagaggttcccccaagaccgcctgataataatttggtatttggaggctcctgtgtcactgcaggaactaaaggaggctaaatccatgcctgatggaggagaagagttctatggttatctgcaaattctggccagacaacatcttgacgtcactccttagcttccataacctagccaagcaagaagttgcctttccaagacaaagcagtgtgctctaatgactaacccctcaaagtactatgccactttaactatagacccatctcctcgatcaatcaggatggcaagatggagctgaggagctcagcaacatcaagtctggagttggtctttaactcaactagctcgtttagacgtgtctgaacaccacatcacctgacagcacggggtggtttcccagtaaaatttacaaactcagctcaagggcagctgtgttgctttcctttccttgactgctgagaaactttttgacagggaacaatggaaacacaccttctgagctgaaacaaacaaacagaaacaaaacatactaaccagcaaaatccccaaatcatcaatcttgggttctcttgaagggcaggagtgtgttttatcttctcccgtcggagcaaacactatagatgtcctccctaaaattctgtcttccctagagcagccttgtaaattagctagggtcctagggttgaggcctaaatcaacttaaaattgtctctaaatatgtacctggatgtgtttgtacttgcagagcatgccctcttcatgtgcctagggctagtaactccctgtggcagaggcatgtaaagtattctgactttttttttttcaacttaattccatttccaatgaaatggatttttaaaaattttctccagagtgtgccatacttctccagctattatagttaatgtgtgtgtatccttgtgtatatgtgtgtttgtgtgtgcatatgtgttttcctagtggttacatgcttactaggcaattatgtaaataagcacagattcataggccagctaggcctgaggaaagaagacattataaagggagggagtattttaacattagctaaagctatcacacaaggcacccattctgctcccctcaacagccacagcccacttcgtccttgtcttaccaataaggggaaaggctggaggtgatatttttcacagaaccgcagaggttttgaacatatttgcaacattactttgagtacacatgagcaaaaattctgaattacatccaggaccccagaagctcattagatcaaagagtgcggggcccctcagagttaccagagattatctgcagacttcagtgcaatcgaatgaccatggtccattttgatggtcagaggtaggactgaaaaacgggtagaaacaattgctttagcgcttccttctgtactttgcctattaatgttttgtctttcaaaaatatattttctcctaattgtttaattggccaaataatggctgctttgggagttgtttgtatgccttggaaggccatggcctgcactttaaaaataagctaagtccattctgcccagcacgagcattaggacagagaatgcacttattttaggatccttaaaaattgcttcttttatggcacactgggttgacgactcatctcgtgggagccttcatggcacattgctgctgttctgcaggtcccaatacaattccttccccctctcagtgccacggcccccccattgctagctacaacaatttgatatcatattcccttttcaactccaaaggagatgataagaagctatcaaataatgctttaaaaaagcaacttgagtttcttaaaagaaaggaaatgaatacatgctgcataattacatttaaaatgtaagccatgttattataagccgcactgagatgaagatttgttagcaaaccagtttcaagcacactcacagtgaagtaaaatcatgtttttagcatctgaccattgggtaatattattctttgttatcaaaagagaaatatcacccaagtatagtatacttagacctcctagaggaaacactccagtcctaagcttggtgtctgaaaagaaaaacaaaaataaagattatggatttaggtcagggagacagagtgatattctgaagactgtgtttactccctcatcatcggccaaccaagatggagttctgcatcctgcacatatcagacatttcagtccaatttcaccaaagcatcagtgatgttctagaagcatcccagcagatggaggatcctaatgtatttgttctgggtatttcccaaggcccagcctgactggagtgtgtgtaccaacaggatgaatccaatcaagctacgcccccattttggtttcggattggccactcttgcatgtgctagtagattgtggaccaggaccagctgagcaaacacagttgcagagtagcctcctatgttgctaagaagctcctgctacccaggtgctttgaacaattgagtgctccctctggttaagtagagatggcaccaccggagtttttcttggatgtgaggctcaatcctttacggcagctattataacaaagtgaaggttttctccctgggaaatgcagcttttctctgtctttactaattctgccagcctgtgagagtaaccaccgtagctgggcttcttctcagattaattgtcatgccaggtctccttcctggggagctgtgatgctgctctgaggttgattgctgaggttgtagtgggtttttgtttgtttttgtttagtttttcttgattgttcttctttctcttgaatggcaagagaagaaacactttctctaacccacggccaggaaggaaatggggagagagctacttcttagttcaacctggttgccacataaaggaatctctctccttggactcagcccctaactggaagcaagagccactgccctctgagactgagagagcagcccgaggaggagatgaatccattctgccctttgtttgggtttgcttcctgtcagtgagagaatgctgaggcagttcctgttatgtgaaactttcatttttaaaaccaggacagtcctaaacagactggaatgagttggtcaatcccagttggtataggcccaatgatttttgctagtaagataggattgtcttcctcacccaaaatgccttcaagtgccctaaaatgggtattttaaaataagaataaataatgtagatttagtagaaaacctggaaaacataagaaacaaagatgaaacgaaaagtcccatgtaattccaccagttagagttaaccactgatatcgtttggatatatggctttctagtcttgtggatatccttttaatctcttgtaatataaagtctgaccatatgtgtccttgcatttgtttgtactggactctgttaatatttctatagtaatggctcactttggggagattgtgctgcacagtgtgtaggaagcacattgggtgtattattcccagttttgtattttgtatttccttggagatgtgcaggggttaagagcgggggtctggccatagctggccacgtcagactctcatatggtaagtatcacagagcacatgaggcctgtgttatgcgctggaaagactcaggaaatgagaggctctcttgttctgacaaggcaggctgagagctctcatttagggtcatcactccagataactccaaatgcagtttattgctcaactgaagcagatgatcactttttgcctccaagttcttcaccctagctagctcctttcaaagagccgagtatgctggatcttaaagggccaaactagttacatctcatacatttcctgatgtttagggatgccttcacttccatcaaggataccttggctgtgcaaggacctctgatagctggagtctccttttggtcactcccagctttgcttaaacttgatggagtttgctgtccagtgatccccggatctttcatcatgaaagccttccttcctctcctgatgtctcaggcctctagacctagactggggttctggcaaggaggcctctatcaatagtatgacatccaataatatgttagtgttgatattttgcacagtaatattaagtttaagagattataaaaatgagttcaaatgaataagttcctgtgatgtaagagattagatatgtgtgatttcagaaccaaaggcaggggggaatcccagaaagaaaacaataatataatcctagtttctatatattatttttattcattactgtatatgggtagagatcaatattctttcttatgctgttactattaattaacacattttttaaccatgccattgaacttttgggtgcattaaagtggaacccaagctcctcattagataataatggcatttggactgagtgccatattcctaaatttccaataaagtggttgatatagagaggacaggataaagccctatagtgtgcagttatatcaaaacagctagtctccactttagggaatgcctttactagagattacatgaaatgtctgcttataaaataagcagagatggcaccactaagcagccacctgaattgttttcctacaggaatgattacttttcagatccatttatgttttcatgctcaatacttactccccttccctgcaacacccaaagagtttacttttgcaagtcatttggtcttcagtctactactgaggaatagagaggcactaactgctttacccaggatcagaactcatgttcttaccttctattaatagagtacttgagccagatggactaactggtctcacattttctctatcttggttttacttccataaacatcaatatctttacccacatgatttttccatcctcccatttttttccatatgtattagggttcaggaactatgatgctaatgatcacatttcttcctagttcctaatttcattagtgccatttcctgatatctacagaaacaattatcaatacatgtagctgcttgagccttatttagaaggctagcctttcttttccaagtgctgtcagaatgtatacatttagtctgtctttttcccttttaggagtctttgttctgggttgatggcaaaattcctctttttacatgtgagatttttgatttcactgaattctacctagatttttatggacattggattttaaagaggaaaacactcattttcttagtaagatattggtgatacatagctatgccattgatttccatactcctgagctttggggagggagacagtggccaagtagcaggcagaataagatcatcactcatgtcctgaatcaatcacactttccttctcggattgtgtatatgctctgccacttcctacatattacatcctgagtttttaagtaaagtggatcttagccagatttgagtctaatggctgattcatcggcatagttcttggcgttaacatctcagtgtcctctttagttctctttgaggattcatgtcattgagggcctttgtgcctccacttgtctcagtatgaggaagaactttggtgtgagggcggagctatgtgaagggttgctgggttgggggattagttcatatggtccccatgccatctatttacttttggagagaggggactttgagtgggtgggtatggatagatgttcctcaaggaaaccctgctggctaatgggcactacatctgtgtattactgtgattctctctgtaagctccccatgtggccaaggacccccctcctaccagggcacttcctgccacctcattgcactggtctcaaccattcagcctgctgctgctgcaccatgttgggctgcggtaggatagggaaggggttctgttgattgctaaatgttgcctaactttatttccctctcccacatttcatgcaagggagcggacctaacacatgacttgcattctcttcctatgttcagaaactccagggcttgcccacgtgtatgtatgagtgaccaatggagcttggaattctttatctatatgatctgtccgaaaatgagatcttttgtactggaatttgtgatgtagttgatcattcagagccaaacgcatataccaataaagacaagactgtcatatatgtggtctctgttgcctactttcgtcacctgctaatactttttcttacatagacttgagaatataattcaacattgggattcctcaaggcaccacgaacagagctctagaagttgtccgcattggttccccagttgcccccacatagcctctctgggttttctcgaagcaactccttcactcaggtaggccagcactagggtgaggcaagaatgtcacttgcttaaggcacagaatttaaagtgacaccagaagtgtcagtactcaagataaataatatactcatgcaacattttaaaagataaaaaagaatgcaaaagatctatgaagaaaatatcaaaattttaaataaagccagcataatcccaggagggctgggatgagtgtaaggtgagtgagcttagtcctacaagttcagggtcagatcctgtctttccttaaaattctgatatttttggctgggcatggtggctcgcgtctgtaatcccagcactttgggaggctgaggtgggcagatcacgaagtcaagagatcaagaccctcctggccaacatggtgaaaccccatctctactaaaaatacaaaaattagctgggcatggtggctcatgccagtagtcccagctacttgggaggctgaggcaggagaatcgcttgaacccaggaggcgggggttgcagtgagccgagatcatgccactgcactccagcctggcgacagaaagagactatgtctaaaaaaaaaaaaaaaaaattctgatattttttaagcgcaaatatttgcattcaattttatcaagaactattgcattacacttaatataatttatctcaataactggatttttagcatttccttaattgtgtgcacaaagcaagaatctcactccctttagccttgaccttggcctcagggctccttctggcctggatcttgtgtaaacctctggcctttgcaaagctgttatgtgtacataaacttctcagtggattgtctgtcagtcttcggatacttcctgagttcctggcctaattgtccttcctcactgcctcgtcttcccttggagatgcagtcccctgtctcccttttgttcagccagcctcagcatctccagcagtaaccatcctgtgctatctactgaaatagcagataagtgcatgctcatcttctcactacatttttaaaatttttatttgttgtatgtgactctccagagtgaggaaatgaatgaggctgccaaagagagagagagagagagacagagagagagtgagagagagacggagagtgaggcagagacagagacaaagagagatagattctttggaaaaggacaggagggaggatcaggggactttctcagtaagtctgagaaataatctaggggaaaaatggataaaatttttaaaaaataagggaaattctttaaaaaacctatattgcttttgtcccccacatttggaggtgtatgatacatttgctaagctgaagatacagtatttgagatttaaaatattccattttcactcagccagtttcttaatgccatgcgctctttttgtaatatttgcattctctatttttatataatttctacctaatgctttttatgggccaggccccatggattgtattttcacattaaaaaaatcttaataattgctgcagtatagatattactctgttttacagatgggaaaagtgaggctcagaaaagttaggaggaaaaggaaaatgcaaattccatcctgaacaaggggttgttattgaagcccaggtggatgtcctggaagtgaggactctttctagcccagtgctgctcatcctttccaaattaatacccagcaattttctaactcagcaagaggaattgtagtgttggcattgcccctttcatgtgggtgatcaagtatgctggggtgtattaacctttggatctgaagggtgaggagtgtccacatggtgggtgctgaacttactgataaaggaggaacctgccagtgggcagagcccaggccatctatggtacaatgattgatataggctcactggcctgtgatgttttctctctcagtagtgtctttaagaaatattaaatgatcatgaatataaagccgttatttttatttttttgccaattaaaattatgtaaaattccactttttcttttgccaagccctctctgaaaagtttacatttttagttttagttcagaaaatcctagaaaaagcaagctataccatagatctcagactctttcttgagtgggttcactcctcggagattagcatatctgatttcctaggtgaacttgatatccaagaaaagaattcaaagtgtgccaactgtgtttgggagcatgttgaggtgcatatatttgctgagtttctgtaggcaatgctgggaggagtgagaacccacagctcctgggcagggtcaccctgtacaaggaggccaagggaacacagtgtctagtaaagccttcttttcagcatcctatggggaaccagccttgatgcgaatcttatgagcatcgcagaggacagacaagtactcctctggctcaccttctacaactcgttccttcattttccattcaaaggtccatgtttccaaactggctaattgaatggagtcaaaatttctatagatctttatgctttagagagccgttttaaaaacaagagttggcattcatacgtggcattcttccaagcctgcatctacgtgcttcataaagtcaggagatatcaaggagctgatattcttgagcactttgtgacagacacacatgttgaccaatatctcatataagtcttttaatggagagagtaacacatgttctttaaaaacatcatacagcacttctttactgggcttggtaagtgcagatgagttagaacggcaaggttagccaaaatgaataattattttctgactcaatgtttattctcttaattatcttgataactttgaaaaaaccatagtttggagtatgaattattcaaatgtagttcaaagtccattgtgacaagtaataaaatacattcaaaatattgtttactagagtgttccaagcccgctgaacctctatgcattatcagctacaaagctgcagagcatggccagccctttggggtggagatgcagccagagagtggtttggagaaactaattagaatgtgacttcagagaaaaggggctgaaatatttccaaacagagaatttgatgagtcctttgctttccctggggtgggggttatgtatgtttctgcatgaatctcgaaatatttgccagtatggaaaattttcccaatgagaggagataaaacaaatctctgactaataagactgtctgggacctttaacaataaaactccaggatggggaggggacaacaagggtaggaatgaaagttcagattaggcttagggtatatgtcgtatgtctctgttggatgatgaacgtgtaatcaggaagtcacgtctcaccaggaattcagtggcagtagtcaatgactgatataaaaaattgcagatggaaataaatacttattggcaattttgtaagttctgaatcatagtctgttcaacgaacaaacaagtgctttggcatctccggctcctagaacagtgcccaagacattgtaggtttataataaataggtagtaaactgaatgaacaaaagaatggatgatcttatctactttgcctgtcatcttactgtagctttgggaagaaaatacatctctacttcattgagcttcaggcatctctagtatttgcctatgattctggtaggagcaaaaggttggttatctttccttttgaattgcatattagctatgcccattgccatgtctgttcagtgttgggtttgaagctttttctcttgctctttctgtcccacctcctaagtaatttgtgttttgagaattctcctgtctggttttgtaacttgggtttcaggtatgctaaagctttatgttttgtattatgagagaataatttctcacaaggcctaatgctgaagttttaatggaaatatacatatttctctcattgaatttacacaatagtcatatggtgggtattcttgttactttaatcacacagaaggaaaacagtaaggcactgagaagttaggcaacttgcccaagaacatacaactactaggcaggagagctaggagttgaacctagatacccaaaccctagcatcggcttttaatgcacacactgaattcgtgcccgtctctctgtctagccatcaagccaggcttctttcatgctcccaccaacacacacacacacacactgacccacaatggatttgaggcagtttacgttggaaatgcagccagtttaactgatgagatgggtatctgcaactttctcattttccctgtcatttaaatcctgaaatttctttccatactataaaacactgtttagattcaaaattgacaacaagggagagtatgattccaaatggtaaaggccaggccagagtctcaagtccttcatctttgatggagagccaccccttggccactgccaagggccaaggtgatttggaaggtgatggtagcaagttaccaggcggtcttttatttgtggctttgctcagcttagtttttctcaaatatgcaagaaagctggaggacaccactgttggaggagatctgtatctatttatccttaaccccatgtccggtagcaagccacttggctgttggcagttgtcagcaagcaaaagctcttggacctgtgtttttcactgtgtcatctcttttgttctagtgtgtgtgtgtgtgtgtgtgtgcgcgcgcgcgcgcatgtgtgcattataataactagaaatactttcttttatttatttatttttccgagtcggagttttcgctcttgtcgcccaggctggagttcgcgatctcggctcactgaaacctccgcctcctgggttcaagcgattttcctgccttagcctcctgagtagctgagactacagacaggcactaccacacccggctaattttttgtgtgtttttagtagagatggggtttcaccatgttgtccaggctggtcttgaactcctaacctcaggtgatctgcccgcctcagcctctcaaagtgctgggattacaggcatgagccaccacacctggcctgctagaaacactttctaagaatcaaatccctgcatccaaactggtatctatcaaatctgagtggctagaggtgaggccaaataatctgcattgttaaaaagtccccagacgattaggataaatgtaagagtttggggatcactgttccaggttagacccattgtggaaggttctcatccagaaggaccatgaagctgggtaaggtgacgtgaggtggcaagctccctgaggacaggcttgtaccttggttgctggtaagtttttttcctagccttcccagctttgctgatacatggttacccttcctggttgcagtacaattcttttaggttttaaaacatggaactgtttcactcatgcgggtttagggcacagggattgtggttttgagggtatagtagcacaggagttgaaaaggcatttaagggatagtcttgtcattctaatgacaagcgcaatgtctccatgaggccatggttcttgtttttgcataatcaacatggaacttgatccattcatgagtttaggattctctgtgcaccaacaatacacctgacatgggtcaccaaatagcggatgagaagaatctactgattgatattttcacaaacacttcataaagttgctaaaatgccaaaactcctaagcttaactatttgaaaaggattggcaatttttttaatctatataatcagcaaaatgcagaaatgcccaaagtgggtgagattaggctcaatccttctaataattcggtatcaaaataattagaaactggagttgcatcaaaagttttctcaaaattcaagttcactaacctagttgacttttctcaagagaaaatatgctataataatgtcaaattatcagaatgttagttgtataatttagtacttagtataaggaattattgggagatcattttattcctccttgcaaattctaaagtttcttttggaatttcattttatgtgatttgatctgtacaaaataatgtaagaagagaatgggacagatggagagaaatgattgaatcaccgtgtttcaatgaaaagtattcaaattgcatttcactacataatgaattctgcttcaacttactttgacataaataagattgggtaagagaaaccagaagtaaatcaaataaattaataaaactatcagagctgcttcaattttggtcctcagacattgtctgctttatttgtataatataacctgctcttataaataaaaactcttgcatataactcagttgaaaacaaaaatgtaaggaagagttagaaaatttggaggcctgattagggcaccttctaattttacaaatatcaatttttttgaaagttgaaaaactgaaatttgcaacctagaagagtgaccttcaactttcaactagacttttttaaaaaaagaagatgggagatacagacatgcatgcaacatcgacgattagctgttcttcatattttcctaattatacacatttactgaacatgaggacatttttgcattttgtctagacgaaggctgtgtctccactggcataatatatcacgacgtttgtgagtcttgtgcaaaattgaatttgcatctctgccgccgcttgtagagttcattatcttgcaatacaaccactgggaaaaatacaattttctgtgtttaataaaactgttgtcttctcatagtgcttatgatgcttgaacaatttgtcaggcactatttatcacagatgctgaacactaattatactgtgtgtagtgcctgtaagagtgattttaaatattttctttatttaatatgtatcagtgcaaccagggttttttgcaaccacactattatttgcatttctgagaatcaatgtgtcttttcacaatattaaacataaaagaaaagccactaaactaagagtagaacatgtaaaatatgtactggatatagtcaggaggcaaggaaacggatggaaaactcagtctctttgctccctagttagcctagggctgtagaaagaagtagggcattggccagtctgaaatatgtctccaggtctaattaatactttataactttctaggatagagatgatcactgaggtccctccaggctactcagttctgcaatctgtgatttaagtaaatcagaagttatttagcatggcttcactaatcagaaacctgaaagaccagaggcctgttttcagatgatcccttgaaaatgagattcaaatgaccaaccactaaaagaatcaagtgctaaatcacgagatcgagaccctgaaacatagtctccagctattacgtgtttttttgaagaatggctatcatacaaacacaatttcagcgggtctttatattaaagacaccatttaaatgggaactgcatccggtgttctttgtatggtaataaactgagcacataaaatgaatgtgtagcagaatagaagttatcttttttttttcttttaataatcctgagaagcatcatgtcgaacacatggaaaacccttagactgaaacaataaacagagttagtttgggcaactttgaaagaaaagaaggtaaggaagggttatttcctatgagacttattggaacccagtattcaaaatggttttcctactgacatcttgaagaattctgtgctttgttactatcatgttttcaccaacaaaagaattagctggttgggcctggtggctcacgcctgtaatctcagcactttgggaggccgaggcaggcggattatgaggtcgaggtcaggagttcaagaccagcctgaccaacatggtgaaaccccctctctactaaaaatacaaaaattagcctggtgtggtggcggcgcctgtaatcccagctactcaggaggctgaggcaggagaatcgcttgaacctgggaggcagaggttgcagtgagctgagattgcgccactgcactccagcctgggtgacagagcaagacttcgtctgaaaaaaaaaaagaattagctgaaagagaactttagagaatacagaacacctgtagatgggaaatgggatttctaactctctaggtcaagactatatactttcataggtatatgaaatgtgtgaccagtataaatatatgtgaccaatgagaccactatgaagaatttgttgtggactcaggtaaagcagtgccacacaaagaaattcacccaaagaggaagtaatggttataactcttcatgaggttgatgttgtcttcctgtattttttcctggaagacaacagtttagtttggaccatgatcccattggaagaagcttcgaaagcttttggagctgttggtcacctcgcctccttaatgcccaacatttgatggtttggagaaatgtaattgccacccaggcactgcctaggcttgggtgttcaagtctagccttaattatcaccgaagctcagggccactgccattctctgaagcccctgatctaacctggggcctccaactgtttcagatgagtctttgtcttagcgacacaggcacattctctttttctgttctgttgctgcaaagtggtatctgaggcctgccactggagtctgttcacctaatgccgttccttgaatatattgcatgagaagattcttttctgttttttatcccaccatctcctgttacctttatgtcaacactttctccttgagctgacccctcatcagcttaaaaccagttcttgcttctagattttgcttagcttgtgttttctgggccaccaaatacttttcactgggtaatgtaaaaggagacagagcaagccaggaagcagatgtctcttgggtggtgtgtgtctttgagaattggaatttgaaatctctgtatgaaaggagcagtgaatgggtgtaattagtcaggctgatgaaggagtaaaacctggtaagcagtttttcttgactggcttaatgaaaagcattagctatcagtttctgtctaaacgcgctgagggtaaaacaagtgtggggtttgaacaaaagataagattcagcgtgggcttggactccgttcccaagaataagttttgcttgggcggaaagtatgtggttcatccgaaaaaaaagaaatcaatgatttgtggcagttcttcgtgcattttatttcaggataatttataatatttcaggaaatgtaaggggttctcgcaaaggcccaaactggtgttttataaccaagtatgaatgtgttgctccttttcttctcatcccctcaagccagacactttctctaggtcagttttcagggccaaggaatcttttgggggttaacttacggttatcttccatcagcttttgtccttccctgtggcatggacctagcctaagaccttaagacctgctcacctcctagtgactagcaagaaattaagtaccccctggaggggaagatttcctgctctcaaagaaatttttaaaatatactctaacatcacttatgatgcctttaaaggcctcggagaaaaacgatgtgagtttctagaagaaaatgattttatatcattgcttgactatgctaagctgtagtaaggattcttcatgcagcaagaccaaataccccaatgatcagctcaagtccagagggtggcccaagatgctgtttccttttttgaccatctctgcctccagggacagcagatagacatctccagcaggaccagcggcatccattctcagcttgactttgttacatagatttcagctttctggcttggacccctgtgaaaaaatctcttaaactgggaaactacaaaagggctggatccacattttttttccttaaaggaaagattatttgttaacgttaattgaggttgcagattattttcttgatgttgtggggacaaaagtgacacatgatcttactttctgtcctatttgattaaaattcagataaatgttacaagggatgacaaaacccattttttttaaaggtacacaacgtctggataaactacagagtggaacagaaaacaaaacaaatccagcctcgtattttttttccacatagttaataatgcaagaaaaagccagccaggacaaagaaagcagaataaaaatgtggttcttgggttcagatgttagagatgagcattgagagaacttaaccagttctggaaagggaaggagaaagaaaactttttttgagacttgccatctgctaagtgtttccacatacgttatctcagctaaactccaccttcaggcaatttcttatagatgaggaaagggatgcttgaagagtttaaataacagactcatagctcaggcagaaagtggcagagaacacttcgggaggacatggcgggtggatcacaaggtcaagagaccgagaccatcctggccaacatggtgaaaccccgtttctactaaaaatacacaaaaaaattagctgggcatggtggcaggcacctgtagtcccagctactctggaggctgaggcaggagaatcgcttgaacccgggaggcagaggttgcagtgagccgagatagcgccactgcactccagcctggcgacagagcaacactccatctcaaaaaaaaaaaaaaaaaaaaaaaaaaaaaaaaaaaaaagtggcagagaagagactcaaacccaggttccctgccctcaaagccaccccagggacttctgtctttacctttttgtaaccaggcactgggcaccaatcctataaaaatccctaagaggttggacccagtgcttagagtactcaacatattataaagttcacctgaccccagagacctgcttcaacccataatagcaaaagcgttgagtccatgatcaggacaaatcacaagtcacacaacctgctttagtttaagtctctgggaagcccagccttcatttttggctaattgcctcattggcgaactttccccattatttattaatgacagaaattttttttttttttttttttttttttgagacggagtctcgctctgtcacccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccaatgacagcaattttttaaaaagtggctctttaaaaacgcttttaaaaaatctttctgtaattctaaaatacctttgatacttttaagtaagactcaaaaatacttttgtattttattttttatttattcatttatttttgatacagagtctcactctgttgcccaagctggaatgcaatggtgcaatctcagctctctgcaacctccacatcctgggttcaagtgattctcatgcctcagcctcctgagtagatgggattccaggtgtgcaccaccacacccagctcatttttgcatttttagtagagacgaggtttcaccctgttggccaggctggtctaaaactcctggcctcaaatggtcagccaaacttagcctcccaaagtgctaggattactggcataagccactgtgcccggccaatatttttgtattttaaatgtggacatcacatatcattggtggcatattctaaaagtataacttattcagtcttcactaggatttagttttcagaaaaaattgtcctgacaccaccatcattattaccagtatcgagacagttgcctcatacttgagttttaatcctagcctcacagcttgtactcttatgtgtccctgggcaagtcacataacctcaatcagcctcagcttccattctgaaaaatggtagtagcagcattataaagatataaatgtctgctgtttgggggccttattaagagccagctgctgcacttagcactttgcttacatgagtaaaatgaggataagtatgcccaacttctttagttcttttgcatcttcagggatttccaatacacatacatctagcatgaggcttggcatgttgtagtcagtagccatcagtcctgctctcctcccctttacttccccctccctcaccttaggtcacactaggtcactaataactcaggacctcttgttaaggtcttcaataaaacatggtggtgatgggtgacagcaggtccatgggtgtgactgatcagtgctaatggccgtgacccttaccgtcctcatgtgacaggctcagagccagactggggctaattgattctattacatttagagatttaacctgtagggggtactcagaatcttttttatgaaggggccatttgatgaactgctggggtaaggatccatttcttagccttggctttaggttgcttgtcccaggtagggaaaatgtacattggactttcttgatcttttctcatcctctaggatcagttatagctgaccatttgaatgaaatctcctagttacagaagcagtaatttgaaagaaaagtaattaagggatctagaggaaattgcgagatataaatgaaatttccatcttcctactgccataatatcttcaaaggatcccattagcaatccccttgggatgaatgccatgattaaaaaatgcttatctgtggtaatggaacaaagacgtaggacacaaggctacccttgatcatataacaacaaagaaatacacctgaatctgggagattatcttcttgtgaattataaggaaatgcttctcagtcatcttcattgaagtactgactggcagacagaagtctgagactataactctaaggtgctttcttcaattgtaatatatctttgaaatctcagattttattttaaacatatgctttgtgatctaattctgtgtgacaaaccaccccaccattagtggcttaaaataagaacaatttacttttcccatagtcccatgtgtcaacctggctgtttacttcaccgtgtgctgtcagtttgataggaaagtccaaaatggtttcttgcctgtggccgatagttggtgattgctggcagggaattcggctggaattgtcagccaagggccccagttctcatggatgcttgtgcttcttcacgtcatggaggactcaagatggtcaagcttttttttaaaaaaagtgccaggccttccgaaagcttaggttctagaatgagcactgtctcaccttccctgcattcttttggttaaaatagcctagattcaagtgaagagattatacgagagcatgaaaacaggaagacacggtgcattggaggccatcaaagcaatagtgcactacaacatgggaattttgcacactcttccagaatacatctcctatatgtgttataaaaatatattctcccaaatagtcaagtaaaacgaactcttgtataagctgtggcaatatgcattccatggttttgcttaccttggcacactactgtggacatgccactagggaagtaagtgccaggattttcttcttttctcagctgaaaggttaggtcttgggacccagtagggcggatctgggacgagagtagaatacagatggttagtccacatattaatctcacttagtgtgcatgtatgactgaatcccaaagctaaatacaagtgatttttattgacgttcatgtctatgttttcatcctttacccacagaattaagttataaattagaacctagagaagtatgggaaagaccctgttttattaagatgtccagggatgtaacttaatttgcttggctcagctaatatagtctgcttaataaaatctttaccagcatgtgtcacactaaaactggtttttttttttaaagaggtgaacttaggccggtatgatatcaagatggatataggctaggagagctgcagagtatggttttagtaacccagtctgatttatttccctaagggtggaggagttttttcactgcaatcagtaacaaggatactttgaaatagcacagcagctggaaaacaaatcatatatctaaatgtatctgcccttgtttcaggccaaagtctgcaaattatccaaaagacatttttcttgcttaagttatctgagctctgctgctacacaggattgtatattacactcactcctgtagggcccagagagaggccccaagcagtaggttccacataggcaaagtacagaaaatatgcactgccctgattgccttagctctgtctctcacatcttaaaccttctgtgtgagagattccatgtggcacatccccaaagctaacactgccaactctgaaacctgacttctaaagagtagtattgaatttctgcttcccactctccatattttattaacaaaaagcttcaaacatacagaagagttaaaagaattattcagtgggcacccatctacccacctggattctacaattaagatttccctgtcagtgcatcatcagtccatccatttctagaagcaattcagaataagctgaagaaaacaggacacttcaagtacaaactgcagttcaatatttactgtcctaggctgggcacagtggctcacgcctgcaatcccaacactttgggaggccaaggcaggtggaacacctgaggtccggagttcaggaccagcctggccaacatgatgaaactccatctctactaaaaaatacaaaaattagctgggtgtggtggcaggcacctgtaatcccagctactcgggaggttgaggcaggagaattgcttgaactggggaggcggaagtttcagtgagcagagattgcactactgcactctagcctgggcaacaagagcgaaactccatctcaaaaaaaaaaaaattactgtactttcttcttttctttttctttccttccttctttcctgcctccctcccttccttttttccttctttccttctctctgtctctggttataaaagttgcatgcaatgaaatacactagccttacatgtactattctatgagcttggtgaatacatgttcctgtgtaaccataacccctgtcaagatccagaacattagtattacctcacaaaggtctctcctatgtctttccagtcaatttcctccactcaccctccaccagaggcaatcactgttccgacttttttaaaccatagattcattttgcctgttctagggcttcaaataaatggcatcacacagtgtatactctgtgtgagaactgggcttctttaatacatcttaaaaatctgaaatcatgtaagtgcacctctttgtgctggatccagaggcagctatgctgagaccctctgctcctctccttgcctcgcaggagcaagaattatcccaggagtcagttctgactgcccagaaattttggagcacttgaccccatgctcttatttcagtgtccccaaaagcctgcagcagcttctcattggcagtgtagatgtggacgtgcagggcagcgtgtgacagagataggaagagccggcacacccatgcaggcactcacgaaccccagacgctgtgtgtttattaggaggtctgcctttgtgtctgtgaatcggactctgtatcactgattttactctgattgttccatgagacaaaggaggaaatagtttgcttcaaagcatgcaatgtgacccagaggggagaatggtgtgtatcgctggggatgaagcttcttggccaacgaggcagacactgctcattctgccttcaatgtagtaaaagagccacctgtgggagctgaagttatctttaagaggcttttccacacctacagagttcttttgacaacaagaaacaggtcaccctactttccaagatagaaacagtacattcaggaacaaagagagggtaacacagatggaatgtgccccacgaggcctgtcaaaccgagtgttgcaaggagatatcatcaggctgttcaatccggggggcgcggactgagtatgttcccaagtctgggtctctcagtgttatttggctaaatgaaaagtctaacaggtgcctggcaattgcatgcactggtgagacccacacttgggggtgtttgggtgttacttgactatttgggagaatatatttttataacacattgaatagtcctcattgcacacccacattaagaagctgcagccccatagtcttgaatgtattccagctgtgagctggttctcttttgcatctcacacgtgtagtttaacgcgacacagttcgtataagcagactagcagcaattatctcctctaatggattattttatttagctttgtgcgttattgggacatggactgctgaactaaggcaaagttgagcgactcctttgacttcttgcagtccagctatcccaactttttgttctgtctcattttgtggcatggacccatcagatactactcagcaaataacaggaagattcccccaccataccccacaacctccacctaaatattctatctaaacttcatgctgctcaaggttggctaagagcaaggggcttctttgagttttacagcctggaaatattgtagtcttgtaaaattattatccaagcaatagtttgcctacaaaaatcttactgtgaggactaacttacaaatatatctgagtgatgacagacatcagattaataaattgccatatgcatctctaaacaacagataactatcagtcatttctaatattgtgtaggatgacttcaaaacaccatacaggaccagggacacaattcataagccttttcctctaattagctacagacaaagctcaatagatagagggaaattggacaggcatcagagaggataagacagatgccactgggctcagctggaacaaaatcacaagaaaacatacaggtttatgattcaagcttatctaagcaataatggaaaaaaatataacccttagataatagggcaacctgaaacaataacctatacagcttaccatattcaggacaaagagaaggaagtgaagggtggggagacagcaggatattgacaataagagaaacaaaagcacaggaggctcgtggacttcgtactcttaaaaagtcttttaaaaaatgtcttctaaagtaaagacatactttgcaactttccaggcctcacttttaagcaattatttgggtacagagatttctactttctctgaatctggagatgctgcttggatgtgattttagaaatcaataggtttagaagtccctggcacttttgatccattagctggttcacagaagcagcctttcataaaagtctttgtaaactgcttttccctaaaatgattctccctaagcagctcttctcttctcctatacttcatcccggcagccagataatcaaatcctagaggagagacagggaattctcttcacatttctctggagcccatgaccaggcacccataaccacaattaagaagagaggccagaaaggcagggcctggctgtggggctcctttagcttcttggtaaagggttttaaaccggttcttattatctttttaaatgttaaagagggaagtcctgttgaacccctgatggcattcaattatgggcatgattataaaatgtctcagctctttggggagtgtgagcaaatcgatagagtgttgagagagtgcaaagctgtgaggcttgccttcgcaggatctcctcccttctcccacctcacttctgcagtggaagtttgtagtagaaggggcttgcttgctgcatggagggggtttagggaattattacctagcaacgcagggcaaataaatggtgctccgagacctttaactcatttgataaaatttttaaagggtgccatggggcattcctccatattattcacttgcagaggcctatgttaattcgtaaataaataacatggttctaggatctttggccaccccacttttgagtaagcctctcaccctctcttttctcccactctgtcatacatttttgttgttgttctgttttagatgagttctctgtgaaatgaacctaggtgtgtttgtttatgtgtttttctgaacaaggcaactttggttaatgcacgtggctccatgtttcaaagaaattatatggctactctaaatatagcaggataatttcatcattagggtgaacaagcatgcatgcattcattgagcagtgatttgtgacatacgccctgtgtgccaggcactgtgcaagaatggaagctccatgaggatagagatattggtcttctttgcccactgctgtatctttgatgcctgaaacactgcccagcacagagctggggctcaggagcatgaggacagcctgcacatacaatgagggaaattggaagcacattttttcctccctaaggctgtaacccagttctaatcacttgtgaaacccacagattggaaagaaagaagtaatttcatgatgttaggcctcagtggtgtgtctctaaagtgatttagtgtcctgaaggattctgggctatctcactactttagacaactctgaaatggaactggcagagtgtaagtgcattggaaggacctgctttttaaaaataaatcaaaattttaacaaaatgcttttttcccctatggcttacgactgtacttatacataaatgacctcgtaccatatgctttaggagggattaaactttaatagtgagatattctaaagccctgtcaggacatctccacaaaatgcttgttcttctgcctctccctaggagtggctcctgataagaggaatggtgaggatgaggatgaagaccaggacgaatgagagtaaatggggaagcccgtggcagtagctgagagttaggagcaagaggagtaggcataatttggggaggtagaccaccttcccttcctagaattgtttgtctgacctctcctggaatcatagccctgctctgagagatgttcttgttattcctgtcatgactccattcaacatatgaggcaaccaaagcccagggattgttgtggctcctcgtggctagacagctggcaaatggaggggctaagctgaaccttgagaggacccttctgagcccccatttttttttctgtctgagacggagtctcactctgttgccagggtagagtgcagtggcacaatctccactcactgcaacgtccgactccctatttcaagtgattctcctgcctcagcctcccgagtagctgggattacaggcacgcaccaccacacccagctaatttttgtatttttagtagagacagaggttcaacatgttggccaggatggtctcgatctcctgaactcgtgatctgcctgcctcagcctcccaaagtgttggaattacaggcgtgagccactgcacctggccttgagcccccgttcttaatcaccatgccctacttcccccaggggttccccctgtggtgttgctgtgacatttttatgccatagttcggactcctgctgcctatttcagcagtcatgatggtcccctgcctgttgtggtgcaggattcccttgagtgctggcacctcttgttctgtccctggacaaaagtagcatgaggctgagaatgatgcctgagccaggtgtgattagtgccttaggacccagaagtgcagagtgtggaagcaagcccttcctccacaccctcacaaaccacttcttcagggctgctctgcctggtcgtgcatgtgtccctcattactcactttggccggagcattggtgaactccttgttgcacctgccacatggggttctgaagaagatgaaagaaatatcaactgaaaaggcctgtgagcaagggacccagggctctataaaaccaagggtcattcttgtcttcgtagccatggcaaccacagcttagcccagggtgggcagagggccaggcccactgatttgcacagaacccccttgatgtgcaaggaaatctggaggcagaaaagcccatgggataagaaaaagatgaaaggtcttatctgccactgtttttttttttttttctatgatatctgtagttggctttgaaaaccatctttataagacagattcacttctgtctttttgggaaatgattgtagctgatgagattcattataaccacacaggagcagcctagcaacatctgacttctgggcttgcagaagtctctgcttctctgtcaggacagtccttccatggtgccatcactttttcagaagtcaactccagtttactagctattagtggtttttcaagtgatactgtgatatcctgtctgtccgtggctggctacaatgcacttaggtgaagtagatctttgtgtttgaacaagcagaccttgttcttactatgtacatactcagacttgaagaattacacagtggcttaaaacactgttgaagaaagagggttatctagtgttttcagtttctttctttctttctttctttttctttcttttttttctcgttcttatttcttattatttttatttcttattattcctgtcatgactccattcaacatatgaggcaaccaaagcccagggattgttgtggctccttgtggctagacagctggcaaatggaggggctaagctgaaccttgggaagacccttctgagcccccatttttttttttctaagacagagtctcgctctttttttctcttttttttcctcgctctgttgcccaggctggagtgcaatggtgcaatcttggctcactgcaatctctgcctcctggcttcaagtgattctcctgcctcagccaaccaagtagctggaattacaggcatgcaccaccacgcccggctagttttgtatttttagtagagatggggtttcaccatgttggtcaggctggtctcgaactcctgaccttaggtgatccaccacctcagcctcccaaagtgctgggattacaggcgtcttcagtttatttctgaacaaaggcttgcttaataagaggcttgccttcagtgacaacaaagtctagtataacacaaatatgcttttccttgagtgatttgagcactgaaatatgggagctgagggggttgataattctccaacctaacatacagctcctcttagaaggatgtcagcatgaatgtctccttagccatattgggaaacatgaaatatgtgtttatttaaagacaaacaggagtattaatttgcttcagaaaatttgaatgactttgaaattaaaaacaaaattatcttatctaattagaaaacaacaccccatcaaaagttaaatgtgtatttcaggacaaaacatagacagggtgtgtttaaaatatctgaaagggtgcccagaggaatgggttttatatttgtacctccaatctcagttgaatttttaacagttctgttacaccactaatccttatcctttactttttttctctctctctggaaagtcaggagggcacctgccctcccaccagccatgacctacttcccagtctggtgttcccatccctctgcaactatatcagtgaaggccaaaacccacagtttgagtaacatatttaaatataggtcaagaattggaaccagctgagcttagagaatagcacgtcatacgattctatattgtttaggtgaaaattgtgtttcctgttcctgttgttcatattggggtgatagagggaagaagagagacaggaagaaaaagggaaaagagagttagagtcagaacagagacaagagtgaagaatgaaaaacgtgtctggatgtgaacagagcagtggagcagagtggactccccacagaacccaaagacctggatactacaggatactagttccctatggggtggacaccaagcttctcaaattctttgtcccttggtctgtggaaagaaaattcctgccctacccaagtcttagggtcctttagaaaatacgaagggatgcaactgaacaatatctgtcagggtggtgtaaaggaagcaggccatgttacaggaacaacttactttttgggcatctcaagtaaaaggaacatggcataggtctatccttcccatgagacatgacaccaaatgcactgattctcttgctggaaatcagaccagtttcattagtgtcaggaaaggaagcgcgcacttccctatagccatgatcacgttcggaaaatgagtgctggttcgggtgttagaggtcctgtaattgtatctcttcacttaaaagacaactattcatagagtgactagttcaaggtctcacaggtagtaaagagcagacgtgggaccagacatcaagctacttgtttctgctcattgactctgtttctacccttaacctagctcctaagcttcctgaggctcagagtgtgtgaaggattctgtgtgcattcacagggttgaggctagtgaggaaaggatattcttcaagttttcatcctgaagtccagaaaccccatgaaaagtactgagaatactgtgggcacactgaagggctggcatctgtggtttcctgttcttggtacagcatccatatctctcagaggtcatgacagccacaccaattctaaagggacaaaagcaggctgcatttcagaggcacgccttgtaaaaatatgtgcacttgtgagtctaactgtaaattgcttagttttttcagtgattggatcatgaataccaccttctccagtaggaaaggaagacttgtgagcacttctcagataacagggacagtctggataagattaaaacacaaaggcctcattgtatcgattcatttaaaattcctctcccccaagtcttcaaattaaaaagttttcaacagctaaacccatctatcaatttcagtacagaaacttttttttctttgcaagcatcaagaagccacatattgatcaaaaaacaaatgagtggcaggaggtaaggagccggttgtgctaataaacggcatacagtcagctcccacttcgacctagaaataaaactacgaagtagaacattgtaaatagaatggtgttttctaaaggaaaatggataactacaggttacatattcaattaatgttttttccccagcagataactcacagatgagaaccctcaaaatgaggtgataaatgtaaattactatagctctgttacaactttcattttattttgttttgttttgttttgttttgttttattttattttattttattttattttattttttgagatggagtctctccttgtcacccagactgaagtgcagtggtgtgatcttggctcactgcaacctctgcctcctggcttcaagcaattctcctgcctcagcctcctgattagctgggactacaggcacgtgccaccacatccagctatttttgtgtgtgtgtgtgtatttttagtagagacagggtttcaccatcttagccaggatggtcttgatctcctgacctcgtgatctgcctgcctcagcctcccaaagtgctgggattacaggtgttagccaccgcgcccgaccataatttttaagacgtaaacagtgctttaagtccaataaaataagagcaaatgcattatgtataatacttatacaagaaacctcaagttattgtgaagagcatattgattttcatctgtctcttcataaccctctttttccaaaatactgcacctcctaaaatgcaataatgatggtggtgctaagagtgagctaaccccagtccagtccagggctagattcccccttccctcccctggcttcttctccatgtatgtctagaccataattccctctgtacagaatgctccaaaactcactagagtcaccttacattgaagtgtagatgcatgttattttagtaatattgcttcagtagtagttgaatgtgaagactatcatcaggctgggcacggtggctgacgcctgtaatcccagcactttgggagactggggtgggcggatcacttgaggccagttcaagaccagcctggccaacatggtgaaaccctgtctctactaaaaatacaaaaaaattagccaggcatggtggtgtgtgcctgtaattccagctgctcagaaggttgaggcaggagaattgtttgaacctgggagtcagaagctgcagggacctgagatcatgctactgcattccagcctgggcaacagaatgagattctgtctaaaaaaaaaaaaattaaaaattaaaaaaaaaaaagactgccatcaatactattggtgttttccactttagggatctttgtctttttcctacaatgagaaggcagaaaacttcaaaagattcttgtgtgttcttttttgaaagcctccaagagtccccatgcatgctgtaagaatgtgagaattagggtgagtgagtgtgcatctgtatttgtttcacaacacttcaggagaaggagaggggaggtgaaaatctttagaatcgggtgcaggattggggatgatttttcgttctctgcttttggtacttttgggagaaatcttcatttttgtaaataatgagtatacactggtttgcaaataaataaatacatacataaacatgtaaataaatctttaagttaccatgaaggaaagggaagcaggcaaacgaatccacaggactagtactacaaagagggataagtcattccggctaactctatcccctcaatctttgggtgtcttgtgtaggaatcctggcccttccttccctatgtctctaaggctttctatgtgataacagagacaccctgggctctgctggcagagagcgctggttcaaaactcatttctgcttctatgaactccatgattttagccaagttactcaaactgagccttagttatttcatctgtaaaatgggcacaatgaagccttctgtagcttccatgaggtctaaatgcaacaataattgtcaagtcattcacacagtttcacatgcttacaaacaagttatctcaatgattgttcattcctttctccaccctagcctgcctcattatagttaccatgtaatttgaagatgaaaggagtttttgatttttactgtactgctcgtttgaaaatctgtacacgtaactattttaatttaaattatttaaaattccataaacttaacattttattttcttgtttaaagtggctatgaaataatacagtgcagatggaacatttccatcactgcagaaaggtctgttggtgcttgtggtgctattggctctcttgcagctataggtgtgatacagttgtggtcaaggaaatgtcaacaaaagtctccaggtaaagcttttctggaaggcagcttttgctgccgggttgatgttatgaccatgaggtgatcttgaggatggaagccataggaaaggagtagagaattagtttagagctggtcatttggagatacttaacagctagccatttctcacaatctcatcatgttccatctttcccaatctccatgttatggtcatctcataactaaaatacttaatagctctttcttaaattgggcaaagtcttaatctcaatgcatcatgttcttttcaataggaaaggaggccagataggagaggtagtgtgttcttggaaggcagaaaaatctttccttctttcttctgatgtccaattgttctttcttgtctctattcttttcttttctcatttcttccttcttttcttttttccttccttccttccttccttctttccttccttgcctccctccctcccttctctctctctctctcagattatagaaaagacattcacctggcctgggaaactcttttactgtaatagggaaatgcttcatcagtgaacctgtagaaatccctccctcgagtatttttctaagcagatgcatccaccattactgatggcctgttttaggctgttcaaaactagtgaaactaaatggacagtacctacaatgccaaagaaagaaatgagaaaaaagctcacagatgctacaaaacagcttcaatatggaaatgtccctgcttctgaacaccttcttctttggcctctccttttaaatccgaagttattatagattattttttcctaccctgtatgctaggcacatgctgttccgaactaagaattcatgaattttaattctcattagtaaattggcttcttgcctaaccttgggcagaggacacaccatgtctttaatgcattcctctaggaatcacatacaatgctgtaaaaggtttaattattaatggaatttgcagagaacttgcctagctgtataactccagccaaccttaatttttaatctttataaatacctttgaattttaataaggcaagttcacagcaaggcaaccatttattcttcaagcatgacttttaatttatggtttcttcccattctttgctttatctcctcttcctccctcccctttggatggatttctctaccatcatacaccaacataatattttatcttcttataacaactgtgtttttaaaaatgtagttgagaaaatggaagctaattgttaaaaagggaatctcaaatttctgtgaatgtttttattcaagctctgtttctcctctgatgtagaaaataaaaatttagtgatatcccttcaaacaacagaatattctgtgaaggtgtatgggaggtatttctgtcatattacatatgcttgttgactataaagttggttttttgaaactcacattacccctatagtaacaatcttataaatggtggttagagtatgaagatagctcacataagtctgttttactcaaagtccaatctctggctttgaaatgaaaaatactgggaagcaatgctgttataatccaagtatttaaatagaacagaaaacatctccattttagtttttaaacctccagcttttcttctcctttatactaatatttttcttgccttacatatgttcgtcaactcttgaagatcattaaagattttttttcctttaacaaaaggagaaaagaaaaatgaatagtgaaatggtgctgatatgactatgtaagcatcagatgagagaagaaggcacacggtggcctgcagtggtggccacattcacgagaaagaatttgctaggtagagttatctttattctggaaggtgaaacacgagtggcaaatggagaaggatatggggacaaaatgtccctctgaaggggaagaaagacagtagtagaaatgttgagcagagcaaagagccttcaaggtgacactgttaccccaaacctactccatggtggggttttagagggtgtgtgtgtgtgtgtgtgtgtgtgtgtgtgactgacagaaaccaggcatgtgcaaggaaatgatgtggacacagaagcagggtttttaaagtgctaggcataactaaagaaggctgaaattttctgcttcacctgaaggatagagggaaggacagtcccaggagatgagacagggtaaaacaagtttcttccaagctatcttacaaaccagtgctttttaggctcattcatgggtcacaaacaatcaatatttttttagaaattaaaatcaaatgaaattgaattttaaaagtacattaccctttggagagaaaacatgaaattttaggtgtatactggctaatgtctactagattgctatgtaaaagtacttcttaatttggattacaatcaaagtcagggaatgacattgctatgtgtggtactttggggtaattaatctgggagtgtcaggtaggtggattctgtacgcagacttaaattaatatagatctgaaaggaggaagggtcttgtcagggtgatggcagtgattggaatgaatgaagatagacatggggaaacgataaatgtgaaaccaatagcatttggctgctgattggatgtataatatgaggacaaaggagaaatacaaattgtttctgttttaatctgggtacatgagtaaacggtgagagaagaggtataaagaacatgagtggaagctcaggcttggggcagcagaatgtgaattcgatttccaatactttgcatgtgtgaagcaaaagagacatcccaaaggaagctggaaatgggaactgagctcaggagagctgtggggctggagctgtgaattgagagaaatccctatggaagggagatttggctcttgagaaaatgtatagctgtagtgtgagggaatgtgtaaagaggaaaaaataagagaaaacaccaattctggaattccagacttgggaatgcctagaattcaggagcagcaaggagatgaggaaaaaggggaagaaatgagagaactagtgtcactgaagtggaaggacaagagcagctctgaggggcaggcaatgggatccaatgacagagaggtcagagaaggtggcatgtgagagaaaaagtgtatttgccagattgagcccagtagtgaccttgcagagcagcttcagcagagcagtgggagcgagctgactgctagggtatgggttgacctggttgggaggtctggtggcgaaggcccccatgcagtcagtttggcagggacagatggagagtgactgagaacacttgatttggttcttccagctgactgggtcttctctcttctgtccaaccactacgttgatgacccttgctggatttagtgtgttttccattaaaacagacccatcccctgtccctgcctctcagagctctagggttagtggatggtaatgattccagtcccataactcccagctccatgaagactgaggggattctgggactggcagggctgtaaaggcacttagagatgtttttggttggaagtgccttgctggctgtgcctgtcgatggacagctttgcttctttaagtattcctttgtaagttgtgtgtatcaatagacaaccttcccccatcatgtccatccttaatcactttttacttttgctttttgttaaagtaattttaaaaggagtgttcctttttcaaaaagaaaaattttaaccaattatgtaattcaaaagaatctactatgctgttggggaaatttgtgtaaattacagtgagggtcaccgcacttgtggcagttatggagtaaatgtggaatcaatatttcttggattgaaacatggaaatctactttaaaccacaccaaaaagatgtatttagaatcactgaccactaatattaagtgatgatgaaactaaactttactcctatagctttgtccatacctggcaggactgcttctaatgcaggtttctactagatcatgatatatgaaaggcaaagaaatacggtgaatccagtaagagagtcttcacctgggaagaatgtgttttatttggataagttgcatagccatttccatagcaaaggaatattttcagaaaatgaactgaaagatgtgttgcatatggaatctcacttggcattttggtaaaaatggagaatctttggttccctattattaccagcagcaacaataagcaaacagaaacgttctctctgagttcatttacttctttttcaaaatgtggaacaaaaaacagcacacatatttttgtgcctgcctggcaaaaatcccaaaagctctgcttaattctgttcagggtggggggataaattttacactagcaacaaatacctgggaattaaaataatgtgtgtctgttgataaagcaacattttgcctcttcggaggcattactcttcttctttttttttttttttttgagtaacactctttgcttttcctggttttacagatctgatataaataaaggtggttgtggactttagagtcttgtcctatgttgccttttgctttgttctattttagaatgcatttgaatatgttcaaatgccttgtccaagttgatagcttctgaattctcaaattcttacataaaggtcagacaataccctttggctgcctcttgtgttctctgttggttgtggttttggaccaggagatgtcccctgaagatgtcctctagaaacctttactgctcagggaaatactcagctgtgtttatcattgaccaaggagcaagtgtctttttaagatgtcagagcacagaaagctgaagttattctactactggctaccaaaacaaaacaaacaaacaaacaaacaaaaacaagctccctctagctggacccttcaaacaaaggagtctgtttcatttgtaggagaatgtgggaaacgacatttacctctgggtctgtatgactgcctttggcagattctcgacatacatctgatgaacaaatgactcaatgagcaagaaaactgaggtgaagcacttggaagcataccatgtcagagtagaagtgacttgtctggtcattaaaataggtaaataaaagtcctttatgcctttctagtctttaaaacttttctacaatgaacatctattacttttgtaatcagacacaaagaaagaaaaaacgaaaataataaacagaacactagttaaaaataaaacaaaacaaagagatctaattgcttttttaatgatggcattaatttacttgatgacacatttctttaatatttctctcatttgcagcaagccatgtgttaacagtgcacaatacacatactcaatgcatggctgataaaaacattaagtcaacaaacatttattgagcacttattaaatagcagggtgcttgctaggcacagtggggtatttatggataaataatacatgagccagaccctcaaggagctcacttatgatgcaggtgggaccaaatccataattgttaataatgaatggtagcttttagtggcaaactgttccttacaagcaagtaatgtcctttgtccgtattaaaaacttactcaatggcacaaggcacacctcttacaatttttaattaaacttctgctttgaaggaattgtagattcatatggtattgtaagaaataacacaaacagagcccatgtgccctttacccagtttcccccaatagtaacaccttgtaaaactatagtacaatatcacaaagctatgatattgacattcatacagtcaaaatacagatcatttccatttccacaaggatccctcatgctgttcttttatagctacacccactttcctccccattcataaacccctggaacccactattctattctccatttctataagtttatcataatgttatatatatggagtcattcaggatgtaaacttttggatttttaaaaattacactcaggacaattttctggaaatctatcaaggtggttgtgtgtatcagtagtttgtttctattgattgctgagtcgtattccatggtataaatgtatcacagtttgtttaaccatacgcctattgaaggacatctgggttgttttttggttttggctattatggataaaggtgctataaatatttgcatacattgtgtgaacataagttttcaatcctctgggataagtgcccaggagtgcaattactcggtggtagggtagttgcatctttagttttagttgttttttttttaagacattgccgaaacattttccagaatgactgtaccctttaacatttccaccagcaatgtatgagtgatcctgtttctccacatcctcactgtcatttggtgttgtcattgttttttgttttagccattctgataggtatgtaagatgtctcgttgtgctttcaccctgcatttccctcatctaattattttcaacatcttttcatgtgtttgtcttgccattgtttatatatggtgaaatgtcatctcttcatcccttttcttcatcttctaattggattgtttatctttaacaattcagttttgagagttctttatgtattctagatagtagtcctatgtcatttataggacttggaaatattttctcccagtgtgtagcttgtcttttcatcattttaacaggataaaaatgtaaagcaaaggttttgattttgagaaagtccaatttgttaatttttccttttaggttttgtgcttttggttgtcaagtctaggaatactgtgcttggttttagatcctgaaggttatctctatatttatttttttctacgaagttctgtagttttatgttttacatttaaggccatgattcatattttatttaatttttatacacaatgtgagacttaggagatttgatttttgcctatggatgtccaattgctctgtcaccatttattggaaaagttattgtattagtgttacagggctgttataataaattaccacaaacttggtggcttaaaacaacagaaacgtattctctcatagctctggaagctggaaatctgaaaccagtatcatcagggccatattacctcaaaaggctgtaggggagaactcttcccttcccttgtctcttgtcttcttatggctgttggtaatccctggtgtttcttggcttatagatttgtcactccaatctcttgtctcccttttcacatgtctgtgtccctgtcactctctgtcttctcctttcctgtcccatctaaggatgctcgtcattggatttaaggcctactctaatccagagtgatctgatcttagaaatcctaaccttaattacatctgcaaagaccctattccaaataaggtcccaatctgaggactcagcagccatatatttttgggtccataattaaacccactacaaaattgcttttacatgcttgtcaaaaatcatctgggcatatctgtctgagtctgtttgggttctctcttctgttctattgatttatatgttcatttctccaccaatagcacatagtcttaattattgtagctatataagctttaaaatcaggtgcgtaagttttaaaatcaggtagaatgagtcttcccattttcttcttgtcaaaattgtttttcactattctgtatgaattttgaatttccatatacatttcagaatagtgttgtcaatatctacaaaagatttcactgggattttgataggaatggtggtaaacctgtaagtcagtttgaggagaattgacatcattactgtgctgagttgtctaatccatgaacatagtatgtttcttatttatttagatctttgatttctttaatcagtattgtagttttgagtatgcaaatcctacacatgtttgaatattcaactagccttgcattcctggaatgaaccccgcttgatcatgatgtatcattcttttgatatattgctaaattctatttgctagtgttttgttaaggctttttgcatatatatttatgaagatgtttgtagtattttttgtgttatgttttctaatatcaagataatactagttttataaataaatgtataaatactctctccacttctgcttcctggatgagactgtggaattgggatgaaatttttaaatgtttggtagaattctctagtgaaaccatctagaattggagattttctcttgaggagttattaaccacaaattcaatttccttaaaagttatagagctattcaaattaggtatttcatatgtggtcatttgtgcttttcaaagaattggcccattttgtccataaaacttgtcaaatttatgtgtaacgttgtttgaagtattcccttgttatcttctccatgtctgtagggtttgtactgttttattcttgatgttggtcatttgtgtcttctctcttattttctttgtattactagaagtttgtcaattttatttatttattttcaaagaaccaatttcttggtttagtgttttcctctattgtttttgttttcaattttattgatttctgatcttacattttttaaaattccttttctctgcttgttttgggtttatactgctttccttctaatttcttgtggtaggaacttagattattcatttgaagttttttcctcctcctagtgcaagcatttagtgctataatttttctctcagcactgctttatctatgtcccccaaattttaatgttttgttttcatttagctcaatgcaattttttcttatttcccttgagatttcctatttgacccaaggattatttaaaaatgtgttgcttgatttgcaagtgttcaaagactttcttgtcattctgttattatttttattttaattcattgtagtaaaggggcacactcaacatgatttcagtttatttaaattagttgtcatttggtttctagtccaggatatgatctattttagtatatgttcagtaataagtctgaaaaaaatgtgcattctgctgttgttgagtagagtatcctagaaatgtccattagacctttttggttaatggtgtttttatttcttctatattcttgctgattttttctgtctaatggatttatcaattattgaaaggcaggtgttgaagtctccaactataattgtggatttgtctatttctcctttcagttatatcagtttgtcctcgtatggttttcagctcacatttaggtttattatgtctttttggtgaattgattcttttatcattatttcatatccctctctctctctctgataattatctttgctatacagtttactgtatctgatattaatatggccatctctcctttgctttgattaatgtttctaaatcttcttccatctttctatttttgacttgcctttttttttttttttttttttttatgagatggagtctcactctgtcacccaggctggagtgcagtggcgcgatcttggctcactgcaagctctgcctccccgggttcatgccattctcctgtcagcctcccaagtagctgcgactacaggcgcccaccaccacccccggctaatttttgtatttttagtagagacagggtttcaccttgttagccaggatggtctcgatctcctgaccttgtgatccgcccacctcggcctcccaaagtgctgggattacaggcgtgagccactgcacccggcctaacctgccttatttttatatttgaagtgaatttcttgtagatagcatatagtcaggtcatgtttcttagtccatttatcaatttctatcttttaattggtgcattcagattattctatttaatgcaattattgatatgttagggcttaagtttgccattttattttttgttttctgtttgttctctttgattgttgtttttgtttctcttttgtcttcttcctgcctttctccagataacttgaacattttttagaattctttttttatttacctgtagtgttttggagtgcatctctttgtatgccctttttagtggttgctttaggcacattttatatacatacatacatatatataacttattacagtattctgtttttgacatgttaccagttcaaataaagtgtggaagccttaatcatctttattccactttactttccctttccattcatatataattgtcttacatatttcttctacatacattaaaatcacaacagaaaatgtataatttttgcttcaaccattgagcacaatgtagaaaactcaagaggaaaaggaaaatgtgttgcatgcatttacctatatttttattcttttcttgttcctgaacgacatttttactggatatagtattctggactaattagtttttttattttcatcacttgaataaggtgtggtactttcctctggcctccatggtttcttatgagaaatctgctgttattcaaatagttttttccttataggtaagatgttatttctctcttactgctttcaaaattttttctttgtctttagttttgagaagtttgactctaatcttcatagtgtggatttttttggaaggcttagcttgtttggagttcactccttgaatctttaggtttatgtcttttgccagatttgggaagtttcagctgctatttttcaactttattattattattattattatttttgccatatcttctttttttcttctttgactctgatgacataaatattaagagcttttgttaagatgtagttccctgaggctccatttctttagtttttccagtccattttccttctgaaaaattgagtaatttttgttgttctgtcttcaaatttagtgattcttttcatctgccctctttattcggtagttgaaccattttgctgagttttcaagtttgcttattgtattttccaattctaaaattttcatttggttttctttatatcctctggtttttttgtttatttgtttgtttgtagggactttatatttctttcccggcacttactattttttatttgtttaaattgtatttgtaattgctcattgaagcattttcatgatgactgctttaaaaatccctgtcatataattcaaacattactgtcatcttggtgttggcattattgattgttctttttaaacttcagtttgatatctttctggttcatgatatgatgactgatttttccttattgaaatctggacatttgtggtattctgttatgagattctatgctatttaaaccttctgtttgagatggtttcctctgacagcactccaccaggggaaagggggactctgacacattactgccaggtgaaggtagaagtccatattttccactcaatctctgttgacacttgagagggcagtctccttgttcctgttggatgcgggtaggagtggctttgtccctatggtggttcgctggagtatagcgattcttgtctaagagttttctgtatagacttcccttttcctgtactttggacaaagaggtcagaatttttctggggatttttttctgtgcccactggcattttcaggtttctggcttcttaagctccaatttggggacatacgaagcaaaaagaaaatccagggaattcaccaccatgtcattccaaagtctccaggtagtctgccttctcttcacctttcagtcttcttatgtttgcttaacacagtggttcccaactttttggcaccagggacttgttttgtggaagacaatttttccacacaccgggaatgaggactgagggatggttttgggatgaaactgttctacctcggataatcaggcattagttagagtctcataaggagtgcacaatctagatccgtcgtatgcgcagttcaccgtagggttcatgctcctatgagaatctaatgccgctgccgatctaacaggaggcaaagctcaggtggtgatgcttactcatccgctgctcactgcctgctgtgcggcccagttcctaacaggccatagatcagtaccagtccatagtcagggggttggggacccttggcttagtgtatgttactctatggtttgtttggccccaccaagtctcctattaaaatgtgatccccagtgttgaggtggatcctggtgagagatgtttggactgtggggatgcggccctcatgaatggcttggtgctattcttgagagaatcagttctcacacttttagttcttgagagccctggttgttgaaaagtggctggtgcctcctccactctctctcttgctgccactctttctagccacgtgttctctgctcaggccagctccctttccctttcccatgagtggaagcaatctgaggccctctccagaagcagatgctgacacgattgttcttgtacatcctagaattgtgaaccagaaaacctctgttctttataaattacccagcctcaggtatttctttatatcaagggaaagggactaagacagttgtctagggtttttagttgtacttagtgggaaaaattgggaaaagtacatctactccatcttcccagaagcagaagttacatctcttatattttaatttaccactatggttccccagatgttgagctttctggaaaattaataaaactactcaagtgtagaagaacacttgctatatatgtgacttcttaactgaaattatgttttccccaaatcactagagaagtgtcctgctcaatgtaaaagagatgattatgaaggaggcatttgactttgggataatgaggttgatacaacagtttagacttaaggaaaggaggtttaggattggtagggtccaaattggggagctcacctggctaaaatctggcatttgaaatctatcagtccagagtccacaacgtgcagtgctacaaagggtaggtcaagtctacctctgttccaaggctctccagtgtagttgctggatcatagcaacagaagtagtttagcaagcagaagagtcatagctacagttactctgtcctcccaaaagtagcatcccaccaagggccagggaggatgagaaataaaatggaaccatttgaagaaggagcctagaaggatgtagctatgtgtcacagtgggttcttgactcagaagagagctaaaatatagtttaggaaactagaggaaaatgttagtcaacaaaaagggataggcagggtggttaaaaacatcagtactcttcatcctagtactcaggagacattactagttgatcatggtactgtttcccactagacccacaatcctctcaacataatgtcccatgcaggcactaccaatcaataggtggagacacgtaagaagacatctgttttccagctcaggcgggaagctcattccaggcacacaggacatcagatctagagcagcacagtggactccagatcccattaggagcaggcctaaggctgcttatttcttgccttccttaatgagaattggttcagggtctgggtgcagctgagcctgatactgctgactttgattatgagagctgagattagtcaaagaccaagtggcagagaaaaaaaaatctttctttgcatattaagatcctaggcttagctgatctatattgttaattcctgaagatttcaagttagcctgcttacaagttgaatttcaagagagagatggcagtgatttacggtgacatctattaagcttttatagaacataatacatgtgttcttgctcctaccataaaattaattgttgctaattagttagggctgccagctcgcttgcatgtgaaagtctgtcacactcccttctcctggtcctgttaattagccttccacagcctcctactgtctcagtgtcctgtagctttcctctcaatgtatgtttcttatttaaacaaatgagcctgctgtttggctttggttggttttggagagaggtttgactttgggggcatagaagtccttgttggcagtcaatggtgtcaggtgagacaaaccatttttgtacaccatcatacattatgtaagtgcatttgacccaaaataagtattcctctttcaaagttgttttttaaattgagtattgaatttccatgaaataatacaattaagttctcaggtacttggttttgatgatcgtttctgggtttctggagtctgggatggagatcattctggtgggatgacagcccataagcacgtgtgcagtggaaggagcactgggccgggcagcttcttggttgcaatgacagctgcatggcatggagcattgtaatgttcagttgtaagggagatgctttgaggtgctgaagatatcatgacagtgatcgagtttgtccacagccctcacagcccttggaggagctctgactcaagtgttcttgcctagggagtactggttgtataattgctgttgacatttccgtggtaaaaagaggtcagttctgttggatttttccaagagcaggcagcctactttgtccaagcagagtaaatctaagagtgacaatctcatgcagttattatcacatataatgacaataaaaagaaagggtttttcctaaatacagttctgcacccagtgaagcttgttcactcctctgctcaatgagccaacaaaacagtcaggcgccagagagagaaaaatcctgtttgcattgattgcgtcctgaatgcctctgcccacctcctgggaggcagcttatttcacacatcctcatgacagagtaatgtgacttcattgactggcaagcagctgtcagtgcagcctgtgaggtgtctgggtgtgcccacacaccgaaatcaagagagaatggaaagcacagcactgcaattgaaatttaaaggggaagtaagtctttattacaattgacttacaaaagtggaggctgtagctatgttcaaatacaatcacgtctgtgaacccacttgtcaagcaacagaaaggcacagttttcattcattcattcttttgctttggagcagggcttcacataacaggtgctggaaaggcagtatcaggaaccaagactccaacagcgccaagcaatcaggtattaggaactggctggccatcatacacattgtcatatgcattgatgtcttcctacctcttttctgcctcctttgcccctgtcctttgctccacaatgggggcttctttgcatctgcttctgcacctgtcttcacctgcatgtccttgcctgacatgggtccagtgaaaggtgacacatgaccacaccttctgacattagatgcagggattcacataccatgactccatggttatttgcactggggaggtctgaaggggatccacacagtgtttatgcatgagtgtaatctttttacttctgaaaagcctgggatagaagaccaatggatgaaataagggatcttttatgacaaatttatatgttttttaacaaactctttgctttggcaactctgtgatcacttaatttggcagcatggttaagggaaaatatgattgagaaagctatttatgttcctgagagtcatgttgcgtatggtagccgagtgaataattctttcgttccgattataaaatcacttggctgttagaatttatagcttcccttttattttcatcactaccactataatctagaacttcatgataatgcttttattaatgcaacaaccttctagcttgtttctctgcttctgggcactttcatttaatacaccatgcatattgctaccagatgatatgctatttagataatgccattccctcattaaggaacctgcaatagctcccatctgcttatacaatcaaatctagaccccttcatctaaccttcaagctctctatggtctggtcccctatctacacatacattgaaacttacatgccaccaccttgcgtcatacccctgattgagcagaggaatcctagtcctaccaccctgcctcggtgccttgctatttgcctttttttaagatccctactttgcctctctgcccattcagataaatacatttttcacatctcaccttagacccttttgtgtctataaagcctttccgatagttaccatccacatcagcttctttcttgagttcctatcactctagtaggcaaatgcttggcactgtttttagtctagtttcttgcagtgatattagtgtcttatctacaaagcttcatctccaggatgaactttttgctttcttgattcttagtctccagaatgcctagtatgctcctcttgtgtacagaatattgaacttggaattgaaaggccaagtttaaggcctggctctttaactgacaagtcatgtagccttgaatgggcccttgacctctttaagcctctgttcccttagctgtaaaatggaactcaagatattttcacagcccatttcaccgagtcattttaatgctcaaataaaattgcatgtgagagtactttatgagccttcaagtgctgcgagaacagaaggccccattattattgtagtttgtctgtaatatttaacttaagttgaaccaggaaaatatatctgtgagccattgtgtaatcttgagggccaaattgctaaatagcagtggccgcaccatataacatttattgtacatttcattgttcagagtgctttttattaggattaccattctgttctctccagtgcctcatgaggttgtgaggatcaggtatttttattcccactttgcacctagaaaaaggaaatcaaagggaacaaatacagtaagtgaatttctgtaagtcacgtagttagttgatggccacaattgaactgaagcttccattctgcctcttattccttgcctgaaaattgtggtcattttcagtctccactttatcaccaccagacccctgcctctaggacgctttcctctgtggttttcacttttcctactttgtctcattggttcttgtacagcaagggtggctttatattggctagcaaggatctcactcctgttcatttcattataattacattcacattcataaggtggagggacattttttttctctttacaaatactgttggttgactgaagtagtcttaggttgggggaccctagatcagagaagagacctgagttcaatgttaggtcctcactttctttgcagatggtttaattctcttgacaggtcaggctttccctagagccttgtccacgcgggcgagactgagacctgtctctttttggcctaaggataaataacaggctatctggtatgcttccagactggatgtggcagtgcacaccactcatccagttgtccctcctttgtgcttaagctctttcccactccttccgtctgttgcacctgctggccccaagcctggagctattctagcctccaccaaatggggcagtcctgcctctactgctgactccactacagcatgttctgaggtgagaattcttctactctatgtttcatgcattaacatggaagccatgcccccatctcccttccagaaatccgttgaaaaatctcatccattaggacttacattgcccttcacttcaccgttatgggtaagaggccaactgatgccctcacctcaccaatctaaagggatttcttcaatacctttctaaggaggtgctgctggaagcattagaatctttcagccatccccacagggacagtgtcatcagcagattacttcctcaacttcagcataaattccagtataatttaacattggcttattcttgagtgaatttttccaatataatctactcggaatatttgatgccattttaatactttagaccatgccaatcccagatgtaaatggttcatactaacatataagaacagaattttttatcacccagagtaagtagttccctgcataatagcatcactgaagctctcccaggagaagggacttcatgacaaaatgtgggagccataacagcagccagattagtctgaccctctgcagtatcttcaccaggaccccaaaggaccccaaagcccaatgggtggagtaattctcttttttctgaagcagtatgattaggtaaatgtgactttgttgtacagttcttattactatcctcaaaagctgagtttgtagcatggactgcaaagtgtggcagtcttccagctgacagaagcatacaaaacaagtccttatctcaagacagaggagaggaacccaagcactgtgactctcactttataaatctgccctcagctcataaactacttttaacaccagtgattcttgacatgagttcacaccagagattttgcaactcattgatatggagggtgtaaagaggcaggggacaaaaaaaatacatctggtggctgcagagaaagggttatttgacttctggggacaggctatagtaatattccactgattttatacagcctttgtctttcctgcctgcactgttcttatattcttataagagctattcaggaaagtagtgtcaggatatggctggaataaagatataaggatgaaagatagttaatagaagaatgaaaaataatgcaactcccaattcttgggaggagataagagatagtgcaagctaaatcctcctctatgtagtggggaattaataagtgagaaaacctgagcagaagttataagcatattcattagagttatggacataatacccagaaaaccaaaaatcaaatgtgttcaaattggctgcccaagagaatgggaccaatgacagaaaggattgtggaaaggaacaatttctttccatcttaaactctttggtactacttagcttgttatgtgcatgtattgctttttaaatatttttcttaaaattaaaaaaatctatggatttttttccctaaaattcaggggttgtgtgtgtgaagatatgacttagtgataaattaggttgagctatatgaaatagcaaatattggttcgtttttgacctgtatgaatggaaatttcatttgattcaaccgaaatagttttcagattttgttctttcatgcggacacgtcttcactgaaagcccagcatatgactgggtcggtggcatcctgccatcctggaaatgtcacaattcattgtgtccaacaacgttctctttccaaccaacacttcaagttctgctcagcttactagagagagttcaaagggcacatcttccaaccgcaaaccctatgctcaaaggatttgcttcttctaatacccttaacccagtattttttacgtgtgttatggcagtttttacattctgccttttacaactttatttgtatacttatctcatctctctgttagactctccatcttttgagcaaaagaatcattttctatagggagagactgtgtgggctttgaagcaattctggcatgccttgcccactttccagctgcataactttgggcaccttccttaacgtcttcaagacccagttactacatccccaaaatggggacagtgatgtctctcccgaggcccatcaggatgtttcaatcagaaaatgcatgcacaatgcctaaaacatgcccagcacacagctaatgtgcaattaacaaccattgacttccccttcctcttactcatccttgagtcttccacagcaccaaacacagttctttttcctttagatgattaaatggtaaatgaaggagtgggggaaagtaggttggtttgaaaggttttgaaagtattgcaaaatcctttcaggaaaacagatattaacactaccttttaaaataagagctctcaaataagcatattaaagaggaaatagcacaggactgtgctttgcatattaactgatctgaaaaccatccagagatggaagccatttgggatgcctccaaaaatattgcctgtgaccctccacctttcagacattggccatgtatcagtggttgtgaactctgctgagcctctgccttctatggaattggggtagagtctacagctgaggagagcagcctgggaagcttgcatggagttctggacctcaaaaaatgcccaccagcctcttaataggttgagcacttgctccttcctctgttcagagcgttccccattaaaaactccagcctgtttttgtaaagttggccccaatgactccatggagcctttctgagttgcccagctgcagaacactttgcttgtcactgttatcgctgtttaccacattctgattgtgttattgtcattgatatatttctcttacctattcctgtgccatcattagagtatgtgcacagagaagatactccatatgtttatgtaaaaataaaatgttcattcattaagatacaggtcagggaagcccctgaataaccactggtgtgattttttaatttatccccaccaaaaacaaaagatttcttccaccatgggaacattctttcagaggttcattggtaaaagccaacttacttaaagaagtcaattagaaaactgtagtagcagcgtggtgtggtggctcatgcctgtaattccagcattttggaaggacgaggcgggcagatcacttgaggtcagagttggagaccagcctggccaatatggcaaaaccccatcactactaaaaatacaaaaattagctgggtatggtggcacacacctaaaaaatcccaattactcgggaggttgagcccgggaggcggaggtcgcagtgaactgagatcgcgccactgcactccagcctgggcgacagagtgagtgagactccatctcaaaaaaaaaaacaacaaaaacaaacaaacaaacaaacaaaaaactgtagtggctactagtttaaattgttgaaggaagaaaagtttttgtggggagggcacatgagtggaggataccagggataaaacagacaccagcaaagagacctcaatggaggtttatggctggcgtggtggcacgcatctgtagtcccagctacttgggagactgaggtgggaggactgtttgaatccaggaggttgaggctgcagtgagctgtgatcatgccactgcactgcactccagcctgtatgacagagtgagaccctgtctcaaagaaagaaagtagaaagaaagaaagaaagaaagaaagaaagaaagaaagaaagaaagaaagaaagaaagaaagaaagaggaaaaaaaggaggtttatgcacacagtgtgggaggtacaagggttgaaagcatgaggctttccagtgttgagagcaggaagaactttagggcacagggacacagagtcagagataagactgtctggcccacctgccaggattttgtacaatcacgctgcataatgattcttgaaaatacaaacattgccgggactgactgacaagtattgttccagcggggagagctgtcagggcaaatcaatccaattctaccacatgccagtgtgtagaacagatataattttggctgttcggggatgtcaaagcgaaggatgtaccgtatgtgtattttgaaatgtggtgttctttttagtctaacagcttgaaagatttctggggctttccccccttggcttttttctagaagttttgggaatttaacttcaaataattccattgcttttatctgctgtaacatgcaggttaaattaagcctttctccctccactcctatggacacttgctctcatttggggtattaaacattagtctagtgaggaaagggccatttgctggcattggatgttgtatgaggcatctataggtccctggtgccctcccagaaatgtaaagttgatttgcagcaggctatctagtcgatcactgcaacaaataaatgcaaggctaaatagagaggcttaggatggctcgcgtgtctaggccccttgggaatctctgaaggtccacttgctccttcggtgccccagtgctatgagggcttgaggccctcagaagttagctcactgaaaatctctcttctctgttcagaatttttctgtgcccccaccccactgccctctctgcaccttccctaggaatctcttccagcagttatctcctctgccttcttctcttctcttcttcttttttttttttttggagctattttatttctgaccctcaactattcctcttaacttacaaatactctcaaacctcacaacagcccctaacccccatgtgctggagccatggtgctgtctctagatggacctgtctgcccctgcatcctccgccccctcccgtttcccacaggctcggcctccattcttcagtcctggcttccatttcctcacttcccattcaggacaccacccagggtaggctgccttctattgtcttcgtgatcatgatccatggccctctcctgcctctgattagttcattttcatcttgttttctgtctttccctgattttcctcatagtcattctttgaggattcatttttggtgacatcctctgtaccattaggggtcacagatctgactgcagcttctgtggctggggacagcacctcccacaagagtcttgctgagctgcggacttttgacaggcaaaaggccggagaggaaagatggatgagggatgggaaggagcccgccctcagctctgtaccagcctctgtgaggacaagttctagtgctatgccctcactggcttccttgcttccagttttagtccagccagatgaatctctctaaagacttgccctgatcacttcttaccatgctcaaaggtcttcaatagctccccaggactcacatatataatgtaaaatcatggactcaatgcctgtggagtgtgtgagctggggcagacctaagatgccatgtagtccaaactcccttatttaacaatgaggaaggggaggcacagagaaggaagtcatatttactagtgccagaacttgtctgaactacttagtgagatattcaaagccctccataatccagtctctttctttcccttccttccttccttccttcctttccttccttccttccttccttccttccttccttccttccttccttccttccttccttccttcctttctttctttctttctttctttctttctttctttctttctttctttctttctttctttctttttctttccttctttttgagatggagtttcactcttgttgcccaggatggagtgcaatggcgtgatctcagctcaatgcaacctctccctcccgggttcaagcgattctcctgcctcagactcccaagtagctgggattacaggcatgtgccaccatgccctgctaattttgaatttttaatagagactgggtttctccatgttggtcaggctggtcttgaactcctgacctcaggtgatctgccctcctcggcctcccaaagtgctgggattacaggcatgagccaccgcacccggcccagtttctttctttttttatggcatgttgcctgctgttcctcttttggaaaaaccaagataaatcactctttcctaaatccactctggacttttctttcacctcatcctggttctttctcttctcccctcttaagtgttctctttctcaccatttttttctcttattcaattactcatctatttttacatgttcgtgttattatttgttaataaaatagttttggttgtctcatgtattccaggctcagcagtggattggggaaattacacctatttgtcaactccatgcccaaagcattcttgagtatgcccataggtgtttattttaatgtccttatgataagaactgtggactccttatgcaatgccttgggtgaagatagcttttgtgtcatgtgttcatttcttattgatctctgttatgagtactatttttaggaaactcacttcttactctggagacatttttgaggacattgatcattgtgcctatcggcatcccttttgtaaaatcgatttgaaacattcctttgaaaacaaactgtcatgaagaatcttacttcatgaagaagggatcgctgtgtttttatttatgagtagccaaaattttgtaaattattgtgttttctttttggcttctcctgccagcaagcttaggatcaaattatgacttaagtttaataaccactgaggacccaagaatcttcatgcttgcatttctacttaacaccttgtcttaacttcctattttatttctcttgacttcagttattattacagtttttgtttttctttgtgtcatttatagtacctaaaatcttttgtgaatggagcaaagatgtaagtaaatggcatgaaagatataagtacatgggtttttctgccctttaggttataaggtccttgaagacagggattattgtactcttctctttttctaggccctagaaaatgctgaggcacttttagtaggtgcatagtaaaagtttattgaactaaattgttagaaatagacctctgatttcctagataggcacagctgaactcatatgctttctcttttgcttgttttttgtaagaaggccaaggcaaggtatgttgtagtggaaagaattcaaaccctgcctcttactaattatacaatctcacatgagttatttagctaatccactcctcctctttgtttccttagtttgaaaatggaggtaagaatacccttccagattgctatgacaattggtaagtcctgtaaatctcagcacattctctggcccataataacaatcagcacaggttaggcaccctgttgcctccctatttcctgatttcactggaaacagtacttggaaaaggataagtaagtggattgctctatggccacaagtaagtcaattaactgaggtgtcatctgtaaaataagtgtggctattgacctcattcagagggatatgaaattaattgatgataatgcacattgggaatttttgctgagaagtgcttcagaatggctcagtcttgttacgtgctctatttcatccttaatattatttatgaatatttagccttttcttgttctggtgtgttttatgtctgtggtcttaattgcatttattttttaatttagtaccaacttgtatcttaataaaaatgtaggtgaaactttaaaacatagtttctatctttcacacaaatttgtttttataaggtggatgattttacctgattcaatatgctgctaatacatgaagatatttggaaaatcatttttgttaattttattttatatcaagttcaagcattttttgaagtatttaacatttacattctgcttttaacattcatattttatatttatcagtagttttctaatgaaattgtttattaggagatgtgcggctcatttcagatgataaacatgagtgtttcaagtatttctagtagaaaagatatcaactaaatgaaatacctgttttcactttaatgtcaggaaaccctctctgtcttcagtatgaatcagtgtcctctatttcagagtccaagggttgcttttctgagagggagggaacctgaatcctagctgggtcaccttctagctgtgtggccccgggaaagtcatgtcactgtgccaagcctctcactgatctgtcaaacccgagggagccagtctcgatgatctttaagttcttttcctatcacagtattcagtcctgggagatggaactgctaaaggcaggctctgcatttaggaccacagggaaaccgagagagagaatttcgggaactcccagtacaggccattatcttttagagtatattagttttaatctttctcctgaaaactttaagatctctctctttttaactgcaggttgctttatccttgtcatatattagatactgaataaatgtctctgttgaaagtccatatgtttagtggaataagtccactgggccaagagtatctatgaaaccccattattgaggaaatgggaaaggcacatttcctgagaccttaaatgaataaagttatatttattttttattagttttagatttcatagcaatgggtatagacatagagtaatactttatctattgcctgtgtgtatatatggaatatgtacttctgggaggaatctataccagaatttgatttaagcaatctgaaactacaagcatctatgtcagctgctgaagacacattgcgacacaatgcatttttcaggactctaatgtgatacgaacacagagctggaagtcagttcacttctggcactcatgggacaaatgaccaagggcaccacatttccattctgaaaaattccatcagtgacagggttgcccagacagggtgcagatcacacgagtttggtggtgtatttcctatagctcttatttgattcctccttttcctttggcagggtgaattttacacagaaatttttctataaaactcttttttttaaattaagtgattgttttgagttttccttcaaatctaggaagtcattcatggtagagtttggttcctttttttttttttaaatttgagagagtctcattctgttgcccaggctggagtgcagtggcacgatccctgctcactgcaacctctgcctcccggattcaaacaattctcctgcctcagtctcccgggtagctgggattacaggtgcatgccaccatgtccgtttaatttttgtagttttaatagagacagggtttcaccacgttggccaggctggtctcaaactcctgacctcaagtgatcagcccacctcggcctcccaaagtgctgggattacaggtgtgagccaccacacccagcctcttatttatttcttattacagttgcttatgttgggtttaaggtgatttgctcaagtctccaaagttaagagcagcagattggctgatcacagagaaaggaagcatgtgagaattttgcatgcttatgtgatagcttatttatcatggaatccttaggcatgcttcactcaggatattttgtgtaaagtgaatcaaaaatgtccacagagcccttcaagatactgatattcaaagtcttagaccacaatgagataggagtttgtccagaatgtgaatcagggcattgcttccttcattacaaaagtcttactctcaggaaaagttagcctaatgtcacacaatcagccaaactaaacctttggatgtctggcctcttagctccactgctgaaagctggaggagaaatggcagcccagtgttgttacagcttaggcaggttactgagcctttctgagctcggcccctgagaaggaaggcactggtagggtggagagggaaaatgtgggcccagagctcagtgggtgagaggagcaaccgagatgtcagcagaggtggtgcagggtaatggctccctaagatagaagcttcaagacagctggggctctagcacgagggagagggagtaaaggatcagaaatcaggtgtgtaagccctgaagtaccaggggatgagggatagagatggcgtccaattgagaggcttgggcatccttggtgcattgccgaggttttatttaaatcagggaggtaaagggatgtttaaggagagttgaggaaataaggagcttgtggagtcacaggcagtgagctcagagtacaccgtggaggggtgtccaggggagctgaaggggcataagcgatccacattgggaggatagtgtctggataactagagacttcctgtggtgttgtagggaaatggaaaatgggcaagttgggatgagttttgatgccttcttaaaggagaatgggaagacgttcttagctcaatgacaggaaagcttcagattagatgttcttcccactgctgccatcccagagaatagagctattttatcacctacaggcttagaagagttgacctcaattaactcaaataacatagtcaagtagtacttgtctgtggttatcattattaaacatattttttcacagatatttataaatcaccaattgtatgcacagcactgtgaggccctgtcaggaatacaaatacaaaattcctgtgcccctaagtagctcagtcttaaaaaagagaaatttggccaggcacggtggctcacacctgtaatcccagcactttgggaggccaaggtgggtggatcacgaggtcaggagtttaagatcagcctggccaatatggtgaaaccccatctctactaaaaatacaaaaacattagccaggtgtggtggcacacacctgtagtctcagctactcaggaggctgaggcagaagaattgcttgaacctgggaggcggaggttgcagtgagccgagattgttccactgcactccagcctgggcgacagagcgagactctgtctcaaaaaaaaaaagagagagagagagagagagagaaatttattccatttagagagaatacattggcaaaaggacactgctcagattatcggtgccccaaaacataacaaagcagataaatgcaaatatagtagcccatttcctaaagaaaagatgcagctctcctgctttcaaggtcaacgtggaaaaactgctttaatcaattttagttttggaaataatgaaattgtggctttggccttaaaaacttattttccaccaaatttttctcctgcttggactgcgaaaagaaagaaggtatgtaataaaatgcaaaaaaaaaaaaaacaaaaaaaaccaacgttaaatacttgccttgctctggttagagtgagaagtaaatcaagtgggaatttaattcccaatgaacatgtgacaaccagggagttaaatattagatttaaatagggcagctaattatctgcaagaattacatttgtgtctttatatgggcactctccctaatgaacacatttctctcctcttaaattcagtcgttgtcactggagcatgagaaattaatatacgttcttatattcatcaatattgttgctcataaaaagaccttttgatttttatcaccctgagttcccagaggctcacaaaagcattcatagctctgaaccacatgaattatcggggggaaagaaaaatcccattaaatcaaaatcttaattaccacttgcattttctataaagttgtgtccaaaaagaaaccaagcaggctgtccatcaacatagaatggataaatacatggtggtacagtccttccacagaatattatacagtggtataagggaaataattcatactacacacacaatacagcccaatctcaaggacaccgttgagagagagattcaagatctgcaagaattcgtactgtataactccatttaatgtaggttcagaaacaggtgaagctgaacaagctctgggagataagtaggaatgtaggtacaatcaggaaagaacacactggtgcttcaaagttactggtgatattctatttcttaaatgggatggtgggttcataggtatccattttattattattatttactgcagtttaaattaaactgcagatatatggtttatattttcgtataatgcagttcacaatcaattaaaaaaacattttaaaaaatgttatcaagttacaccgcagtactaaatctctactttgagttgcacgaggcatcaggagatatttagggctcggtcttaaccttgggagcttacagatgtgatataattgtgggatacatcagaatacgaacaagctatgacagaatgtgagttcacaggaagaggtctttggtggtcaaagtggtcctggaaagctctatgagagagtaagaatttgaacggggctttgaaggatgaactaagcagagaggaagcctggcaattgtttttacttttttctctatttctcttataaattaagtctctgctcatgtttagtacagtttacaattgaaaagagactttgtgaagtagaagaaaacacatgaactctggaatcagacagactcgggttcaaatcccaattccattcccagactgtaaatcttggaaattcctgcagactgttttcctacttgtaaaatgcagagaggattatgtcatgggattgtgagactgaaatgagagaatatagttggccacacattccaagctctagagggcatcacaatctctttttaatgcactaccattcagcaacaaggagttcagaaaataataccagccaagacccagcggaactcccgtgctaagggactcaacatttaacgtgctgagtgaggaggcacagctcacatgtacttctgtcctctgcagggtctccttgtgggcctgtcctccatgacctctgtcctttggtgtgctccctctctggtttccaccttgcagccaatgagcttctgaggacccttaactgcctcctgccttgtgcaccaagagggtgtatggatgaatgacttgagccgtcgctgctccagactgtagggaggaacattctcttgtcctgggattcatctgcttttgtctcttcttggccttggagagccaagactgagccatgattttaaaacacggctaaggaagctagtccttaatgcagacgtctagatgtttctgatccaaacaaaggaagtcagtgaggcccaaccatgttttagcccaccccactagaaggctaaaactgaggtgaggccaaaaccttaattaacaatgcaaagatcttgcattttccttttgtatcctctgactctgtctcccttaggaatctgagatggcttaaccaataattcaggattgctagctatctctctgctttgccctgctggacacactgctaacaaatatatgcaaagcatctggcttataagaagcctgccattaatgtgaatttctcatttctccccttttttactctataaagtttatcaaggatattttgcagtcagcaactaggtatctactttagttttatcagaaacaataactgagttctggagaaaaaggtgatgaaacctccgcccagccatttggggtggactgtgaagatggacacccagcttcttcggttcactgtgcacagaggagagactcttgggcctggaagctcaggtacaggccaccaactcttcacccgctgccttcacctccacatgcttcaattccaatttccattctgtctttgttttgcagttgttcagcacatcaagcgacataacattgttctgaaaagggagctaggcgaaggagcctttggaaaagtgttcctagctgaatgctataacctctgtcctgagcaggacaagatcttggtggcagtgaaggtaagagaacattccagaatgtctcattaaccatgatcacacttacgtgtggaaatttaactctattttattatattttggtggccaatgcaggagtaaattgttcctgctatgatggatgtattcaaattcctttaaactaaatggacagtggaaaggacatttggggcacatccaactgtcagaggttcttctcagtggccactgacaagtctgcaggctgtgaagagctctgagctactcttccaagtccatgctaactgaattttggatggaagtcagtggggccaaacagaattcgaccagctgagtccttcctgaagactcacatgtgtctcctcaaattgttaggtgcttgttccaagctcagctgaagcttgtgtcaggtttatggttctggaaggaaggattgtggacttcacttcccctctcagcctctgtgccactcaattctctaccctgaccctcccagatgcgtacaaatctccagggttttatatagcacaggcatgatttcatccagggctggatggcatctcctgtggaattcaccacccaaggagacatagtggttttactaaaatgaagactgaaagtcctccatcatagtcacgtcctcataaactcaaaaaggagtcctggtcttcaattagataatcattatgattgaaggggatacaatttccactgagctctctaaaacacaagaattaacaaaaatagcacaaaaggcttcaggtattttacatatatttttcaaaaaatttttaactcaccaaaataatgggtaatatatatttaaaacacttaaaaggggcatatatttataaaatgaattaagctccaaatgaatatggacatggctaatgtaataaaatgtaagttcttgacataatataagattattgagttttttgctgttttatttctgccaaacaggaaacatttttacaaatggcatttatttactagtcataaccaggacaacttttcattttagaaaatcaggagtctattccattactgttatacttaacattaaaatgtttcagtacatacataatgggcacaactgagaaataaaattattcttggagtcatccagcagactaaatggtttttattaaagtttatccaaatagaaaatctgtacatttgctttgtcaccaaaagaaactaaccaaggtggcatgatactcctaaactctcagagaagactcctaaactctgcactttggggtgaataaagaacaggccttcctaggaatgataaatgtaaacatttttcaaataaacatcatctccccaagatggacaaatggagggggagagagagagaggagagaggagaggaaggagatcctagagagatgtgagggtgaatggggtagaaggtggcaaagtgagaatcttgtagtcattatggagatgtttaattcttgcttttgctattacttcctcttttacttactcaaaaagttttgtttgtcattgtttagcacaaaatgttcagaacatttggcagtgttaaatctgcagtctctgttttcttcttactgtatcttttttttcccccttttggttaaatgagaccaaaaggtagctctatttttgtaaattcatagtttgatcacatgttagagctggaagaatctttgggaacatctaatcctaggctagccatgtattatagacaaggaatcttaagactctggatttgtgttctgggtgcatattttgtactgccacccaggaagctaagtcagaccttcagactctgcaggtgtcacaagatggactctttgaatgtaaagaaatcctgggagactagggaatcctagatgagagtgtagaaatagctaagaaacctcaggcagatatagagatagagccaacagatttctcagtgggtatggcctttcatcttagtaccacttcttgccctgtgcctacttctctgtacttcttgcaatacctttaaggagagtgtgttgcgtagctgaatccagggcaccctcagcttatgtgttatatttccttccaaacatatgctcaaataggacttcagggcttggacaactaacagtgaagagtcagctggtgacagtgatgtttagcctagtagctgggttggcattaaaagacatcttatgccattccagtttcctgcccacggcatgcttctgtttgggcatatgtcccattatcactgtcagtgaggcccctctctagtttatatcccaatcacattcctagttccacctctgaaccagacctagggcctagtcttcacatacatcctggctttgccaagtaagtatttgcaaagtaatgacctatgatgagtgcttctttaatcaacactgcttaaaaaaaaggaaaaacaagatttaattctttgttaaatcccaactcttctctttgctagtttcattcttgttgaaattcaaatgaaactatcatctgtcatctcaaataaggaggacaaagtgcctgcagactaaaaattcattctaacttcatggtcacaaacttaagaagtctcatgtcagtgaccttacatgtgaattttttttttttaaatgagaggttttgcttatgtttgctagagtaatttcaagcttcagagaggatgtttatttcaactctctgggattcagaggctgcagccacgtaagggactagctggaccttccacaggctccaggctgaattggatcagaataacccatggacctttcacagagctgtcactcgccagcctgacctgctcatttttagggctttaggcctattgaaagtgtattcaaagactatccaaaggagcctgggaagaaaatgtctatagttcagccctgaccacaatgaagggattttttaaaggaatgaaaccaactgaatgcagctgccagggattgcacagcttctcacctctatggagtgactgccgggcttgctcctcttccattggagacacccagggatgtttgacagcctttctgctgttgcttagcaacccctgctgcattgattatgcatgctaagaaatagcagctattgtcctttttccttctctagaaggagctgactctggtgtgaaatctaaggctttacgttcagattgacagatgtcagattcctgtaaattctggtgttgatgatttaagagcttgagggatccataggaagagatttagggtggaagtgatcctaaggcatgtgcacaacacttgagggcacacagagctgagcatgcctctcccatcagagtatttgcttgtttggatccaaccagattgtccctttcctgatatctttggatgacctttgtttttttagtgaaattgatctatcaaccatttttttttccctttgcactgagttataatcaaagaacccatagagaggaggagaagcagagaaaccagtctttgatcaaactgagttactttacctttaagtaagtcaattgccaaggaaacgcttcatcgcagtttccctgcattaactgtggatgcattagctatttttggctccatccaacctgtatttccaaagctgcaattcctataacatttccttgtactatgaatccacattgatttttgctttttaaatatatccacaagtgtgcatcgtgggattcatggtctctcctcccctccccactaactcaggtgtatttctagaaacataaaatgctgaataggagagagaccttagaaatcatatatataacccaagcctcatgttttatggatgagaaaactgagactcaaggaagttgagtgacttccccaaggtgtaagttaaagtgaatcagaggtgttgtacaggaagaagacttggcaagataaaaaatggtaaaatttgacttcagcaagcactttcgttggaatctgacttaggatttttgcttttcatgtttccaaattctttcttgtcaacagagaaaatgatgatgtttttctccaccaagagtttggaaaagttttctgataaaccctctagcacataatgaggcaggccccaagtggcatccaacatgtttcttccatttccatgtcgggatggcccctacccagcctcttggcccaggtaactcccatccacgcatcagctctcagttcaagttgtccctcttgggaaggatgtgccttgtttgctcctccatctaggtcacatctccatgacatatgctattaaaacatctgtacttgtcctttatagcatttgtcaatattttaaaattatatatatatatttctgggcttatttaatgaatggcattgaatgtctgtctcctctagtagagtggcatattccccaggatggcaatagtgccttttagcacactgcctcatatgtagtagtatgcagtaaatgcttgttgaatgaatgaagggatggatgggtgggtgcatggaagaacaaaaagatcatgaaaataatagccttttgataaatagagagttgcaccaggtgtggtggctcatgcctgtaatccctgcattttgggaggccaaggcagatgaattgcttgagctcaggagttcaagaccagcctgggcaacatgatgaaaccccatgtctacaaaaaatacaaaaagttagctgagtgtggtggcatgcacctgtggtcccagctacttggtaggctgaagtggaaggattgcttgagcctgggaggcagaggttgtagtgagccgagattgcaccactgcactccactctgggtgacagagtgagaccccaactcaaaaaaaaaaaaaaaaaaaagaaaagaaaagaaaaaaaaagagttgacagttggcatttctaggtagggaaataatttgatgatctattgatagtcatagacttttatagctgaaagaaactgtaaagatgatatatatatagaataacgtaatctaacaagaaattattttagaaatgattgaatcactatatagatatatagagctaatattgatattctttagcttaactccaccattttgccaatgaagaaacaggaatccaaagaagacaaatgacctatctaaggtcacctagcctaaaagagatcatttaatgtcaatgtcagacctaggacttaaacacagtccagtgctcattgggtaccatattttcatttattgaattttacatgtgccctggtgaaccagattgaggaaatccaacacaatgacacttatcaaataatataaaggagtgtgttagttatgtcgtttatatggaaggatgggagacatgttcatattttcccaagtagaaatttaattcaagggaataagtggaaataagatatactggattcctgagggagtgtttaggcctcaggggaatacaagcaaaatattataatcagcttttataaaaagaacaatatcatgttcactggaaacccaactcaagctggcttaagcagaaaaaaagaatttattggcttctagaaatccatgctactagaaaacctacctatgggtatcccagctttcaggcaccactagatccagggaatgaacgattctctttctcgtcttctccatcccttggctctgcttccctctgtattggcttaattctcaggcaggttatttccacattttgctaaagacttgacagcaatgactcagggcttagatcttgccctcccagcaactcaaaagaaagagagctcctccttccaaacagctatgcaaaaatccaagggatgactcctattggcttatcttgggctgtgtcaccagaccctctggccagaggaatggaatattctgattatccaggcctgggtcacatactgacccttggaaatgaaagttggggtccactctacccaacccaaatggactgaacgtggggaagtattgtttccctggaagaatattagagatgctataactaaaagaagggagaaagaaatctgacagaagaaagtgaaagatgaccaactcaaataggaattgcaggagagcttggcctccctgtgatgagaagagctggtatctgaaagctcactcaagatctgaggcagccctggtgactgtcccttctttatcatctcggcaggagacatcagggaatctccttgggactcccctgcttagtgcagctgtctcttgcctctgctactccctaatatttgcctgcagctttcataccagctactgcccacactgcctccatgactcacttgctgattccccaagagggaaaatactatggtccagttcttccaattagtcatctgcaatgccatttagtcttcatgccaggacacctaccttccatccagtcatctgaggtggtcacgtggtacagaagaggccacctctgggaacagaagcaaccagagccacttgtctcagaatctatacaagagcagtataagggctcacaagaaaagcacattctctccaattctggaacagtttaaaaaaaaaaaacatagatgagaaaaagcatcaagagttagttgactcaagtgctctacccaggtaaggttatttctaagacagatggctcttttcattatttctttttattttttatgacagtcatcatatcacttttcacgtcttcattaattgtgaagtccttctcccattcctccctcttccggtgcctccttcccatgtttccacttacattggcatgtgaaatacttgttcccaaaaaatggaaattgatgatgaaaagattagttacttaagaagacaattgttagtgttactctaaaaaaatagtttgtgtcaacatgacgtaatgttgcacaaagcactgcaacattataaggatctaggaacagaaactgtaaaacttttaatagtgtctgtgattgtctttattatccagatgttgcttaatagactagatttctattgttctttgggtatgtacattctttcctggtgtgcacactcaagagtgtgtgtgtgtatgcatgcatgcatgcaggagtgcactgtaagatagagagttaggcatttgaattagataggccccaattattaagttcctatatcaatatacctttcccagtaatttcaactttagaccttgggtcagggatctgttttttgaattgttaatcactttggtgaccctcatttctggcttatcttctatttatccacatattttcagaaaagctaaaacaaaacagtgcatttcactctaatgaggactcatctggcatcaaacatagctggaggattcatttcacacttttgtatctctggaatgtatgcattgaaatagttgtgctgctttttaatttactttaacatgatgaacgaattcccagtcaaacaatggtctaccatgatccaccagctcctttatgtctagcaaaattttattggaaaattttatgctggtgtatttaaagcctgtaaatatattgcagttgtccacattggaggtcaacttctgattcactctcttttgattcaatatttctctaattgacagttgctacgaattagtttcctgtacaaagacataacatttctaatatgcaacttgatatcatatgcaagtataaaccatctattttatccaccatattattgcaaatagtttaaagtatgtgaatcagaacttaacctcctgtttccctttggatagttgccttgttagatctgagctggaagagccagtatggctgagaaaatagagatagcagtgaacaccctggctataaatcttgtatatgaggttgtcacttggtacataattaaagtcctgtcaaaggagttatatacaactaactgagttgatatacatagagtattgttttctagcacatagcaagcacaatctgagtgtttgtgatcattatcctcttcatacaatcatttaatgagtttttacatttgtagggatgttgggaagctacctattgcactctctctagtttctaagattttatttctcccaagttctttctatccacgaattcattaaaatacactcctccaaagctgaattttgtaagaatttgatagacacttcctctacctatttttagaaaagattctgtcgttagaagttcatgcagcatgcagcattatgatcaaggcttgttctaaatgcgtggttaatcattgcctgtaacaaacttataagtgtgtctaccttaattctatctcaattttatagtttagaaatgttttccaacattcccaagaaagaggttggctcactaatagcctatggaggtggcttttatagaacaatgaagtccaacagaagcataatgtgagccactattgagagtcacatttgtaattttgaacttcttagtatgcatatttaaaatgtaaaaagaaacatatgaaacttattttatcgatatagtttatttaactcaacatatctatattatcatttcaatgtattattaatataaaatattaatgagagagtttatattattttatttatagcaaggtctcaaaatctgttaggttttttttttacctaaaatacatctcaatttggacttgccaaatttcaaatcatcactagccacctgtgactgttggctaccatattggacagtgcacatccagaagccatcaggagactaaagattctccatttgcaacagatcttgccacagtgatcctaacccagaggaactcaggcatattaaccaaacattctcatgcatcttggttgactggtttgggagtttttaaatttccctctgtgttttaaacactatggtgggaattgggcatagtgaggtcttaccataataatctcttctatattttgtctttcaccttaacaaagacactgtttctatgatctctaaaatatatgagaagaagaatataagatcagtacttttaaaaagaacacaacctctattttacctcatctctcctaaaccacctacactttgaaatggatgatcatttgtcacatcctacaatattctatcacaccaatgatttcaaataagccctcttgcctctcttactagctttccattaaccttaacattttgctgaagcatttcatatgaattttgatttttcttttgtttttgctcttctatttcaccagcactagtttctcagttctgtgctaaaatttgtttcatgctagtgcattatttccaattctgaatcaatatgtactccaggcagtatctcgctacagttctggaggagccctctcccttaagagtatcttcagaaaagatggcagctttggggtgtcaggaaattcaccaggaataagaagaaatgaaactacaaagcagacagtaggagtaagaaaatagcaatgctcagtgatcgggcaaatatgcttgtcaaaatgaacctgaagaagagggattgtcagtgagggaagctgccacccgatattcatggcctcagtgcattgccaagggactcagggaaccagccaagccttgcataattgagtaaaatgacaatcagccatggtactaaaacagagatgatttttataaatagggttgatagcaggattttccagcttctgattgctatctggctatggttccacccttagaaaaattctgcccttacagtgccaaattcagaagatgattttgcccaagttgttaccaccatattttctgaatctcttaaaatagaattgaatcataatttagaaaaaaagacccaacatgcaaaaatggatgggcatgttggatgaggccaggtttgtgagatgcatttgccccatgaatagtggaatctcttctctcaatttcaaaaatgttactgaagcacagtttttgacattgcactgagaatgggctcttttccatattttgctttggggacatggaaatgttagatgcttcttaactctttcaggttggcgtttcaaaaaagaaaagcttgttctctctctctctctctctctctcacacacacacacacacacacacacacacacacacacagtctagcattcttttttttttttttttgagacggagtctcgctctgttgcccaggctggagtgcagtggcgtgctgtctgctcactgcaggctctgcctcctgggttcacgccattctcctgcctcagcctcccgagtagctgggattacaggtgtgagccaccatgcctggcccaatctagcattcttgaatcaatactacatagctaaaatttgagcagaaagattatacacagaatttgttcatgccttgtgataatgaccttcaagggccagtaccttttccaactcactgaaaaagataggcatgtgccttagaaataagctatctcagtgactcagaccatcctctgtagagactggatctgtgaaaaaacattgcaggccaagggctggatctgtgtgtgcagtatgacactttggggaggttggacagtcctctgggaagaagtggtagctccagcagcacctctgctctcatatcttgggttggcccctgggccttattcatgcatactttgaccttcttggattcttacgtgagcaaactgaatacaagactggttgtggtttcaaattcaaatcatcaaatgtccctctctaccaaggaaaacatcccaacttacactaccttgcatcattatccttgtgtccctgtggagtagatgatgatattgttatcctcactctcaaagaagaaaaccagggtcagagagctcgagggcagagccaggatttgaacctgcttcttctgatgctaagctagaaccccttccgtttgagcaccaccattgtgaggatttgtcattttactggaaggggaacacaagtttggggccaactctccaggagagagtgcatttgggcagctcccctcagccttggaaacaagtcctttcacttggtttcttttcctggtccgtctttcatttccactcctcactttggcccatgttcaacttttccagatgatcattcactggtcattcttcctcacattcttttatctctactttcacaaacttcgtgtatcaggggttcttttagttgcctgatactggatcaggcagcaggtgataaaagggtgaacaggacacacttcgactgtcaaaggcaggagtggagacaggcatgtacccaacaccattacgcaagtgcaagtgtgagaaaggcactggtgtgtgtggtttgctccatgggcccaggagaaggacccagcagatagacttccatctcttctatctcctccatctcctccataccctccatacctcatctgctatttttctactgtgaagttcagcgagataagcacatcacttctccctgtgcaagagggatgcaaaggagttgagtttggatctagctaaacactaaactaattaaatctgggtggcacaggggccatgtcaggcccagtttctgtagcttcaagggagcagagacccagaccccaggttccggccactgttcattttgttatttaatgaaggaatgtgcggtttctatggcaacagccccatcgaagctttatggcccctgagcacttgctgacccaaattcactcacttttccaaacagagctggtggtgcttataaagacacttctcagaaaaccacagagtaaagtgaaaatagtattgatcccgagagcgtgccctaataaatgcctcacctgctaatctccagctcagatctgctccctggggaacttcacctgtggcacattcaaggtctccaggtcacgtaggtcaggcatgtccccacagggagagaagcaccgaggccgtgatctagaaaatgaccaccagggacctggccgtgttctggacactggatatcatcttttagttttgcagtcagtacatatctgacagatgacagtgctttcattccattccaatactaaatttaagtgaacacagatgttcccatttgccatctaaccttaatgactgactgtagtctccctggagatgggattcacaactcacgtgccacttctgccaggagaagtatgccttttcctcaattagaagcaaccactccctctctgacctctcttgctgtcagtgtttagttctcgtggccttcatcattcattacacaaatagatgttgaatactagccctgtgctctgcccagggctggcaatgcagaaatgcatagttcctgggtcaagaagctcacagcctgtaccagagataagcaagtaaacatgcaattggaatgtactgtggtctgtgatgtgatagaggtaagcatgaggtgcacctagcagagtcaaccactctggcctgcagtgcagaggggatgtgacagcaatgaggggtggtcagggaacacttttcagagaggtggcagctgaactgagtcttggaggactgctagatactagccaggtatattggttttctacagctgctataacaggttactgcaaattcaccagcttaaacaacacaagtgatttatttcagttctggtggtcagacacctgaaatcagttttgctaagctaaagacaagatgttacagggctggttccttctggaggttctaggttagcatgttttcttgtcattttcagcttctagaggccacccacatttcttggctcatggcccctttcttcatcctcaaagccagaaatgtgacatcttttctcctctctgatcttctgtccttatggctctctctttgcttttatttatttatttggagacagagtctcgctctgtcgctcaggctggattgcagtggcatgatcttggctccctgcaacctctgcctcctgggttcaagtgattcttctacctcagcctcccgagtatctggaattacaggcacacaccatcaaacctggctaatttttgtatttttagtagagacagtgtttcactatgtttgccaggctgatctcgaactcctgaccttgggtgatctgcccgcctcagcctcccaaagtactgggattacaggcatgagctactgtacccggtctctctttgctcttataaggacccttgtaatgacattgggccctcctggataatccaggataatctctccacctcaagatccttaacttagttacatctgcaaagctgcatttgccacatcaggcaacatattcacaggctcccaggattaggaagtgaacagccttggcaaaggtgaggagttcaaccttccatgccagtgaccacacccaatatagcattccaggcagaggaatgtgcacatgtgcaaagggagggaggcatggcctgttgtcatcggggcagctgcagacagttcctaacgtggatgcatgggtttcgagaggagtgtcaagggattgagctggagagagatgcaggtgctgattcattcaggacagtgggttttgagcttgaattgcagttatttatatacatgtcatatctccctatttgcccataagtgcctgaggccaggatctgggtcattgccttcttgatgtcatcacagctctggctcagtgatgggcacatgccaagagctcagcacattatttgcatcactaaatgccagctttgccctgttatgacaccacagtggcagagttatctaagcagagaactaaaggcaccaaaacccagctgtcatgctcctgggcatcttcaccttggcagcatgaccactcttcttgcggcttgctgggcagggatgttttgtgagccggcagtgtttgtgggcacaggctggagaaggctctgtgcagtgctacataaagacaggcaaactgatcgttgctgaagctggagatgggtccacaaaggttcactgtactcttctttctactgaatcataacataaagtttttaaatcttatctgagcagaggtaagctgcacatagcatcacagaaagaaagcacaacaggcaccaacaagggaaagaagcccgtgggaattattgggtgcagaccagggttagaaaggatgtggaccctaaaaagacctcctgtctgtaacctaatgagagaacctctgtgaaagtgtgtcataagctggaaagctttgcatatgcctaaggagttattcctcagttattagcacaaatgttatttccttaggaactaggctgttttctcatcttttgcctaacaaatgagatggatgtctttcctatctcagtatcatagggcccactgaagtaatccttctcttttaacacccatccccagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcaggtacagtgaggcggggaggtgggctccaggagggagcaggccttcagggttcaggagtggagggttcatgggagggaacaagggacccctggacctttctcgaagcatcttatttgataatgacaccagcatatgccagagaaaggaggagagaaaaaagaaggtgacagtcttgttctttttccttaatgaattctatgtaatgtgatgcaaatgatccaactcaattcagtccgcattcactgaacatttgctacatggagtggtatgtgacatgggcatttgggatgggttttagatgatctgtaggagtttgctatgtggtgttattaaaggcaaaggaaacaggaagagctaaggtacccaggtgtcacaatggaaattgcagtccagtgagagtgaagttttcaagttcccagactgtggaatgaacagtaaggaagggaagcagaaaaacagctggaggagtcaaggctgaaagggtggggcaggtgcttggactttatcctaaggacaaaaagaataaccaggaggccagtagttcagaggatctacagtggaaagatccaaatccaaagaagaaaagcttcagaaggaaggaggtaaaaacattgattgaagactccagattatgcggagaccctgaggtcatgaaaagatggacagcttcaactgagaagttttgtgggatgtggggtcttcagaaaaaggcaaggcaaggaagagaaaatgttgactataaagggagtcactgggctattgattagggttagtgtcatttgaatttctagcattggcctgattggttgggatttatttatttatttatttatttatttatttatttatttgagacagagtctcgctctgtcacccaggctggagtgcagttatgtggtcttggctcactgcaacctccgcctcccaggttcaagtgattctcccacctcaacctcccacgtagctgggataacaggcatgtgccaccatgtctggtaattttcatatttttgtaaagacagggttttgccatgttggccaggctggtctcgaactcctgacctcgagtgatctgcctcccttagcctcccaaagtgctgggaaaacaggcatgagccaccacacctggccctgattgggttttagttcagctgtgccttctcaagaactcccctccctcagatgatgggtacagggaactgggaggaaccacaagatagagcaggtgagaaatggctgaaagtgactgtgatctgggaagaaaggtcaagttgctttgaaacagtaaagctaactcacacaatataagtggtgacttttgaggagaccatgctgcgtgatgataccagtagggattttggcctccagacacagctgaagttgagtctcagtccaggcattattagctgagtgacctcaggcaagtctctttagctgttctgatgagaatcttgagctggcagagtaggcatgaggactgaactagaataagtatagaaagctcttagcgtaggagcgaatggggaacgttcaataagcagacgcttgaattctgccaggaatgatgtcagctggtaaaccagctgcctcggtaagagaaatcacaaggagagctgagtttgataagatgcaggaagttggtgatcaccctggtagggtccacagtgagtgatctcctgcatctagcaagggagggaagaaatgtgctgagcaagatactccttggggaaggaaggcaagtgatgctttggcttctgtggaagtggcaaatacattatcatgaacctaaagagtaagaagtcccagtagtgaggacgggagattcaggttctccttcctattctgcatcagctgctggtgtcccttaaaagagcctccaccccagttcgctcaatcacctttgttctcaggtaggcctgccttgtatcctctctaagttttatctgggtctaatatgttttttttttttttaatttagctagtcctcattttggaaagattagcaaatgggctgcttgtgatatcttggtagacagtaataggaaagttgttaaaggctgttcacctgcccttgctgggcacagtttccttacctgtgaaaggggtatcatttaatccatctcaaggtctagtgtgtgcattgttggactgagaggtaatcaagaaatgttgtcctcacaatctttcacaatacttcatctctgccacaatttcctcttcattttggttgagagatctgaaatcctggggaagtggcacctttcttgtgatggcaacacctaggagtctctgtctgcctctcatttccatgggtgctgaagagggctttgcacagaaatcagccccagtaagcttcatgtatctgctggaagactcagacactgcagtttaagtaatcagtcaatcactgcgagaacatactgctgtttttagaaatggtatcacatggctggtgccgtctggatcatttttaccctctttagcctcatggatccacgtgcaatttaattcttctttgctgggctggatccctgttctctgcttttcctatgattgtgtgggcgaggaaatgccaggtggaattaggaatatatagccgatttgcagtattctgagacaatcttgatgcattatcctacgtcagcaaaatttttcttgtaagtgataggacaggggatgacttttgaacattgtcttgtcagctctaacatgaaaggaagaaaaaagctgaatgtggttgaggtctggctgcttctaagagaaatattttcccattgttcccatgccccagtctacttccctaattcaagatggtgctttcgaaaatctgtagcataagaaatacaaatgtgctcacctggatgcaattaaatgcttccgtgagctcacagtgtgtctgtacatacatgaatgtgtgtgtgtgtgtgttgcaacttgactctttcactttctcactcagcctctccttctccctagctctccttcctgccttgcagaaggaacaggcacctggttctcccttggcaccttgcacagggtgtggagcaattggaaacctagcctgcttggtttcagaacctgctaaactctgggaacaagaggtttgccatgccaaaagtctagttctcaggtgcactaacatgctgcaaatataggctgtcctctttccgcaagggagctgggcacttagctgccatgaaaagtccccagctgtatcagctctgccctataaagacagatgtcttctcttgtctccctaccctctttattcatccagaagccatatattaagcaccagcatggccaggctctaagctagttagggtgggaaatgaggaataaaacacatgtctttgcttgcaagggtttcatgatttttcctcttagaatctgtccagagttgccgtctaatgaggggaaaaatagactactatttttcaaactatcacagctaacatttattgaactttctaagcattttaatatgtttcagggtataaaccatccttgccgtcattcctacgttacagttggggaaactgaatcacacaggtagcagatgacagagctgagattcaaacctgcagcccctggctgcaagaactcatggtcttaaccactctgccatcctctctgctgaggtgcttgttgaaaagaccagaaggaaagtggtgtgctatagaatcctggagccagagcagttggtgcagtgccggctgtaacccacgctggagagaactggacagctaagtcaggcccatgaacctgctacttgcttcccaagccagggagctgatggtgctttttttaattttgttatttttttacctcttaaggaatgtcttcctggaagagatgaaatgtgttttgatttctaagacttcacgaggacctgggaaagtgaaagcagaggattgcagcgttaaccgttatttctgttcctcttaaggacttgtgtagcagacccacctacccactttttacagcagtatgttctgctcagagaaagcatccagaggcttattttatttaaagagccgtgttcagaaagttgaacagcaaatacccagatataaacaggggaaattactttaaaaatccaggagtctcccccaacccacacatactaatataaagtgcattaggcatttgagggccaccagcttcctgacgtctgcagagtgtggggttggaggacagaattttgtgcagaggtggccttttgcactgacatctaacttttcctctatcctggagtcttgcctctgagagatatttaaagtagatcagttttctggaactgatataaggctgtggccaatcaacaaattattttattatttaaatggtacctatgaagattaaattctgaccgagtctctgggtctttatttcagattttctttagtttatgtgcaccccagccccttctcctggtgctgaggtcatagtagatttaaggaagacaagtgaaaacattggcaatttcccctgacccctcagtgctgaaaaggattaggcttgattcacctttagtgaagtggaaagggcccaccctctagtatcctgaagagccctgttacaggccagttacaaaaagtaatgcacagaggataacttgtgttttcacatcacctgtcaatttcatttttaaagagaatctttgtttgcaaagcctttctccctggttttcctgtgaaaggccacgaagcactatgcaagcacagtgtcagtcctcctcacatcaatgcccttagcaaggggcagttagtatctacaatttacagagtgaggaaacaggcccagagaggttatgtaactcacccaaaatcacacagcaagtgtaggacaggatccaaattcatttcacatatcccggagctttggccactgtgccgcttcttaccttgagtaggtgcttttgagctgaagaaagccctggagcattttcccagcattgttcctcaatgtgacaagaggcagctgggggttgtggtttgagtagaggtgaaatatgttaggactggcttgtacaaaaacaggaaactcctccccagggaatggttaaatccaggtatttagagacaggaagaacctaagaaattacccagtataatattcctctgtatttttgactaatgaagaaattgtacatgagagaaattaaagggcttcccaggatcatggcattggacgctggtaggcctgggagaccccccaactcctgtccagtgttcattccctgagattacaggaatgaaagatctggtgacagaatgattcccgaaatcaaaggcaaagacagtcactgtaggctggagccgggatggaagtggggatacgcctgtggcttgaatagttgggggaaggagggcggagaggcagggcaaaccctgacatgtgttctcagacaattctggctttctcagtttcaaatactcacacggctctgaaaccctgcaggtgaggttacctactttaacatttatgcagaatcctctatatttattctaagtgtttcaaaacgtcttgagagagatctttcctttcccagagagaagcccttggccacgccagggcagagcccgacagcaaaccccgcctttattccttgcactgcagcgccccctcaggccaccaggggcaatgacgctcatcttggctcacagcgcaggatgtcacagcagagcctgccgcgctgagggcggcatcctaagacgcggatcctcccacccttgcaggacttgcgtgttagggtgccctaagtcatcacatagctgaggagaggccaggtgtgtaagacagaagaaaaataagatttaaaaaatcatagtccccctccccatagtgtaaacaataaaattttccccagcaaaagaataaacaggctgtggttcaaaagagttctcctatgtgttggccatagcctgtgttgagcggaggttggaggaggggtggacagaaggaaatggtattttgtattgagaatgaacatccagattgagaatgccctgggactctgttgttgaactgggcttgagagagccaggcgtagcttcaaaaccatgcctggccacagatcaggtggactatggaaggccgcaggctgcccagctctggtgctggtggggacactctggaggaatcagcttggttgggggatactctggcatagcctggctaggtgggaaggggtggggacccactgggctgccatgtccatcccactaggagagtccatctttccccatatgttttgtttttggttttgtcttccttcacctacctgctgcttctcagggtcagggggccctggtaagtgcctgaacccagcacagtgccagagcccctaaaatgtcaacctgtctgtacactggagggaagggggacattcaggcccacggggtcctgggaattccagactctttgggaaacagagcagcctgggtgctctcaggactgcagaagtacaactgtgtgagcacctttgtctcctcttcatgctaagtcaggcagcatcttttagcaccagcagctacagggtgggggtgaggagcttagcaagagggacggggaggggcaggggcaaagggcccctggagtgaaaatgctgaggcccccagcttcattctccatgtccttccccagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtgagtagctgtgcagatcagagaccccagggacctctttccctgcgggacccctgctgtatttgtttgctgaggctgtcataacaaaatatcatgactgggtggcttaaacgacagacatgtgtttctcatggctctggaggctggaagtccaagctcaaggtgtgagtgggattggttcctcctgaggcctcgctccttggcttgcaggtggctgccttctcactatgccctcacattgggatggtgacaacccaatccttccctttaggcctaaatttcttcttttaaggacaccagtcagattggattgcatcccaccctaatggtctttttaacttaatcacctacttaaagtcttgtctccaaatacagtcacattttgaggccctggaggtgaggttatcaacgtataaattttggggggacgcaggtcagcccatagcacccaccctgctcttggcactccagcgtggtgggtgagatctccaagagtgaagtcctcagtgtgagaatccttccagagaaaactgagggcctgggggaattcctggtgaggttaaaggatgctgaggtttggctttgattctgtgaaagtatgcctggagcctttgtttgagatttgaacaaaagtgaacttgttcacataaataatagtacaccggactttggaagttccctccaagcgccatcttggttgaaagcggtttagcttggtgagatggaagaagttttatcctgcctgttcctagacacttccacacagcttgtctggtgtttccaccactgaaatcactgagaggcagagttacagacagtgactcagatccactgatgacctagaactggcccccgggatatgttaactttgttaactgagattttggaactcggacatgagagaaaagggaatttctggaaatgttgaagttgtgatatttagagtgaagattcggggtggtgttctaccactttgattttctaccaaccctcaatttgattttcttgtgtgttttgctgtttttcaaggagagaggaagggaaaaggaaggaagggaataaatgtgctggtgtctatagcttaacagcataaagcacagaactggctacctttcataatagggtagggctggtgaagatgctggctttgctcttctcattgttatttatttttgaggaggcaccttctcagtttatttcctgttccccttcctgcagtcttgctcacctctatggcctctgcgttttagtggggtgaactttgctataattagtgtaagaaaattaatctattgtcgtgctccattattcttcatttgactgttttgtggtgttttttttttttcttggtcaccttgataagcatcatttacattttgtgtggcaaaaaggaatagagaccacatggaaaaagattctcttgggtgtatttgcaggagatgggggcacactcttaacttcaggtgttcaaaatgtagcttaaaagcagtgactagtttgttcaagatatttaaaacgtggggagactttacctaccagagatggtctcctctgctagttctacaccttaatgaaagttctcccttccttgatgggggcagggaaacacatggatgattctccgaagaaaagctttgctgatcttggtgagcacccaagggagggacatgtggcccaggcaaaggctttctctctgcagtattagtaaagggttcaacgtgcctggcacaaaaagtgagtgcttgttaagtttttccacctaattattacccaaatcaatagacatacacttcatctccaaagctaggacttaactggatggaacctggcatcctcctctctaggaatctccaaaaataatttaaagaaaaatacctaaaatctcaacaataaaaagataaatcactcaattcgaaagtaggagaaggttctgaatagacatttctccaaagacaacatccacatggtcaataagcacatgaaaagatgggtgacatcattagtctttagggaaaatgcaaagaaaactcacaataagacaccatttcacaccccctgagatgactacaatagcaagtgttagccaggctgcagaaaaattgaaactctggtactctcctggtgggaatgtgaaatggtgcagctgctttggaaaaccgtttggtagttcctcaaaatgttcaacatagagttaccatgtaattcagtaattctactgctaggcatgtacccaagagaactgaaataatatgttcccacaaaaacttgaacacaaatgtgcatggtagtattactattaatagctaaaaagtggaaacaagtttattgtccatcaactgattaatgaataaacaaaatgcggtaatccatacaatggaatattattcagcagtacaaaagaataaagtactgattcatgctgcaacacagataaacctctaaaacagtgtgctaagtgaaagaagtcagacacaaaaggccacataccatatgattccatttatatgaaatgtccagaataggcaaatccatagagacaggaagtagattaatggttaccgggagatgggggcagggaagaatgggaattgactgctactgcgtacagggtttcttttgggggtgatgaaaatgtgctagaactatatacagtggtggcaattgtacaacattaatcatatacaaaaaaaaaacactgaatcattcactttaaaggctaaatattttggtacctgaattatatctcaaaaaagaaaaaaagagcatgaaaaggaaaataatagcaaaacagtgaccatcattatgaacataagaaattaatctcggtcatttatttacacattgtaaaaacactggactttgccatctaccatattttaacatttgttaaaaagaaaatcctccacttaggtggcaatattctgaagtactttcttctgaaatgatcggaagaataacgattcccagttcctttatttgttacatgatcttggaactggctgagtcactaagaaatgtgctccagatgccatgttaatttcacccccgtggccactactcggttgcagttgtagggttagtttttgtttgattttcccattcaggatgagggaaaagaaccagccttgcaatggcctctgttgcagatgggaatgggcaagactgggtagggaagtgaaggatggatgcaaaacctgacaatttgctagcagcctagggaaacaaggaaatgacactttattttgcctttctaaaatgtcagaatgatggttcaccttttcgtttcatgaaagtgaatatttgccatcatagaactggttcttgggagatgtttgcttattgacatatcgatggggcccattctgttgagtttgtcaaatggacaagcagaagctgttgatctgttttacaggagaactccagtgcctcctgcggtggctaagtcccagagcactcttgcttttacatcagtcatccacctattgggtcacttgaaagcttaaccttgaacccatccccttcacggtgtctcttcaacttctctatcaccatagctggggtaatgtgttctccttatgattcaggtttctcatttgctggcaccttagtaatttttaaaaatttttttcattattttatccctatcctcttcaacactctgcattgaactccaaggtgagaagctgctttagctgatgtgagctgtcgtcaccaatgttaaaaattctttccatcgcagtaatgggacacagttgtgtgtgggttttttttgtttgtttttggttttggttttgttttctgaccagggctatcttatgtggaagaatggtgattgggcatggagtcaactgaattgcataaaatgttccttatctttaagcaagaaccattcccactagaagtccaagccttccactcatggtggcttataagcagccttgagggatagccatgtctctgtgcaattcatggcaggaggggcgggtggcagctgttctttcgttacaggggagctggtagcaccaggaaatggctgcctccaggcgtccaccctgttgcagctgagctaattataccttcccaatgaagggagaaatcggaacactacatttgcattgaaaccagcccaacatggcgggtccaaaattactctagcatttatgttctctgaattgttttaattagcagatctgcagtaccagtcttttgtttttttgtttctttcctccactggcaaaacctgacatttaggaaacatctgaaccagatttcagtcacattctgcctgttggagacctagggtctcactctacttggtcatgcctgtgccgcattgagaccatttaaatttttgtaatgtgccccttgggtggtttgcactgtttggttttaacatatgcttaaaatgtatgtgatctgttgatgagtggagggccccaaacatctgcaatcctagctgttaaatcttgttctctcttgggcttcagctttatgttggagtggtaagaaaccctgtcctttaatttatcttccacttaagaaaagaaaaggaagaagaataagcaaagtgatttatagtagacatttacagaaacaaatgaatataacttggctgagcaaggccagggcagaactctaaagtgttaaagagatgtcagcaacagattccaggaaatcatcattagatgcccactcccagtttatcaactgggaagagaaaggaagatgtgtggtaccaagaccagctaatatagcaagtggccagatgaacagatatgaattttagcacctttcaccttaccctactcaccttagaggtttccaagggttgatgaactggaaaatatagtcctgagccacagaagggagaaggtttagtaatttaagaactggccaagcatgtaagaaataatcaagagttaaccatcattccttggtctttaaaaagactgtgtttatttttaagaaatatttttatgtaatgtgaatattttgagataggtaggtggatggatggatggatagattgattgactgactgattgattaatagaaagatagactcatcccacagatgtttttaccatcttgttttgtcatgtactaacaccattccctctatgaggagcagcataagaggaggtttcagttccacctcctccctgacttcctcttagcagaataattgctcacaaatatgtgatttttctatactccatacaaagaggcatcacagcatacagtaccttgcatcaaggaaactggctcatatctatgtctctcattaatatgagagctgatagaagataagtcttacacatctttgtttctgcagaaactggcacagggcatggcgcatatgaggtggtcagtacatgattgttgaacaggactcccaccaggactcccactttttgtgtgtgcctttgtagccctgcaggtgaataaataaggtactcagatttgtatttgggtctggctttgaagttaggagtgttgacttcaagaagtaaagctaggaatataggaccatccctatctcagacaacattttcgttgcagtgaagagcccagggctaaaacttacttctattgattaccataataagaaaatttcctcctgtaaactatgtctagaacctttgaaaccaggcacaatattcaatttacagggcaaatcagttccttcctaaaagagggatgtcctctgtgtcattaactctcatttgcatggatcattttcttatttttctcatcactatataatacttagacaataattcttagctttcacatgaacaattatagatctttctgtttcggctcttttgattaaagtgtacttaaaaccataagagtttgtttattttatgaaatcatcttcaattaatgcttcttacaacacttagagcacagttcagaggaacccgtctgccagggagaagtctattaagttcagactatttctgtattaaacgggacttgcataaactgtttcaaggttctaaattggtttaatttgtattcagcctccctaagaaccttttacatatgctttggagttgccacagggtgagcgtgagagtcctctcattcattcattttatcagtacatgtttatgaaacaactactatgtgctagatgcaatggtagatgcaaaaagcatctagactttttaaagaaaggcacctaggctctactttgaggagttcccagacattttaatacaatgtgataaatgctgtaatgtagatacaaaatgggaacccaaaagaggaagcctccagcctgctttggaaactcagagtagggttctcagggacacaacgtttgagctggtatttaagatatagaccctaaattgttccatttgcaaggaggccctaggccaggatagagaggaagacagaaagtaggatataaggagagatgtcaatgtaaacatcacagtatgtgatccaggagtggggtcttctttgctattcttctgaggctatcaaaatacgctcttgaggctattatcacatttcacaggggtttttgccatgccaaagactttggacttgatcctttggcagtgtggagccactgagagattctacactggaaaatgacatattagattgcattctgatatgtcatatggtctatgaaatagatccgccaaacagatcccaacatcttcacctctgtacttatttgatttgcctagagcagggtctctcacccatcagctgtcagtggatgtgcttcaaaaatgtgatcttgtaatcataaggtaagcaatctctttccttgatgcagaaatcctcagagcctttaatctattgctatgccttgtgatcttttaacaaaggctatagaaacttttggaaaccagcatggagacacgttattccagttcttggtcccatccttcacccaactggtgaagaatgctagcagtagatgggtaaatccttgtgtcccctttttttttggtcttctgagtctctttttcttgaaatcactagcccctatactttatacgtagaagtgctacattcagaaattagttatgcttccaggtgcactgggaatgacagtagggaaaagtggacattgcccattggcttggatggggcagaaggactctgatgcctcaaggtcctaagaggtctctcctcctccagttttgaaacagttgggcctccgctttctcgtgcctgtgatattctatgcttttgcctcactcagaccagagcctcttctaaaagtaagctggcaacaaagagttagctggggtacagagggaagagcatccaatttggagcctgaagacagatattcaagtctctgatttccttttctacccttatgatcatatcagttaggaatgtgtttagcctaaggaaccaatatgctactaaaggtggctaagcagataaggggttgttttactcaagtgaaaggaagttcagaagcgggcaatttctgattggttcagaggctttccagtgtcagagctgtggattggcactggagatgtacttggtctttccctcctggctgcaagatggctgcagcaactccaaacattaaaactgcaatccgaggaggaaggccaggttgctgcacagagcagattgttttttcctgcacacctttttccatcagggcataaatctttcctagaacatcccctctgcaaatacttctttttgtacctcattggccagaggtgggtcaagactaagggctgagctcactcgccagagatcaatgacttgttaccaaagacctagacaaaactgcaattctgttacagagaaaaaggaagcaaatggctttggggtcatcaaagaaaattatctgtcacattgaccttatgcatcatgataacatctgtttctttatttgcaatgagcccctgcctttaaaagttgagaactataaatcgaagtgatacaaaataattgcttattcttctgtgttaatgcttctttttgctctggctgcttttaagattttctctttattactggtcttgggcaatttgattatgatatgccttagtattgttgtatttatatttattgtgcttggactcactggatttcttggatttgtgggtttatagttttcatcagttcagaattttttggctattctttgctcaaatattaattctgcttttcccaccaaccccctatggactccaatttcacttataataagccacttgacactgtctcatgactcactgagctgtttccatgtttttgaattctgttttttctgtgtgtttcattttggatagtttttgttattatgtcaccaagttcagtaattttttttctcctgcaatgtctaatttgccattattctcatccagtatagtctccatttcacactttgcagttttcatttctggaagttcaatatgggccttttcttatatctaccatgtctctagttaactttttaagcatatggaatattgtcataataaatatttcaatgtatttgtaattctaacatctgtatctatccttaaccaggttccgttgattgagttttctccttattgtgggtcatattttctgctcctttgcatgcttggtagttttaagttggaagccagacattgtgaatttcaccttgttggatgctggatgtttttgtattcctgtaaatatttctgagctttgttatggaatgcatttatattgcatgggaacagtttgatccttttgtgtgttactgttaagatttattggtcaagaccacagcaatgcttactttagggcttatttcccactattgaggcaagatcctcctgtgtactctgcccaatgccccatgaatccggaggtcctcaccctgcttcataggaaccagctttatttctcaccctgtgtgagcactgggcactgttttctcagatcttttgggaagtttttccttcggccatgaatagtatcctcacatgcacgcactgatcagaactcagctcggtattcaacgggcatcctctgcagatcttcagagttctttctacgtgcagctctctcttctctggtattctgtcctttcaacgctagccactttgatctccccagactctcagctccatctccccaacttagggagcttgttggactcttgggctccccactctgtctttctcaatgaattaagctcacaatgtttgtttctcatctctcagatcactcactgtccttcattgcctgttgtctagtatgaaaacaattttttcacatatgaagccattttttggttgttactccatcttgcctaaaagcagaagatggttatcatttctcttgataatgaatatatcattttgaaaatctaccagtgaactgcctacaagctgcagcatggcaaacaagttctctcatcgctttaagacagttacttcctgtgaaggtttttttcctttttaattaaataacttacatttacataatactttttctacaattaaagtttccctgcctacacagaattattacttaagtaggagagtattctccatctccagtgagtattgagcaagaggaaattatcttagcctacttgttacctttgagagattccctgggctaaaaaaatgaattggttcaagaaggctttgaaaaaaaatgtgtaggcagaatattagtaatgctacccacttttcacattctcccacagtctttgcctatggttggggtcaaacaccttggatggatgaaatggctgaattaatccaagatagttttgcagacatagttcttaaccatgcctctttaatgtataaataccaagtaagatgtattctgttccccaaggaaaaccacacgtgtcctggggagaagagacgtaaatgaatcactctgatactaggcagtgtgatacatgttatggagagcagagataaactgatttggggggagatgtgggatgacatctggaaaattctctgaaagcaacagaatttgaggtgggccttaaaggataaatagcaggtagaaatgttgttaaccgcaaagactattgcctgtgatggatgttataaatacaattagatgacctgttaacaagtactttttgggaggatgtagaagttctaattttgaactccacatgcctcacagaatggtaggcacttcctaagttcttacagatcatgacaattgcctaaaaggagcttccaagaaagattctataatattcttcttgtaagtctttcaaaatgaagatgctcttcaaagtagtgggtcttcaggatgaaaattactcctgagtccaagcatgatttgacttcatctttcaactctccatatcaatctcttaaaattctgtcctccggtcatttctacctagtctatatgtctatgtatgagagactagaaaactccaagatattgttacatcaacgtagcataatactggatacctacagagacgtgaaaaacaccagggtttctctttctgcagagctgcagtggctttccctgttgatcatcctattggtgaccataagaacttagcacagtcatgttgcctgagggattctgcttaccaggtacaactagtttaaatttgactccatgaagagaattatcaaacataaaatagcttgtgatatccaactaagagaaaacgtctgaaattctttttatgctgatggaggcatggaagtatgatcttacctagtactatagaacttcctactgcatgggctcctaagcttggtcacacatctgaataccccagagtgtcttttgcgtaatgttgatttttgggcttcactttacatatactgattcagcatcttgaaagcgatgagatttgggaatttatattcttcacaagcttcttagctgagtctgatgtccagccaagtgtagagctatgtttttgtttgtttgtttgtttgttttgaagtggagtcttactctgccacccaagctggagtgtaatggcacaatatcagttcactgcaacctccacctcccgggttcaagtgagtctcctgcctcagcctcccgagcagctgggattacaggcacctgccaccacactgggctaaatttttgtatttttagtagagacggggtttcactgtgctggccaggctggtctcgaactcctggccttatgatctgccccactcagcctcccaaagtgctgggattacaggtgtaagccactgcgcccagccagtgtagagctattatataggcactgctcaggtagacttacagaaagtagacaaggatataacacggtctcctctatgctgagattcaaatggtaactttacaaaaggtcttagttatcaagcttctaaaggagaatagttgctgtgaaaaattctctcaaccatgacccttgactttcctgagagagatggtattaccataattaatggatttttaggacttctgatgggaaagaccctctgaattttaatcactagtgcacagtcatatcctactctcttgaacaccagagcttaggttcattgaaccatgacatttccgaatgaacccaagaactatttcttacggtatcagttagtaaacgaagtgctatttgaggctctcttctctcatcctgggaggtgagcttgactcattctctaggtaatgttgtcaaagacatcatgaggatcacaagagagacagagcaagcagcaggtggaaagtgatgcaccatgttcctggacatgccaacacagagcacaccaccgcccctgccccgcaacccctctccacaaggagctggggctcccaggctggtggtctaggcagacccctgctggccttctctgtcactgcatggttgtgtatctgtgtgggtgatgactggtggaggccctacgcaggaaatgcaagaaaaggcttgtggagagtcaaacagcttgtcaaggtatccttgtgggtgtctgtattgaagtgtcacagtatgaaggcattttattagcagctattttagaatccgaacactgaaatggaacagtttcttccctacatggcatttccaggctggcttcctccctcacagccttacgacagcaccagccttctcataagggggtggagaacatgacgctgggctcctttgacggcggagcccagctatgtggcccacgccctcagccctggagataatttggttcattcacatgttggtgatgacagagatactgcagcggaagctggggaggatttgaggctcatgcctcgcctttgtgtgcagcacagaaatcttcctgggttttggaaaggtatggagagattgatgcccggggttaagggcgtggagggaacatccactcaaaggagaaattgcagggtgagtgatgtccaacctcagtatggcttttttctgcagctaccatgggggcttaagttcttcccagctgtcttagggcaagtagtgaatttctttctggaaaactcattagacttcattgtaggaacaacgaccttagaagactcctgttaatgtcttagagggctgatgtggggtcttgtaaggaagactgacatacctggcctccttttatgtctcagcttggcatgtaaccctctcagccatcttccaatttactgatgagaaaaataatattcagggatgtgaagtcactttcctgaagtgccctcccttatgcctctggcagactggcatctgagctcctgttctcaaacaaaaactccatgctcttcccactctgaaagcttctctgtgccctcagcacacccctggctcctctagtcttctccctgagaggtgggcaagggtcgcctggtgtattctcagagctctgccctttgtaatcataaaagatccatctaggacagtggcccactgtgcagagcaaagttctaaagctgtgttggttgcaagaagaaaagggatactccaaatttcagaaccatggctttttagattgggaaggggcttcagaagtagtcagtctgtccctttattttaaggagggaatctgggttttttgtccagcctaccagctctccagctttgggtcattcctgaacctgactaatatgccaaggaacataggcaggcagacagcagacttggatttattctcactttcaatatgtgtacagtgtgtggctttgaataactcatttaacttctcagaaccttacttctcatcttagtaaaatggtaaagaagtcggctctgtctgctatgagtgctgtcatgatgccaccatgaaaattgtgaagtatacatattattaagtattatttattctgtttttgccattggggaatggggacagagcagagtcctgtggcatatactgtgctacacctagcatatttgcaaggatgctctattgagtaaccacatccttgaatccaaagatgggttccaaagattgtgaatgctgtcttgggtctttttggcatgggcccaagatgttgctgtgggggcatatatgatacattgacgtcacattttcgttttcttcatgtctcctgaattaataaaacacttcctacaagtgcagccacacttcatgcattgttggtccaccctcccaggctagaatggtgtttatgaggtctttaggaaggtcaaaagacttccccagattcctaactggctgctgtcctgtactctgttttttccgtgctatccctaaaggcaactgtagccaccaccactaaaagcatattttaatactccatgtcatgtgcttcctttgtgtctttggagttggtccagaacgatcactcgcttaccttttgtcagccattctgagtcatatgtatttgcctgagcatgaaacacttgtgttaaaggaaaagttttgtggcgtaagccacacacattgcaggaaaagctcaatttgcatagctcaggatagggctctgacctttagcagtctggggaagcctgcccactcctgcaccaaataatgttctgcatgcaaaaaaataaaatatacagcattacaaaagaacagcgttgcattcagcatagttataaaatgttaaaagggtgacataataacacgtgtttttgttaaaacattaaataatgagatcttttggcggtctaatagctattaaaatttcaaagtgatgatcataaatgatgttttgagataatctataacaataataatgtggcatgaaaatatctgatttctatgggtgacaacttcacagattctgccaatcctaagagatgctaaatttttgttaaaagttcatgaaaatgagatgcaattcaagttgacagaaccctgtgaattctatccatggatccctttaggatctgtgcattacaggtaaagaacacttcctttacagcattgtaaaccagtgcacgaatgctcattagacatgtataatacaataaagttctgctggctaagagcactctagaacattggaagcagggagatgagggtaggagaattgcataaacagcatagtctctggagccagattttctgggttcaaattccagctccacctcttactatttttgtgatcttgaacaagtgacttaacctctcaacactatttcttcaacttttaaatggcaataatagggccgggcatggtggttcatgcctgtaattccaaggaggggaatttggaaggccaaggtgggtggatcacctgaggtcaggagttcgagaccagcctggtcaacatggcaaaaccccttctctgctaaaaatacaaaaactagccaggtgtggtggtgggcgcctgtaatcccagctacttgggaggctgaggcatgaggaggttgcagtgaactgagatcacaccactgcactccagcctgggggacagagtgcaaaaaataaaaaaataaaaaataaataaaaataataaaaaataaaaaatggcaataataataataataccttcttaaagagatgtggtaaggattaagtgcaccttaaatagtgcctacctcatagcaggcactttatatgtcagctgtcattattgtaactatctgtgcatacagaaagagaatatctcagaaataaagagcatcagggtgagtcagcgctgggcagggcagtgttaagagggcatgcacgcactggtgtttggttagctgtgaattcagcccacattactccacctctcaaggatattgcaaggaactttacccaagagccttgctgaaatcaatatacttcatgtccaaggcaatcccccatcctatccagcaacttcacttacttctggatgatcatttggtatgatttcatcttaaagaacccatacttgcttctggtcatcactgcattttctaagtgctttcaaacaatgcttaaatagtttatgttaaaatctagcctggaacaaaggtcaagtttagtgatcagttgtttctggaatcctactttttccctcttggaaattatgtcagtctttgctcatccccttcagcatctccacttttacttttttcttgttccttctgtctgagtgagtgccacacttacattgtcaaaaggagcaggctgggacagtgtttagctatgcttgaagacatagattcatttaaaacagtttccatttaaagaacaatttaaccatatttgttacatcacttctagaattcaggtcattcttcttgatggaacagaaagaatcaaaataggaattatgtagctaattcatttaacaaatattgctgagcatgagcaccttacctgctaggcactgggcactagagggaaaaagtgagcaaaaatagacacatcttagcctcctggacctaatgatccccctagagagccagacatttatcaaataattccacaaacacatattgaacaagacctgtgataaatggcatggaacaaacattctgagggctatgagaatctgtaataagggaatctaaccaggttagattcctgtactctgggaagactgaggagggcatctttgagccctgggctccttccccactgggcagaggaaacaatgagcaggaaggccccgtggcaagagaagcagaacatggtaaaggagatggcagatggccagtgtgctggacatagagcccaaggtgcaaaacccagctgtagaagcagaaggaccttgccagccatgctgaggattttttgtgatcataaaagcaatgagatgccactaagagctctcagaaagaggtagggctttgcaactctgtgagccagagtaagcagatgggctgaggggctcttacagaagctcagtggggagatgatggtttggtgggcatagattcagagcaaagtgaaaagacttataagctatttaggaggcaaaattgcaggacctggaggtggattgggtatggaaagggaaaagaagaggaagatatcaaggatgtgagatagatttctggccagaataactggacagttggtgtcattctatgaccttgttttggaatggtctggaaggagaccaaggattcagctgggtgcattaaattaagtttaaagtgattttaagtcatctgtatttcaagatcacctctaaccggcatgaaaacattcataggggggtatccaaatagttgaacaacgccaaggtgggagagttgggagagctggggacatttgggtgagaaaaaggaagacctaaatgtggacatactagctaccttctgctacatagatgaggatagaggttctagaggccagaactgtgtctgttgcatagaagtttcatgaagcagatttggcacgatgtaaagaggaactaagaacgagagctgtgatgtatcagggctgccttcccaaaagatgagttccttgtcactggagggaagtgtccaagtgtaggttttccatcttctattatgctgcagaaagggctccagtgttttaaaaattgtgttctatggaacccagtgagtttatgaaggggcttcagtgactggttttgtaaacagttgatttcaatttcatctctttatgtgtactataaccgttaatataactactaatatgaaatatgctgtaaccaataaaaactaatgaaaactaacatgctcaaatgtgttatatacacaattttaacacattagacagtggaaaaactttgatgtgtttttggggtttagctttataatgtataaatactaccaacttgaagttttagaaatgaattcctagtaatacatgcatttttattttcattagttttgaagatggtgtcttaagattatatgaaatttagataaggcctaaagatccttataactcaaagattccattggttttattcagacaattaaaataagcaatcatattctcatttctatacatttattttagcccccaaaaacccatatgagcagatctaggtcctctgtgcacagggaaacatttatgaagcactctgcttccagaattaactatgatttcagctctccctacgctctccattgagccctctttccatgctttccttccttctttcaaacttgccaaacttcatctgagctttcaaagacattgattatatgtgcatggactactctaaaaaagtcttggtatctcattatatttatgacataagtatttaaatagcttaaggaccatggccaacagcttctccatgtcacagagaagagaatgttcaaatgttcacagctttgaagcacagctcactgtgaataattaagtggcagtagttaagagaaaaaggggaaaatggtaagcagatcagagaaacccagagaacatttgattcaactttttaccagatgactgcttcactattctccaggccctcagcagaactcaccaactttgccacagagagaacattcacccaaggacacacttggccataacagtcttccctagtttttcattcagtaccagaacacctaatgtgtcctcaaatactcctactgtaatgagtgtgaaatgaacaggaatatggcagcctgtttcagccccttgaacaggttcctcattctcaaaaacagaccccaaaaccctttcaaataaaacacaaggttgacctgctgacaaacatagtactcctgttattcataagatcaaccacctgtggttacataaatccaaagtgtgctaaataacgatttctgtgcactaagtgccacccatgtgatctgtacatgatctgagcacactaaccctccctgggcctttgtgtctgggcctcagttgtgaaatgaggacagcgttcatcagatcagatgatttctaaagtcctttcagctctaaaagtctaatctcaagactcaggttcactgaattaaaccaaaatattgtcttcacagagaagacttaagatcaattcttagagaatttacaaaactaggggaaaaaatttaaaaaaaacaaagatacagtttctcctacagaatgtacagttttgctcaatggtattttttaaagtttatttctttgtcgactgtttatgtttaacccccatgaatcatcagaagatgcattttatctgctggccttacaggtaagaggattagatgatactatctttttctgttcttttctcttaaagcaatatccccatattagagaagaagtttatttattagccacatgcagactttcatggtttgctttttgttctggatgtttgtgtgtgtggaaatacataaaatgacaagaaatgagaaagtacataaaacctgataacagtgtctgaaccccacgcatatctgctatcatactatagactaatattacctgtgtagagccagggcctctcctcataacaaataccctaacttgataaggtggcaaatgaatcaatcgttatgtggtttttattaaataatacacccaaggatgcatgccttgtgctacttggtggtgtgcaaagtaagtcaaacattgtcaaccattgtcaatgtaatttttatagatctcagttttatagatggtaatttagagctgcagaaggttaaagctcttgtgtaacttggagccagatagcccaagagttttctttacctttttaaggcataaaagaagtaggactcagattgaattcctctccacatctcacttataagagaaacatcctttatttgtccaacatggagactgagcagcatggagaatgggctgttctccagtttgaaatagtgattttcccaagtaccaacctagttcatatcctcaaatgatgtggagaacctcttggtttccacccttggtttccacctttgtaggtccccttagaacttccaagtggaggtgcatgtctcctccccttgccttatccctgctggcttcagctttccctaagcagcctcaaggaagtcgccggctgtttgggagttaaggggagcaggcctggatatcccctgggtgtggcatatttccaggacagaaagctgcaaaaggaaagaacagtgtgggaaagaaatgcccacttgaatgagatcaggatgttctgagccctgtcctggtgccgcctggggctgcagtttggcagtgccaggagacactcattgccctcggcggctctgggagcaccttggaaggcggcaccctcccccgggggagcacacacaagctgctgcaggcaaagaatggccacccaggggcagttctcagaggaaggaaggttcctttgaggagtggacagcaagacattctcaccctgggactcaagagaagtggagcttttttcccccctctttcccaaaatgcaaatagcctctgtccttggaataaggaagatgggttgctaggcaatcacttctaaacaagcactccccctgcccctttttcctgacccctagaacaatggagacttttcagcaaatggaaccaagatggaggaaaagatgtggcaaaaacagaaatggaatcagagattacagaagttctgattcatagagtattggaagaaaaatgtaatattaataggttttgctctaggcagactaaagggggtctcacttttgccatcacattggcgttatttgtcatcacaagtcaagttgcacaggcagtgcagcagccgctgtcctgtgctgatcccacttgcaatgacttgggtgaccttaaggatgtgacgttattaccagtgaactaagagttcttaggtctcagtctgtttatcagtgcaacaatattaatagttggaattatcatattttcaaaataatctttttagcaattcccacatttcgttagattctgcctgtcagggtcttggtaggaaatatgtgtgatattcacacaaattgtgtgaattgtattcacacaatacaatacaatacaatatgtattgtaagtgtgaatacaatagaaacagatttgaattaaagggctattgacaaaggtgtagatacgttttagggaaacacaaaggatagcataggtccctatgcccccttggtctgaagggacaaggggaaggagtggttatctagcccaggaagggtagatacctgagagggctgcctgacaagagctctgccttttggtagaaggacatagctagcctatgatgactccacacctaaattctgtcctcaaaacagtgggaagccaggggtcaaggggacagtccaaatgtatgagtcagcttagctgccgttaacaatatgccataagctgggaggcttaaaccacagaaatttattttctcacacccctggaggctagaagtctgagaccagagtgccagcatggttgggttctggtgagggctctcttcttggcttgcagacggccaccttcttgctgtgtccctgtgtggcagagagagctctgttgtctcttcctcttttataaggacacaaagttctatgggattagggctctacttacgggtgcctttaacttttattacctccttaaaagccctgcttgcaatgcagttgcatgaggagtgagggcttcaacataggaatttggcggggacataatttagttcacagcaccaagtaacaatttagagtcgacactgaattaccgtagtgctagaggcctaagagaatcagaatatctccctgggaaacttaccacaagattttaaagtatccattaatgcaagacctaatattattcttacttcttggtagagccaactaaaacactgtgagatcaggtaacttttccagagaatgagcatgaagggcaggtgctggccagcttgctctgtttgacagaggtagcaaggccctgatcccacaaaaaaaaaactataaacacaactagagaactctgttagcaatcagcagggtttctttgacttttgtccattgtaaatgttttcatggtggaagcagtgttattaaaaatattcttgaaatttgaagaggaaaattagatcatctataaatccatatgattgaatatttactgatttatttgtttttacacactattctcttgcttcctgtgtgtatatgtagatatagacatagatatacacatacacatacacttgattcttattattcacagtggttattttctataaagtcactacattgaattagctgaattagctgcattagcaaatactgaatcactgctccaaggggaaatataggaataggctcctgtaaaccctggtcacaacatcttcattagctgatcaatacataaccttgttttatgtacgtttctgtttaaatacatcttatttagtatgtattgttgattcatttacattgaactcagggccaacagcctgaacataactcacatctgaataaagtgtatctaatacacatattttctccataaggcacagcacagacttcttgctcttaggaacacgagacagaactttagtgctaagtttggggaccattttaaatagcaaaatcaccaataacaagcacaaaaatgcaaaaaaacatggttctaaatagcataaaggatgcatccttgcagtatgggagctgaaacaagaaggtagaatgtctccttgttcaaccttcactggaaatgtgcatatcagacaactcaaatatttttgctgctctgtgcatggttgtgaatgactgtggaagaaccttgagtgttggttttgatattacaagtacattttacagtgtaggacaatttgcaaatacagaattcgtggataatgagaatcaactgcacatataccatatatacacccatgcacacacacattagttgtacaggcatacctcattgtattgtgcttcactttattgcactatgcaaatattgtgtatttttacaaattgaaggtttgtggcaaccaggtatcaagaaagcctatcagtgccatttttccaactgcatgggctcacttcatgtctctgtgtcacattttggtaactcatgcaaaatctcaaacttttgcttattataagatctgttccagtgatttatattcagtggtttttaatgttactattgtacttgttttgtggtgccacaaactatatccatgtaagacagtgaacttaataattgtgtgtgtattctgactgctctaccaactggatatttgccatctctctccctttccctgggcctctctattccctgatacataccaatattgaaatttggacaattaataaccctacacaaacctccaagttttcaagtgaaaggaggagtcacacatatctcactttaaatcaaaagctaaaaaagattaaacttagtaaggaaggcatgtcgaaagccatggtaggtgaaaagcgaggcctcttgtgacaggttgccaagttgtgaatgcaaagaataagtccttgaaggaaattaaagtgctgctccagtgaacacatgaatgacaagaaagcaaaacagccttcttgctgatagggagaaagcttcagtggtctagatagaagatcgaaacagtcacaacattcccttaaaccaaagccaaatttagaaaaaggctctaactctattcaattctgtgaaggctgagagaggagagaaagctgcagaagaaaagttggaagctagcagtgattggtttctaaggcttaaggaaagaagccatctccataatataaaagtgcaaggtgaagcaataagtgctgatggagaagctacggcaagttacccagaagctctagctaagatcattcatgaaggtggctgcactaaacaacagattttcaatgtagacaaaacagccttctattgaaagaggatgccatctgggctatgaaaatagctagagaggagaagtcagtgcctggcttcaaagcttcacagtgtcccgtcagctgactctcttgttaggggctaatgcagctggtgactttaagttgaagtcaatgtttatttaccattccaaaaatactagggcctttaagcattatgctaaatctactctgcccatgctctataaatggaacaacaaagcctggatgacagcacatctgtttacaccatggttaactgaatattttaagcctgctattgcaacatgctgcctggaaaaaaagattcctttcaaaatgttactgcttattgacaaagcacctggttacccaacagcaatgatgggatgtacaaggagattcatgttattttcatgcctgctaacacaacatccattctgtagcccatggatcaaggaggcattttgactttcaagtcttatgatttaagaattgtaaggtaatagctgccatagagagtgattcttctgatggctctgggcaaagtcaatggagaaccttctggaacatattccccattctagaagccattaagaacattcatgatttgtaggaagaggtcagactatcagtattaacaggcatttggaagaagttgatttcaacccttgtagatgactttgagggagggattcaagacttcagtggaagaactcactgcagaagtggtggaaatagcaagggaactagaattagaagtggagcctggagatgtgactgaattgtttcaatctcatgacaaaacttgaacatatgaggagctgcttctcatgaatgaacaaataaagtggttttttgagctggaatctattcctggtgaaggtgttgtaaacattgttgaaattacaaccacgaatttggaatatgatataaattgggttgataaagcagcagcagagtttgagagaatgactccaattttgaaagaagttctgtggataaaataccatcaaacagcattacatattacagagaaatcttttgtgaaaggaagagtcaatccatgcaataaatttcactgttgtattattttaagaaattttaagaaattgccacagccaccccaacctttaacaaccacctgaccaatcaggagctgtcaccacgaaggcaagaacttccatcagcaaagcaatgatgacttgctacgggttcagatgattgttagcattttttagcaataaagtgttttaaaattaaggtatctacattgtttttatttagctataacgctattgcatacataataaaccacagtatgttgtaaacagaacttgtgtaagcacgggaaaacaaaaaaaattgtgtgaccccatttattgccacatttgctttattgcagtggtatggaacggaccctgcaatatctctgaggcatgtctgtactcatctggatctcacaatttgtgttcattttgtgtgtgtgtgtgcctagtcttttcttctatacatttttcttgttacaatgagtgatgtttatatttttgatggctaaacagtattccatccaattgcattactataattagcctaattgtttcctattgttggacttttagattttttctgtttcttactattttaaatagctgtgcagagagcatgattgtatgtgggactgttttcttcttttgacttacttacttaggataagttcccaatagaggacttgtaggcttgaaaaatatgaacattattatgacttttgagcaatattatattgtcatcccactcttaaaatagttgcacagcattcaccaatacatgaacattactaactactaatccccagtgtctctgttacatccagccttgagaagataatgattaaatgagaaattgtgcaaattcctaaataaaacactgtccctaggtgtgagtctgtattcctttggttattggtgcatgacttctgaccctctgactttctattagttcctctggagccaaggcaggaagtcaacagccaaagaggtccctacccatcatcccatacaaagggcagaggatgagtgtgagaatcacagctgaagcaggcatgccaggttgggcttgggtagcatgtccaaaatggagcgcgtaagctcgtgatgccaaatgtgagcctcaaaataggagtaaatgcataaactggggaaacgaaagtcagggtaggtgcagacttcaagagagcaggtagtgtgaaagaaatcctttgccaagtttttatataaatgtaggcaatgacctcatggcaggacaggtctgtctgaaggggctggaataaacagatggcaaaatcaaccagatttcccaattttggtaactcattcttgctttgtcttatttagattttctgctttttgctttcaacatttaacttttgtttttgttttttgagtcagtctctctctattgcccaggctagagtacagtggtgcaatctcagctaattgaaacttccgcctcctgggttcaagcgattctcctgcctcaggctcccaagtagctgggattacaggcacacaccaccatgcccagccggttttgttttgttttgttgttttttttttatgtttagtagagagtggtttttgccatgttggccaggctggccttgaactcctgacctcaagtggtccacccacctcggcttcccaaagtgctgggattacaggtgtgagccaccacacctggcctcaacatttaacttttgaagtcttgatttttttttctcataagtgaataattccttaaagtacatgtatacatatttgtgtatgtagttacttgtgtatatatgattaagcaagtaattattctaatctttttttaattttgtttttggaaacaaaatataatttatttgccctgtattcaaactttataataactgaaagctgatgtgttttttcattgtcttcttaaatcagttgaaaaggtatgatacttacatgttcttgttccccattaagtggaagaattgtatttttaaaaaatagcattttactttggctattatgtccacaggataaaaaggaaggggattttagagggagaaattgtttcaaaatgttttgaatcacttagcagtttaacccttaaaatgatagtttctggggttttattgattatttggaaggtaagtctatgcagacaaatagttaattggcttagccaagaaattagagaattcagtaattcagtggggaagtggggtgtcaagccagctgatcgattagtatcacgtggaagaactaaccaagggatttaatttctgggttttatccattgcctttgttactgcataagcattctgattaatgaaaatgtaaactattttagaatattctgcaagttttagtacttacatgcaatagtatctttcctttttattgggtagaattatattttgcacacccccatggaacgatgtttcagtattgaatgtcagtgttagagatttaggaagaggaacagtttggtggcctttagctagggttgcttttaggaaacccacctatgccacacccacaagggtacatgtcaggctatctgggcagctattaatgactgagaatgagccgaggaggattaagcaggaatttttctcagcaggaggatcttgactctagattattagtggtcctaatgaagaaacagatctatctgctggcctgtgtcactcaggagtctgtggcagcaccagggtcacctgaatcctggtccagaaatctcccctaggaatctatggtcaaaagactccattgtcaaaagaacccattaggtctgaatccatgtggtagctaagtgcctctctcttctatatgccaactacatcatcacaaagatcctcatgctgatctaaggtccatcttatcctctttgtcccaacatcttcatttagctttattttagccccctctcacttcttacttacaaacccaatgcgcaatgacaaaatcacacttttgtacacattccatataatataaaaatgtaggggaactaacacttatccagtatgtgggatgacaactgtttgacgttcacctgaccgtatcttttaaacagataaatgtgtatgctttgatttaaaaataatttcaaagatatgatatatcccaagataatctacattccacaaagacgagtagacaaaatgtaatgatgtttatcaaaggggatggaaaatatgtatgtattcagcagattatatagatttttctttcttagagcagtggtggattttttttttctcctgcctaatttataccccatgtgacttttgttgggcaaatcaaatatagggaagtgggaaaggatacttaatattctgacccttctgaaataggtcttggtaatgagatcgttttgctgatgcatgagctgaggaaaaacggccccttcagcatcctcggttctagtcttaaaaattactactacttgctctttaacagcgtctgataccaaattgctgttctttaagttcataatcagttctgtccccatggttccctgaaaactaaatgaccccaaggtgaaattgacagaggaagcataaggtgaggcatacaaccacttaggcacaggctctgtcctgtggtcagcaccaacagattctaagacaaaaccacagagcacctcttgttcttggaaatcatcttgaaggacagcagtcaaggcttccactggggccttcctctttgggaattcaggccttcacaattattttaattccttgtctgactataaacaactgtctttgaacccttgggctgcttctactaatggaaactaaggttgattaaatttttatttccctaggaccacttagaaaataagtacaaatcatttgaagatctcagtgatcaaaagtgctcttcaattctaaatctgggatagtgtaaaaagagacctgagctgtgggagccttgatcccactgggtatttgtaggatcattccccataaaaattcagatttccactgtcaggtacaaaaaactagttattttaacatccctactgcccctccgcccccacacacaaattacatgatttgaatggagggacgcgatagctttcattttaaatgtgaaggtccattgtgaaggaaagaaatagtcttacttaagtagaaactgtaggtgagcagatttgaactctagggtcacaccctgtctgacaattatggtggaagacatgggacagtgggtcttggagctggggctctagagttagccaaacacatacatttcagtttcagtttcctcctactgacttgaagagcttagaaatgttgactcttctttcgagcctcagtttcatcatatccaaaatagtaatgacaaaattacctatcttggggttgctgtgaggattaaatgagatacttcagtgatgattagcctttatattccagggcagtggttttcaaactctggcctgagtaagagtcgcctggaggcccccttaaaacagatttcagggccgggcatgttggctcatacctgtaatcccagcagtttgggagactcagatgggcagattacctgaggtcaggagttcgagggcagcctggccaacatgataaaactccatctctactgaaaatacaaaaattagcctggcatagtggtgcacgcctgtagtcccagctacttggtggctgaggcatgagaatcgcttgaacccgggaggcggaggttgtagttagctgagatcacaccattgcactccagcctgggcgacagagcgagactatatctcaaacaaacaaacaaacaaacaaacaaaaaacaaaaaaaagatttctaggttctgccacagtttctgattcagtaggcttagggtggaggtggaaccctagaattcacaagtctctcgaatcctcagatcaagccaatatggctggcctggggaccacaggctaagaagctgagaaccaccactatatgatacagcaaaaatagtttagagcaagttctcagattttaaaaaattaaccacagttcgttaagaagtagtttgtgtataaactagaaagacttgctattgggagtacagagccgtaggttcgtgtcttatctttgccgctaatgtactgtgttgccaaagaaaaacctctccacatctctatttcatatttttgttgtcttcatcctgtatcttcagcaggttgttgtggagatcaaatgaaagaaatgtgttacaaaactttaagcagtattaacatataaaacagtgaaactgtggagttgttgctattattatagactatgagtgtgactttaccttcctgtcatagaaatgcctttgattaagctacagatacaagactgtgtcttcttaggaaaaggagattttaaaaatcacatatctgtcccagcaagggtgtttgcagaaacagccaaatcttttgtaataaatcatttttatttagataaatcaggcagataggaaatagctagtcagatattaaccaagctcttgacatgatttttgcgtccttttctatgagtgattcaaaatgaagttgctctttctgaaaaccctataatttgtatctcaatttgaaggaggtatgatcagctggcctatgtggttgatgtgactaacatttattgagccttactaagggcaaactcctctgggcacgttataggggctactgataatatctacccaaaagttccactgtcaaggaaaaaagctctgtttatactttcacaccatcaatacatgctgaaagccaggatttgaacttgcttaatattcacagtacagcctaaaggtctgttaatcgctggtagcctgatctttcagctatgcaactgacctattaagagtgatatctacccactgattaatctttgtgctcattgttggtataaatacggaaaatgttattgtgatagctttctgaagattgaaatctactctctttgaattggttaggcataatttgagataaagttcaagattttaagatgcaagattcattgcatggaagtaatgttcttgtcagcctctgaatgggtaaagggaacttacattaatacagccaacattgattaaggctccgtgttaagacaagtaagacacaccttcaaggatcacacagtttaattaagaagtaggactgttaggtgttcctctgttcacaggtgaatcgtaaaaccagaaaggatgggaaagaggaggaaatgaggagagggtgtgggaaggggcaaggaacactaagaagagctgctccaggactctttgaatttctaatgagcatattcctgcagctggagctttaattacacatagatgccctctgtgttctttgtagaacaacctctcagagtttgaacagtggttgctgtctgaaggcatgggcaggttaaattacaattattatctgactactacttgaagcccagagatgactaccctttcacaaacagcccccaaaccgtgtgatgttgtgacattttcaacactcccgctgccccccgacccctgctccatattcagactgtctgatagtaattctctagagcagcattccccaacttttttggcacaaaggaccagttttgtggaaaacaatttttccatggacaggggttgtgaggatgtttttgggatgaaactgttccacttcaggtcatcatcattagctagattctcataaggagtacacaacctagatccctcacatgcacagttcacagtagggtttgtgcttttatgagaatctaatgccaccactgatctgataggaggcggaccccaggcagtaatgctctcttgcctgtcactcacctcctgctgtgtggcccagttcctaacaggacagggaccagtaccagtccatggcctgggagttggggatccctgctctagagggattgctccagtcacaactgaaactttttttgccaccttacaatattgaaaagtgtcatggttgtttatgcatctcatttgttgacagacttgtttcctttagatatagtgaacctgatgaattactggagagaatggacaagaaaggtctagagagaatgtaagggagacagagcaggagacagaaggtggcctttgcccataattggggaacccaccattacattcactgtgtttaagtccagaaaggtaattataatttaactgttccactcaagacgttctaacatacatctagaaaacatgcaaaagtatcctttagattagaacagatggtcttgtaattgggttttgaaacacaggtgatttcacgaggaaatgtgaagtccattagccggggctgtttctgatgaagctgagggagggtagaaaatcacacctgctcctataaatgggatcatatatttgataccttttgatttgaaaaaacaagcatttaagacccaggttgacccaatttcacatgtcagggtgaaaagaatttgttaagaagttcagccctgtagcctaataccactctgaaagaacattcttgaagttttatgttaattgagcaccattagctgtgcactcattaatttctggtcaagaattggtttgctgaatgaagaagtgatctagtgagtacatttgaatgactcatgttcatagattttgatatagttttataaaaataaaaggatagggaacacatccccatttttttaagttaggaaaatgcaaacagtattctttagtccatgcacaaaggggatcactggtccttgagaaaatcagagaataaatattttcttccctctattacttaaaacttcatcccttacttttccttttctttatatttccctcctagctttacgaaaaatttaaagtttgatgattcatttttgaggaatcaaatggtagtgaagcattaagaatgaaaaatcagtgacaccaagttgaacagtttaaaaattatttttcttagcagaagcattaactaagcaatggtaaacatgaggagaattaactgctttcaattttctctttaaatagtattttcttgattgttttatttactaccactaaattatacttaggatgcagaaaatacccttctaacttattttcacaaaaagaattttaatggtagaacttctgaacttttattgtattttccttataatgttgccctacatgtaactaatgatgttaactaatattattaattagtgatatatatatttgcctgttcttcaatgttgtaaatttcttattcaactccttaaatactgcagttacttccttaaaatctttactgttgtatttattacccatcaatcaacaagtgcttacttagcccccatggggctctgcaggggacacagatttgcaccaatagatatagttccaccctaggagcacttttaatctggtttaaatgctagacacccttgtgggttggtagtttcagtagagtgccacaaagaagcttgagctacatcttgaaggatatttggagcttgtgagatctagaagacatgtgagtacagttcaccagaaaatgcagccacgccaaccagaggcagaggagggccatagataggctgccatggctggagggagagagagagcaaggaattacttggtgagagaggaccctggaaggtgtgaagtccttgaatgtttttctagggaattaaggtgatctcatgtaaacccaaggttcttaaggggtggatcagagagtgtgaatcaggatcaccctgggaacttaatctataaatttcatctctttcacacaaacacacacacactcacactcacttacacactcattcatacactcattcacatcttcccaaagagtgagacaattctcccatcatgtttgagaaccactgcattagagaatcatagaaaactttgtgatgggaccctgatgcggcgagggaaatcagctctacagctgtgtgcacacttacagggccaacatgaagtcctaatgagcctgagccctttgaatggggaacctaggttatcatgagggtgaaaccaatttatttagatcaagtgatggcaggcgatgccaggccacttgcctgtgctacaggaaggaccttggaaggcaggcagcccacaaagtcagccagcgctgctgggcaactgcacaacaggcaggttggccttagaggcactatcactgtgccaacccacaggccaaaacaccaaggagctgaggctaccaggagtggcttatctgactacatcaaatggcataaggtgacagatatttttgatacaagctgggactctggctttaaatctgatagttggatctgcacaaaattatgctatccttggagctggaagagaaacaacctcatcttccaaatgcaaatatcccgaatcagagaacacaggttactcagccaaagctcctcagctactgagcagcaaatcaccaaacctcaagaaaaggcttgtaggactaaagtagtacaattcaaacttttaccactggacctgcacagctcacaccaccccaccccacaaactactattttgtttcttggttacatgccttttgtttgaggcactaaatacttctctgaaaattatctctttatattctcagttgtcaccacttcaaaattatgttctttgcttcttaaaatcatccgttcttcatttattcttccatatatttatatatttattaactagatatttatggaatgtctattttgttccaggtattatacttccatccttatctggtcccgtaatatatgtgagaggatacctcaaaataataagccattgaaaatgccattcatttcttgacattgccccagtattggcaattaaatgactacatatataagtcataaccaattgcataatttctaaaactgcaattgatcccacttttttcaagaactgctgaacagcatatataatttcagacccaccctgaaagtcatgcagagtttttgacctgcagtttagaagtaatctggctcaattttctcattttccaaaagccgcagagcagaaccaggctataagccttccgactccttgtccagtgttttttctacctcatcaagccattgctttgaaaatgtcttttttttgtagtcttctttaaaagtaaaaccacttttctttctgaataatgtgtcctcactttcaaaaaacgtctttgaaggcaaatttatttaatctcctgagagttttttcaaacccaggcagtctagtaccttgtacctaaagaacatacaattttagcacataaagttcctaggtgtaaagtgagttggtaataacaagtacaatatcccaacattggtggcatcttttgctgggggttttttgcctttcactccttgctcaggcagcacagacgttatctatgcactgccaggctggtcctgaggattaaattagatgaaatgctttggaaactggaaggagcctagaaatgtaggagcttgctattatctccaatagtctctcaaaggccaggcggatattcatctttgtatcccaggcatctagcagagtttgttcaataaatatttgttgaaatgaaatgaatgaaagatttgtcaaatgtcatgttgagagccagcgcttgggagtcaagcatgtcacagagtctttgtgtcaaaaatgacatcagaggaaaaaaggtgaatgtgacattgttgtgtatcttacttaatacggacaaataaggcttttctctgcactgattgctccatctgaaaaccaattgcctcccattttgtgtggttttgtattcattctcgaagcccaggcactcttttgctctaagggtttcctgacttggatgttaagcgagcttctagccctggcttgtttctgtgttgtcaggcacagataaaggcatggtggaatttgcccattcctttgagtgaaggaaactgtcagaaacattgtggtcagcctttagaaactctcccacgttggttccaaagagaacatttgtgtgtgtgtttgctttggttttgagaactaaacacccctttgacattacgtgcgccagctcctgaacactggggtgtttcagaaatgatgccatgggcacatgacgcaagaagcactgccctgctttagcaacaggaagaaaagagacctgaaggagaggcttaaagaacagaggggaatgaatggaagtgtttcagagaggacaatgctgaggggcaccccacaattagagaggatcacccccacccctcactgtcaattgcatttttgtccttttaaaattattgaagaggatataaaggctccgaatgctgttggcccggcatctttccctgtagcaacatcaaaagtcttgggtcacactgggtaggagcaggctgcctccaagcaacttggccagcaagcatacctggatggattcgtcccttccctgaagcgatttattaggaaagctcacaccttatattgacacatttcctctctttttcaaaggagggataattgtgtttcaaatatgattttctagcagagcaaaaacagtaatttgtttttgccctcagtggcaagattcacattttgatcagagcacattcaatctctaatacattttactgagtacataggtagcatcttgttaacgagacaaggacatagcggacacgttgcttccctccgtatttctgtgctgggcaccccgtggatgtggcgatatgaacattagttatgcagatgaagtctctcagtgccaggccctgaatcctctcagccaggtattatctatgcgagtttatctgtccagtggcacattagcagggtgcatcccctggtcggttctcaaccgtggaagctctccatctccaaccacatcatcccccaaaccatttttctccctctcccttccctttgagcccttcttctttggaaattcaccagtggaatttttctccccacatctctatggtgagttttcccagctttggaaggctcagttgccatggtagcgagcctcctccgcctggagctgagctggtgatttcggaagaagggattgtggtggtaggagggaggggaagaaaagtcattaaagtcggccaattagtatgcagggccagtgcccccttgcagttcctctcacacgaggaacagccagggctctttagatccctgctggtcgagatgcaatgaagcaaagggaggggagacctcccagccgtgcacctgtctgaaggtacctgtctggaggaggccttccatggcctcagtccagggaggagccaagtcctgctgccaccccacaaccagtgcctcctcctcctctgacctcctgtcttttgcctccctccattttgaaaacagagcttcatggagagaccccagtgagggaggtgctggaatgtggaccagtggtaaaatctacccttcaaggtctcatatatttcattatttttctagttggtggatggttgttcaaccacagttgaaatgaaggacaaatataaaatgtgtcccaggatattggtggctgcttgatacctgggggtatcaagttggctgggggtagccaacttggatgatattgaacagaagaaagtgaccacactttcataggcagatgtgactacttacatggcccaatggaatctgttctccccagaaaatctgtctggaagggagagtattgatgagtctgcctctatctgagcatattttctcctgccactgccagaggttggatgttctcgggggctactccactagagtgttcctggtccccagcccccttgtagcctctgataccagtgctcactgctgaaggtaaattattataatctgtttctttttccctgaattatttgtccagatcctgtggatttgaaggtttcctcccgggttccacactgtgcccattgtctggcaccgtgcctggcaaagaacagaacctaataaatatttaccatctacactgcctctctctttccactccctgcccagcccactctgatttgacttctgcctcattgctgcatcaaagttatgcttagtctaatctgatttaagtctgtagtcaagttaattgcaagggtccaatgtcaatttcctgtgctccatttatgcagatgtgatgtgctatcactatgcttatatatgttaccattgagggaagctgggtgatgagaacaggggacctctgtggactctcctggcaactactgtgagtctgttattagttcaaagtaaagagttaagaaaaaaaaaatatataaatatatttaatgtattatatatatatataacggttctcactaaacccttagtgaaacctctctggaaatcaagccaataggcatttccagtcctcatcttatttgacaattggtatccactccctgtttctttaaatgttcttttcttggctcccttgataccacaccaccttgttggcccttgtgtattataggcactgtttcttagtctccttcacagggaaaggctcaatcactaactgttggaatttctcaaggccccttcccagtctcactcctcttcccaaagccatttcctctattctccaggcgtcagtgaccactgcaaagatgactcacaaatgcacacctctggtccagtcattctcacttgctcaggtttcactttggagactgcagagctccctttatctcaacacaggcagctcctctcccaatagcctctttcctagctcccatcaccagcatgccctagcctactcaagtgcttcctatctcagtgaatgaccatcatctgccaagttctgtaagaaactatattctctctgtactcttgctaccagcatcctactctgagccatcaaactttctgggcagcagtatcagcctggccactgctcccactgcaatccctactctgcacagcagccagagtgtcctttgtagagtgcaaatctggccatgccattctcagcataaaatcttctatgttttctcattgcttttagggaaaaaagtgaaatcctttctctggcctgcgacatcctgcatgtcctggttcacatatgacccctcagcttcatcccttgtgaatctcccattgtttacagcactctagctatactggacttcttcaagctcctcaaacacactttgcacctctcctgtcgcaggacctttgcacatgctgcactctctacatctagatgatttttcctcctcccttcacctggtgaattcttgcttattcttcaggtcttgcttgaatgttacccccacaagaaaccttatatcaggcttccagcccaaagcaaattctttcattttaagcctttgtgcaaaccaatatttagccagaacactggttacaaaaactgaagtatttttatacaagttttaaagtagccaccaccctgaatccacatcctttagccactaaagggttacttccaagcgcaacatggagactttcacccaccaagaactatgtaggttcagattagtcagtgcctgttaagtattttgaatatttcttctaattctaaacacaatcttttctaccacatttattacatgtgtaattttagagctatgttgagattatttgattaataactcccctactgtaagttatatgaggttgagggccatgctcactatcatattccccatatctaatgcaaagcagacacccaacaaaaatgttcaataaatgaatgatttaagtgaatgaacagacttttcccagataacatctaatttgatccctgaatcccataaaaacgaaagtgcaagctacacggagcacaggtaacagtagtggctgatcccagaggatggtttggaggcaggttccccaggcagtgccttttctgctctcccaccttgtccccttcctgaagacttgcagaagacactctttattgttaccactcccagatcactgcagcgcttccagactctttagcatctcatatcctccatcctgtcaccatgacccagttttagactttggaattcaagcattgctgacagaatccgtgtgtggcttttttccccctgttctctaaataaaagatgaaatcagaatggtcatgtatttgctgtctcaaaatagtgctttatttagagagagaaggtgttagttattactggcatttaacatttgttgagtgaacaaaatctgctgaacattgaagagaacatggaattaaagagttcctgcccaatgtgtgttgtggcctaaattagacccagacaagtcactaatgtgcagaaaggatggatctgcagagtgccccattgcaatgcataaaacatgctccaactgaggagggaacatttttttcctaagaagagggaatattgtggtcaggacttagaggtaaaccttagaccattttaaaaagagcaaagagaactaaaaattccatgtgagtccttagaaacagaaaacccttgggaaaagtaaatgttctccccttctgcaagggccttccctaagagaaatgcagtccctaggttcctactgagacatatccagtcctgggtctactgccagcatgtgctgtagaaagccctgttggcttcagaaggtgtcacactgtagaggaccgcacttccaagagtgactacatactgttttgcttttttttttcccccagaacagttacagtgttggtagaatttaagggaaaaaacactttttatcccttggtggggtttttttggtttgttttttgtttgtttgtttgttttttggcatggagtggaatgcaagtctcactttgcccaatgagaccctacaaaatcccagttgcccaaatgaataacacatatgacttctgtcagttttgaactgaatccaaaacagggtgataatgtctgcacattggagttgattctggcctgggggatgagaggctgtgccgctgggtctgccacacacttgggcaagtcttttatcctttctgggccctagttactgtacctgagaattggacatcagaatgcctagcttgctgggttgttgcaagcactaaatatactacatatataaagaactagcaaatggcatggaatatgtgttggttgtgtttctagcactaaggacataccacctttatctagacaactaaacagaaactcgaggtcaggtccaaatttaggctaacaattccagatgcttaaagtttttaattcaatagatgacattcacttgtctaaaggtaattaaccattaatagaggacaagaaacatatggattcttgagaacctcagctaagtcaacagtctctagcctttccaagtattgcaatcctgggaaaataaaggaaacagatctctaaaaggaaaatatctgattggctacaagtcttaagtgtgacaagatgcttaaaattgacttaacaaagagcactttttatattgtgaagtgatcatcatactctttcaatttgaacattattgtgaacatatgaggctgctgtacacaggtcataaaaatgtcagaagagtgaatagatttagcatgaaatattaacctcgggaaaaagcctctctaaagatgtaacccccttcccattaatgtgtgtgattaagcactctgaaatttattagtgcagcatgaaagacgttgctatgataagacttggcagtgacctccattattggttcttactcagccaagtttacaaaaggaaactttaaggcatttcatcagagggaagcactagagtgagatagcaattctgccccaggtgactgtacgccgtgggcagagcacagatgccagtggcaagtcacttaaagctcagctttgtggacttaaagtggaacttcttccttctatcgctatctcctgacatcacacacgtggaggagaaagaccctttgtcagggccttggagtctgcccacactgtgtgaatcttgggagaagacatgagctggttccaggagataccagtgatgcagttgctggggtagcgagccctgcattcagagtcagagtgagtactctattctaggtctgcaaccaagaagctgctggccttgggaaggtctttaagtgccaagtctgccatctatatcataatattgtatacagaggagatgaaaagaaagaatagagaagagatatagaaagaggtagagagagacacaggctacagcttgtcccctacttcaggtatgtgccaaacatcatggcaggtgccctgcaagcaggcttagctagattttctagtgcctccaataactaacttacttcctttctgtggctgtttcatggctgtttcagtgcagtatgtgcactgtggctgtttcaatgcagtacggcccgtatgcagagtcacctggggctttgttcacattcaactgggtgataagcagcatgtgtctgcacccctgtttccacctcgctgtggaggcaaagcatgcataccttttacagtccttgtaaagccagtgtctatcagctcctgagttgctgttgatttcatagtgtaggatttatagggaagagctggtagccagacaggtaggtatagggttgggcaggagctgggatttagacctgggcaggtgcagctagcggtaggggactggcccggggcaaagctggtctctgagactgaaaaccatctccattccaggatgggggtcaagaagaagttaagtgccccttgaagtggatgggcccagaaatgaggagtcttatgcacagatgaattggctttaaggaatctgtccctaaggacaggcacccaggctctgagcttatgtttagacactcagacccaggtatcttaggaagtctagaggactagtaaggttactgacacagtaacagaatggagatctagtcaaatccctgtaccagaaaagggactatttggaggaattccagagctacgagtgttgagctgtgagataggggtacttgtgggtcagctcccctggggcaagtgaacaaaaagagtgatttcaggcataaagtgggagctgagtggtcagcagagggcaccaagtcagcctgccatggaggctgatgatgtgcacagcagagcaaatttggaaaggaagtgggctaagctgcagctgcttaagtaatgctgggtctgggaaaacctgggtggggctggggggtgttcagccatggtggaatggcagaaggaagagatatggagtcttgtggcttaaccccctcgctgtggcagatgccacctctccctccactgcctcagagcctcttggctctgcctgactttgagaccattggtcattttgctatgctccagcccctgctgtgataaccggctctctgtggggtcccatctgactgcacagcatcttgcctgccttacatacctctcacctcttggcctggtgcctccttgttgatgctgagatacgaagctcagacagactcctctgaagcctgtacatgctcagcttggaagtgttgggatctttaagcagtgggaggcagaagcctgaaaataaatgatcccctattcttcccatcaaacaggctttcctgagaacccagtgttttccaggcacaagcaagcagtcaatcacatggataccaaagagtggctagtgtagtagctcctgcttttgctcttgccccacttcaaggggcacttagcttcttcttgacccccaacctggactggagatggttttcagtctcagagaccagctttgcccctgggccagtcccctaccactagctgcaccggcccaggtctaaatcccaagtcctgcccaaccctacacccacctgtctggctaccagctcttctctataaatccagcactatgaaatcaacagcaactcaggagctgatagacaccttgtccttaggcggctttacaacgactgtaaaaggcatacatgctttgcctccacggccaaggggaaagaggggtgcagacacgtgctgcttatcacccagttgaatcctcccctgtctcactctccttatccctcatgcttgcatctctggcattgcactctttgggaaactagtaggagatacaccttggcctctggctctgcttcacggagaaactcgcccacccacctgccaacattattatgtcttataatttgattccattaaggaaagagaagaaatttgatactggaaggacctcatttacacatgatacagtgtcacccatgacacagttctgcagtccaggctcagatgatgtcattctagtgaagtaccaatgtgtgaaaggttgtcccaaatggactcttctctgcagttgaggttgtcagcctcttctttggaatcccccatgcagccttcttttctctcagctaaagaggctcttctctgttgacttctgactttgaggttcttggtgcatcttctgcacactctttagtgcctcctggagcccctgtctttggcctgcataagagaacccaggcacttatgtcacttatgtatatgcataggaggatgaggttaaacaccaagcccgctcattaagtccatttgagcgtctgttttatccctctcccactgaacgtacttttggtggccccaaattagagttttctcttttacaattgcctgggctccttgaagcttgtgataacatgcataagatgctcagagtcctcaattgtgactccttcccatcagtaagttataaagcctctctctttttgtattgtctgttaagtctttaaaagagaactcttgtgatgaaaattgtattctaatgtctttagctatggtactaccagcatattgggccattagggcacaaattattataattaaagatatttcacactaatatttaattcttgctcatttgaatgtattttagctgagtactattgctatactgatacactggacagccttgtaatcctctttggcaagtttagctcttgagttctcaaaatcaaaactagaaaaagtctgagtttttaaaataagatttaaaaaatcctatgtggaagagaatagtgtgtatatttcatggtaaaactgaatttcatcttggtgagaatgatcctgccctaaattcgctttcctaagccctccttgtgtgtccattgccaagactcctgcacagcacagcttcctgttgagagtggacttccagccacactgactcccaccctggggaagggtaggtggacctccccatgccagcttccaccccactgtttcctgtaggtttcctccaagccacactttcatgtcctctgctcaggttcgcagtttctacagaacagcctccccagcccagcaaatgatggcgaaagcacagcgaggagaggacagggctggctacctcccttcctgaatttttaaatggcacgaatggaagctgtcttgcattctaagagaggaacccgagacacagcctcgggtcacatcccacgtcctcattgcagcacatcttaaaaacagtttcagagcaattttaggtttatagcaaagtggaacagaaagtggagttcacatataccccctgcccctcacatgtacagcctcccccactgttaacatcctgcaccagagcggtgcatttgttacagtcagtgaacctgcactgacacatcattatcacccagagtccatagcttacattaaggttcactcttgatgtgctttctatgggttttgacaaacgtataatgacatgtatccagcattgtagtattacacagaatagtttcactgccctaaaaatcctccgtgtgtctcctattcatccttccctatcccctagccactggaaaccactgatctttttttactgtctccgtcgttctggcttttccagaatgtcatgcaattggaatcatacttgattccaactatatgacattatgtagccttttcaggttggcttctttttacttaataataggcatttaaagtacctccatgtcttttcatggcttaataactcatatctttttagttctaaataatattatattgtatagatgtactgcagtttatccattcgcctactgaaggacatcttagctgcttccgaattttggcaattatgaataaagcgggtgtagacattcatgtgcaggtttctgtggacataagttttcaattccttttgggtaaataccatggagcatgactactgggtcatatggtaagagaatgtttagctttgtaagacactgccaaattgtcttccaaaatggctgtatcattttgcattccaaccagtaataaatgagagttcctgttgctccacatcctcatcaacatttgatgttgtcagtgttctggattttagccattctaataggcgtgataggtgtgtagtggtacacattacagcattttgggggccagtatggtcaccacttaatcgcatctcaggtagattccaagactttcagttcacttttagttatgaaacaattgagtctagtttaaaactttattcttacatcagattcaaagcttccccatctggtgtcacagcctggaattctcccctctccctcttctggtgctagttcttcctgtttggttagggcctggaggagggactgaggatggagaatatacatctggttacttctcagttgtcattctcttttctgttgtcactatttctccatgggtcacccttgggcagccagagtacagacaaaaaggctaaaagtagacattttccacagtgcccacttattcttgaaagactcacatgtctttgccttttcagatgatgggcaagcgatctctgccactggtcctctcagctccaccatctttgtccgtccctttgtgcttcctttgcagtacacacaagcctgttgtctaaacagaagctcaaatgcacaatgaggtcccagcaccccttcttacagcatccccaatctttatgaggaattctcttgaagcccttatttggtttcaggttggggatggggtagcagagagagggagaaaggatgagagttaattacctgtcttctggaacattctatcaaaagaccaatggctccatatctcttgctcactcctgctcccagttctttccccacacagactgagagaggagaaggatctaaggtagtgggccattatagggcccgtgccataattggggcagaagttggatccagctgtgagatgctgcgctggcccctgactgacacagagccttctctagaacaggtagtaaacacaactcctttttcctcacctgaaggccagaatttctgaatagggcagggaggggacaattgaaaacgcccccctagtatcctattatggagcatcagaggtatgcggggaaggggacttcacagctgtcctcatctgaatattcaaacagttaatgacctaatggccattcatgacagaaaatctgattgcagcaaacaggaaatctccctgctaatactcacccctgcctgttcttgaccttaccttggttactggtagtcaggcactattccccttgcagtactgcctcattacttggaaggtggtttttagccacacctttgcctgcttccctccagttaagcacaagcttaccccctactgccctgggtgatagaaatgcaaagcaagcctgttgacaatttctgaagaccccaagaggatgactatcagaatgaggccagttctaactgactgagttttcattagtgaagatcatgaaatgcctggcccatgaaggctcgaggtttgcatctggtgtgagctcacatgcgtggatgcagaagcttcccaggtgctgtgggtgtctcttggcggcattttactttataatgctcagtttgggttcctcttctgctgaacctaattttttcactccaggggtaaccactttttccactttcaaataatggtgcaacttcagtgatttaatttagagaggtgatgaagtgaccgttcaagtgttcagcaaatggataaaagcctttcacaaattcctcaaaaataaacactctcatcttctgaaaggtttactaaatacacactgtaaagaactagccatcagcatatatacttcttgttattcgatggttgcagtattatgttttattcaagtttggttacatggatatggaaaggtaaagtctgacccctgaagcaaagaggatggtcattctgcaagtagggcagggacagcaggaacagagaagaatctcaccatgtcttgaccatgaaggtctcaagatgtctaggaatgcatttctgggggtggatagggttgtctacaaatggtgcccccaacatcaggccaggtcaggccaggctaggaggtgaggggctccagtaggtggcctgctgagttggagaaacagttgggggacggagctgagtgagcttggtgaatcagccccgagagagcctactagaaggctggactctgtgcaacacaatatttctctttattgtgtccttagtgtttattgtcctatggttttcctttagagtttagcaaagccattcagctcaccttgagctgtgctaaggtgaaacatgaaaagcttcatttgtgagatcattaaaaagggatgcagtgcattcctggaggccagcatggaggaagcagtcataattaaagtgagacaaaaacaaatgggaggagaaaaagtgtggagggtgaaaatttcactccttcatctatttcaacaactgtttataccgctgctcagcactatactgagtactagagctacagcagcaaacaagaccatgaaagcttgttctagtggagggacacagaaaagacaagcaacataatacaaataataattgtagctagttctaagtgcaataaagaaggaagggaaagagagccaacgtggctttcagtgtgccccgtgtggtaggcaagggggagagatgtcggtggggaggagagggagctgagctgcacctgtgtcaggtaggaactgaggggtcctgctaaaatgtttggattttgttccgagtacagtggaagatgctgatgaattgtaagcaggggagtgatgagatccaatttacattttgaaaagaatcctccagttgctgtatggggaatggattacaggaagcaagagtgaaagcagacatacctgttaggaggctactgtgaggatccgggcaaaagaatgtggcagcttggcctaggtgtcaacagtgaagatggggggaatggggtgcaatcagaatatgttctgcaggtagggctgaaagaacctgatggtggcttggatatggggataagagaaaacaaggaatcaatgatgacttctcgggatttatcttgaacaaaaacaggagtgattggtggtgatggttgtgctatttaaggagaaagaagaaggaaagaaagaaagaaagaaaagaaagagagaaagaaagaaagagagaaagaaagggagaaagagaaagaaaggagagagagagaggaagagggagagagaaaggaagggaggaagggaggaagggagtgaggaaggaaggaaggaagggagggaggaacagggacttttcaaaagggggatgaaatctgaggacatttagtccttgggccagcagaggacagaccatcattggaaagggggaagattgttccaaagtctgatgttcttaagttgaaaataaatcatctctgcttttctctatagtttccagttaatttgcaaccacttgttcattctgtataagccttgccattcttgggagtattcttgtcttcatctccaaagacaaattcagggataaagagaattacaatccccaagtctgtgttcagagagtagatactagtgctggaagacttttatatattttatttaagctatttcaagaaatggattaaagtagatattaaccagttaatagagtatcctaaatgccaatgatctgcacataaatacgtgttttgttataaacgaagtgcgattgtagaggatagagaccttgggagggaattcgcagaaacataatcataggagttgactaagggatttagaggcagaaaggaagatgcacaaaaaaaagaatgccagttgatcatcattaaggacttcagggctatgagatcttctctcttcttcccaggataccataagggcagctttcttcctcaaagacagctcaaattgtttcaggagtcaaagggtgaccgccttagcagtgatgtgatcacataacaggtagaatattggggaaataattaggaaaaacaaggtaatttggagggattctcctacccaggtactgactgagagaagcatgcagagaccatttgcataaatcctaaagctgaagtcccaagggggctatgactaagcatcctagagatttgagctctgagaaacactgaaggagctagtaataataggatccctctgctgctgttttctcttttctagtgaggaactgggaccttgagggactgtgagggacacccacacagtcagacctgctttgtttcctagaacctgttacttcatgcaaaagaaagcgttggttattgatacagtgcaattatgtcattgtcaaattatctgcatcaaagaggaagagactccctcctgaacaagactcagaaaacatggctgatgactgccttagctgacttgcatagctggtcatgccaccaggtggacttggggaagtgatgcaaaatgaaaggcagatgcaaacagaaagagacaaggttagaggattggaaacatccgtcttccatcaccatcttggaccctgattctgactgtggtcttggatttctatgtcttcgtttccctacttagtaaacggtaatgaaactaggccacagactgtgtgtatttgttgtaaaaccccataatattatgtaatgtgccttaaaatattgcctggaagtagcaaattatttcaatatagaggtattgagatataaatatagatgtagatacagatacagatatagacacacaccccagtgcagctgtgcttattatacagaaccctaccaatgataaccctgagtaacactggactgcttgcttttgaaacacatagaagctgttcctggctctgggcttttttgtacctgctgaccccaatacctggaatgtaacctcttcccaatgtttgcatgtcttgttcttttacttcattcaaatctctgcttagctatcacctactcagaaaagccttgactgacctacctttctatctaaaatagaaccacccctctgttctttccagtcccttactctattattttggcacagtatttatcaccacctgaaattattgtgcctagtatttgtttatttacatatgacctttgtatcccactaaaatgagagctccatgaggatatggagcttattcacatccgtgacccctgtgcctacgacaatgcctcacacccaggaggtagctcaatatatttttgctgaataagtgaatgttatcaaaataagcaaatgaattatcaactccatggttaaggaaaaagaaacctatactttttgcaataagtgtttaagaagtctaaaaatactataatagcttttcttcttatctgttgtaatgcaaatagtccattgagagagagggagtttggcaagagggaagtttagcttctcctgacatgagttactgcacagtactctggcccttactatagtggtaggggtgggagtgagctcctacaggaggcagtggcaatgctgggggctggtttggggaagttagacctctttttattaagctctgctggccctcttgggctcccctgccatcatgctaagcatacatgtggccatgccaaggcagcttcaaggtgagccgctcctgcctccaagccagactgccatcctgaggctcctcaccctggggaaattctgttggggtgacaaggaggctgctgtggttggatggcttcatgcagtgaaggtgggatggccaacaggctatactacaggaggagcaaaagaaagacacccctggggacagggcacccagtacttcccttctcactgacttctcccagctccctctcacactgtcctctgctgaggggtcactttggctcattcatctgtgctttcagtggcttttcctggtaacgtattctatatgttcattaccctatgcacaacatatgtctgtttttgttcctaatttacagtttcaacaggacataggtgtccttctctaaagcagatcagctactgtccattttgcctttcccttctggatacccctctgggctccaaggggtatgtgcccgcagccccaccagcacttacaggaagctgcctttttggttttagctgctggttctcctcccatatttatttcatacagtattgcccacctctgagaccattccctagggcaaccacatacaatccattcatttgacaagtatttgttgagcatcccagcactggactgtgctgtctcccatgaagttgtaatctagaggctggaggaaatagcaaacatgtaacctcagcttacagctgactggggctgtgagggaaagggatttaccattatgatctaacaagggaacctgcttttggtgcctaagaacatggtatttaagttaagtcctgttggacaagtagaagttagccaggtaaaaattgaagagcagcacgtttgagggacctatgccatcagaaagagctaaaggagtttgggaaagagagggaagatcaaaatgtaggggaccctgcaaggaaaggacagagaagcacaagaccagcaaagttgctaagatcaaacggggcacaagcagccattctgatgacttttaattttatcctaagggcaatgggaagtcactgaagagtttgctattgtattaactgtgaattggaaaaaggtcagaaggaaaatggggagtgattgttgcagtagcccaggggacagggggaggagggaatgatggaacttgaagatttctcaaaatggaggtggaaagaagtagacagactcgagatgtctttggaagcataaccttggaaagacatcttagagtattccataagcccttgactgcatacttcaggacttctactaagtgagaaaaatgaagaccctcttatgattaagccactgtctctgtgacatgtagcagatggggatccctaactgatatggcctctttatccctacattggctaagcttgtgattcactgtggctcattaattaataagcataaagttcttggttatgcctagcatgtggcaggcctgcagtaaatggtagctagatgttaaacattagccacacagctacacataagctcagccattgcagcctctgttggggcattgtggctaacaccttcttcacagaaaacttcagtgaggaactgggaccttgaggcagggaacgggaatgtctttgaagaaccttctctcctgctaccttctatgagctagtttttgcagtcttcttccatgtgatcctctggacacactggcaaatgtttgggtgtcttgttttcaacctgttagcagaagggaactgacagcatcactagattaaggagtgaaccaaactgtattagtgctgggactatcacaagccacagccatttgttcacatttccactatggcattgattctgtcttgcattatggccatagaacaaactctggagggcaggaactctatctaactcaactttgtttccccacagctcacacagcactaactataggttggtgcaaaagtagttgcagttttgccattatttttcatggcaaaaaccgcaattacttttgcaccaaccaacagtccctgccacaatggggcatgactgtataaacacgaatgtgttgaaatggactgaaataaagatatgtgcaaagaagcaagagtggtgatttatcacatgtggattggttgctaccactgaagtcacactttatgtcaactatctcacttgaacctcagaggtaagacgtaataagtatcattgtcccagattctatgaataaaaaacctgggcttaaagggaggtgatgtcttgcccaaaatcacatggaaagtcgttgtaatcacaagaagcctgggtcttcactgtagttcagtgtatcatacaactccaggaggagggggagaatgtacctggaccacagcgtgaatggtgcccttcaggatcgtgcagtggagcaggactgtgtcaaatcctgcggcaagggtttcactgttactctaacgctatcgcctgaatgtttccttttccttaggtcccagccatagggctgttctccaagggaaacatcacctcttcagaacttttagtctactggggaagtttataggcttgatttaggcttataggttttatccctttttggatacaatgaacagactctaaggcaagtgatttatttacgttcagctagttggcaagtggctgatctagaacaggaaaccacgtctgtagacttcaaagctcattcacttctgcttccaggcttctccaacaggagtctgactgggtagcctttggacccaagatggtgtgtctggaccatagactcatgaaaccacaaaataaacttacttttcataatgcattaggaagtctaatgcaatcattgtatccaatgttaaagatgaaatataagactttaaataaattccagacttgctataaacacctgggctagtgctccaggcacagtcccagttaatccccagtccctcaactgtttacttctttctgcagtattgggatgctttggtggaaaggtttgagaagcacagggctacactacagtgacttccctaacactgagcttccacttttcaccactgtgcagagaaaagcagttggtcagaaactgagttccagtttcaacatcgcaaagcagctgctgcttgtagcatgtgcactttttatgggtatattttatctgtaagtatatctaaagaggaataaggaaaatgagctttaaaagtaggtcatgtcttcagctcagagcatggcacacaaagtacatgctcagtaagggaaagctaatttgttatattatttcttaactcttacaatcatcatagtaatcattatgtccttcaaaacgaagatcacaattgctatgtgttacatatatcagagatagcagaaaagaaccataatgatgccaggttggcatttagaaccataatgatgccaggttagcatttagaattctctagagaaagtggttttctgttgatgttacactcacatgaaggcagacatcagtaaccatagcagaatgaacttccccagctgagaggaaagaagaacttactcatttttaactgattttggtgtattaagtcctcatctcaggctaatggtggaatgtagattccagaagtcttcagtattaatgaagaagctgggattgatggtgggacagctactctctctacttgctggacaggatgcacgcaggacagcagtcatcaccacaatcacagatgatatggagagtactatttggaatgcagagaagcctttgcttttctggctctgtttacaaattgctgcatttgtccctttctaaaagctacctggaatattagcctgtctgagtaacttacataggaagagtcttacattggagttttggtcctaaaccagcataatgccatcatcataacacagacaatgacacacatattgatcctattttcctggttgctttttctcagcaccttggtagtctccgtgattttcaccatcaaagggtgcaatgcctttgtctcaaatgctaaatgttagatggtctcttgggttcaacacataatgctcaggaggccatgaaaagctcggtaacattgaacattttaaaaaggcagcttaaagaaatgtatagctttggaatgcacaacttcccattgctgagtgatgtgtaaacacaataacctcacaccaggcagcgtggtgtattagtactttctgagggtttcattcttccattgatccacttgggaaattccctataaagattaagagttactggggagcggggctgtcagcaggaggggaagaacatgttgttactatctaattttactttattcttacaatgaagaatcattgtttctagatccaaatgtaattctaaaacttctgtgtgattaaagcttaatgctgtactgagagaagatttacttgctccccattagagccaaatgtaaaataagatgaaattataatcgcttctaaaactaggggtctttggctgtttaaattgtgtacagtatacaagcagggtgccttccctatgtcatggggaaaatgaaacccatgtgggaggtaacctgaagcaacatggagtccaggaagccattctgcccctgtatacaccttattagggagtgtcagggtctcctcattctcccttagccaactcccagggaacctgcaaaggggtgtgtaggagagtgagggaagagattgctctaaggtttgcattggaaatggaccagggctgctgtagaacaacagcaggtttgctaagctctagaatgagataataatagggaagccaccaagagttacccaggaagggaagggagcggtagggttgggtcttcacttgggaatatgaagatctgataaagggccacagatttggattctggaccagaattgcccacctcctagtattcagagctgttcttgctcccctgaactgtgccagaatcagaagggagggatgagcgaggagagtgttataaactgaatatttgtgcccctcaaaatatatacatcaaagccctagcccttagtatgactctatttggagatggagactctgaggaaatattaaggttgaatgaggtcataagagtgggtcccggatccgataagattagtgttctcatgggaagaggcatctgagagctctctctcgctctcgctcgctgtgacttccctccatgtgagggcaaagcaagaaagcaaccacctactagtcaggaagagaaccctctccagaaaacaaattggctggaaccttgaccttcaacttctagcctctaaaactgtaagaaaataaatttctgttggtctgtggaactttcctgtggcagcccaagctgactaagatagagagccctttccatccctgcagctgagtccatatcagactgaagctaaaatgcagagtgctaagcctttggagagatggtcctgacctatactctctacctcctagctgtgtgcgcttgggtcggtcccttgagatccctcatctttttaagttgggataaaagaacatgcctgacctaccccacaggactagtggagaatcaaatatgtagagcattattttattttattttattttattttattttattttattttacttttgagatggagtctcactctgtcacccaggctggagtgcaggggcgcgatctcggctcactgcaacctccgcctcccaggttcaagcgattctcctgcctcagcctcccgagtagctgggactacaggtgtgtgccactgcgcccagctaatttttgtatttttagtagagacggggtttcaccatgttggccaggatggtctcgatctcttgaccttatgaccctcctgcctttgcctcccatagtgctggaattacagatgtgagccactgtgcccagcttgtttatttatttttaaggaaggctcattgaagtataatatgcccatagtataattcacccttttcagtacacagttctgtgagtcttagcaaacacggtcacttaacttccaccacaaccacgacatagaacatttccatcacctttaggcttcctgtgtgcctgactaaagcaagtcctcccctcctctcagttctatagttttctttttaaaatatcatgtaaaaggaatcacctaagggttttgagtctggcttcttccaaagaaagacatttttctaatatctactctttgcaacaatattttgaagttggcacaattattagagtgaagagctgtggaaatgttatgtaaaagcaaaaagtgtaggcaaacctgaggtataattattataatcatttctatcattattattattattatttcacagtagaaaaaatacaatcaaatttgaatggaaattttgtgttgaatttgccttatctagaatccaggtgtcaggagatagtcataatagctctgtgacccgtcccttcaaaacagatgataatttgccttattttgggagagtagttattgaatgatgtaaaaagtatttgacaaaatattgttagcattaaggtccagcacatcttctctttgactaatccaaaaatacttggccttgaagttactaagtcattaccttatgtttgtgaccagattgaaagatgttctaggctgcaaataacagcagttccaggagtggcaataatccatttccagggctcaaaagagggagatgaagctggttccagcactcctccttacctgccctgagctgtgttcattccggagtgagagatgaggcagaaaagcctgtttctacccacaaagtatcccctgattgaatagctacgtgcctagaagccccttatcactctttgtagtaggagaattctcattttcctggacgtggtcattgtctggccacaatggctccaggttcttctccaaggggaagatttttgtggacattgtttctttttttctgagatggagtctcactctgtcacccaggctggaatgcagtggcgtgatgttggctcactgcaacctctgcctcccgggttcaaacggttctcctgcctcagcctcctgagtagctgggattacaggtgcgtgacaccacccatggctaatttttgtatttttagtagagacggggtttcaccatgttggtcaggctggtctaactcctgacctcgtcatctgcccaccctggcctcccaaagtgctgggattacagaccctgtttttaacctccttttacagatataacatgtaataaataaataaataaggtctagctattccttaaagtttaaaggttcatgaatttttaaggaacacatcaggaaaaactgctgagacaaagcaatggagcgtagggtgtgatgaggaggtctaggagccccttcaatatttaatgcaaccaaaagcctctgacagctaatcatctcttaatggggcttgccctttggcctacaagtttctaagggactaggatgtttggcttccaaataagttatcactcactcactgagtaaataccacaagctgaaagtggcctcccaggcatcattggtctttgctaggtgagtttagaaggtcccagattggcattactcacctctaaatcactagcagcttcaaagccagagaggcatttgctttgggtctgtggaaaggctcctgtctaccaatgtgcctctcagaagcacagaagggagatgacagagggagagtgagttttggtggggtatgatcctttggggaagtaagagacaaatgagaaaagactaaatgcaacatttgggtctggacaagtgagatttgagaggagattcatagggaagtaggaatggacagggaggggcagtatggagacgaatggatacagtagaagagaagggaagaagatggggacacaaggaggatgataaatgcattttctaagaagcccaacatagtggggagagctaacctgtcacctcctctctcgtctccacgtatacctggaaaacgagtggtgcattcctcgttaacgtgtgccaaggatagcaaacaacaacaactcatggggaagaacctagcctgtcagcatgaagagtggtggaatagagagctgtcttcaataccatttggtcgccaattcatatttacacttgctcagcaaattccttcatttccctaaattccagtcttccaatttcaaaaaataaattgttcgttagccacaaacaactgaaatttttcacaatttacaacctaatgaccagagtgtgtactttgaatttattgagtaagaaataaactttgtagtcaaaccaattagatgtgtccattctgatttaaatataaaatcattgatttctaatgcaagatatttacaccaagggccttttagtattttcttcaggatttattgtctagaaatacctttcaaacaggtagatttaaagaatgttcaggcctgggtattttaactagaacgcagttgttatttttctctacatatcactatcaaaattacgaggtgtcatagaaataaatattaagggctaaaagaacagttcttttcttgatatattttaaaaaccggatccattttttttcagcttgatttattttaggcactatggaatttctttttggccttgtgcctcagacattgttctgattagctttgctggtttaaccaagttgcagtgattagccctgatggtcatctggtttttaaaattatgttttcatagtttaacttccctctttagtctctcttaattttctccagcctcagaagagatgtgatactagtaactatctttagaaaaatactcccttatgttatacataatgaagtcttcctagacttaattcccagacataatagttccaagtctgcaacatggacactccccctgtctactgtacaggtggcaaaccgagacatggggtttcttatacaacttagagagactttatactccttgtgaaccacagtagatttggctgcattttgagaagttatgaatttcttatttgtagcatcaaacagatgagactgtttccatctgtctcatctaaggcttggttctatcgagagtttacagaaatgactggagaatggacaggaaggtagtgaagactgatctgtttcaaggaacacattgagaattcctcccccaaagagcagcattcatggggaacccattaaagacatggtatgcttaccaacccctgcctcatcccccaccagaaagaactgattccgtgtccatccctcttgaggcatgtgatacgttaggcaaagaaaggagttccttctgtgttcccagagctacacgaagagcactagaaccatccctgagctgcagcaggaagggagagttttttcttgaagtggtgggacttgagcttgccttcataaaggagacctttgggaagtagggagaaagggaagaagatcaaactttctaagaggcatgagtaacttggccctgggtaggaagccacctaagcttgctggctgaacacagagtgtgtgtggagactggagaaagcagaaaagcagagtggtccatcctaatgaatacaggatgtccaatggggaaaggtttggtatgtggctttaggtaaactacttaaactgactgacttttaggggcattacttgcactatccaggcaagtccatgtctgctgtagagcataactgttgggttcaagtgagataattgaatagaaattcttcgtaaatgttgaagactgagtgttgatggatgattacggtggcactgaggtggtgggtgattccggaaccacggcgtttttgtgctggaagtaaccaagggctgccctaactcttcacattttaccaataaagacagaagccagacctgagggtacctgctcaagctggttaatagcagcagcacaagaactagaactccagtctcttgggttgaggaaaataaaaattgcaagtccaagtcaactctccagataactgggtttctcatcttgcaccaggtcaacctggtgagtttagtgaagaccatgagaccccattcaacttaattactggagagcccctgaggccccacagcatatcaggctgagagcaggaattctgactctcagtgtcattcctgggatcacattccatctcacaaatatttaagcaagggcatgagggcaagttgccaagtagtacgatacaaaacaaatgtctcattgtgtttgttgctgcacagtgtgttgtttgtgtggtccaaaaaccatcaagtgactataactagaatgtgacagtaatttgtaacaacagtgacttttttggggggagggtctacttttgtgacatgcttcaaaattctgagaaagggttgcaaaagaaatgttcagaaatgtactaaatgggcttagaaaacttgtgaaccctgtctgaacttttattagattgtcccaccactcacccatttgacatctgaacaaggaaagcattatttataacagcatgcgtgaaatcccagaagggattcttgaaagaattagagtgaaaaatctgccccaaagagacagcaagcagaaaataaatgatcagatgagaaaacatgtaaatcaaaacgtgaatcttttgttctctctctcttctttaaaggaaacagaagctttttcttggctattagcaattcaggatagagaaccagtatcaggttttctatcttgcattgctaatgaccaaaaaaagtgggtgctgctatcaaaggagccacttggttaaggccaaatgaagagttcaggagagtgacatatgatgattcttcttaatgtctccagaatggctgcttctggagtaagtaagagagtgaaggttccagagaagaaagccacacctcaaaagcattaatactttaagacttagaaaacactttcacaaatgcctgcttgagtaaatacctcccaacaacattaggaggtatacattattacttacatataattattaaaccttggccacagagagatttggcaactagtccaggttaccccagtaggaaacaggtaagtgagcgattggaaaccagctattgtcatccactgcattgcagctgtgaatatccaggtagatatggaaatcctgagatcttgctagattaacacacctcaaagtgtatttttagctgtcttacctgagacatatataaatggttatctctcccacaaacatacattcaaatagtttaatttaccaaagttaagtttgttctttcctgccaaactcctcacatactttaataagcctcagtccctgatggatctccttgaattgaagagggttgcaatttacagtacatttgacatatttgatctaggaacttctggggttgttaaaataacacaactcagacagcataacaagaagaccaggtcccagtctttattttaagattcctacttctctaagcccactttgaccactggggttctattttatctaacgagaaagaacagcaacaccaaaatgcacagtggagctggttgcaccatagcactatgctgacatgaacaatgatgaaatgagctcttctttatagggtaggaagaaggttaaaatgagagaggtaaggttaaaaataagatgtatagcagaagggattatttttccctttgatttcatcttacccatttttttttgcatgttaggtaagcaaaacaatgccatgtttgtatcttaagaggttcccataaaatgcttgctgtgtggatgaaaatggtctgttaaaatgtgtagacctctgtcctatctgcaccacccaggcaaggtcacataattgccaggagcaatttcatcatctgtaggctagaggtgccaccaagagtcctgagttctttatggtttgctcacacaattaaatgacaccagacgtgtatagatgttttctaaaccatatggtacattccaattatggcttcagagaatggcaaggagactagagatgctttattctaggggttaacaatctttgaaaatgtgtgtgccaaagtgcccagccttttctggcacataaacagaagggtcatttgcccacctctgcaaggtggcagcagcatccctgcatggcccaaagcagtcctctccttggcattgccatgtgggctgcccagacctggtgagatcattctaccctcataccgcaagtcctccaaagcatctggaaacaacaggtcctctgtgtatgtcagcagattccctctcccaaagtcctgggcacctgggggtcacagagttataaacagggcagatatttgccaaaccagaaatgtgctgaaatagctgcacccatatttactacccacatcctttctggttggtcagtgtctgtgccacactgattgcagtttgagtatcgaccctgagggtgactgttgccaccaccttcagacatcaagtaagaccataagagaagtctctgtccattgaacactgatgacctgtcactgctgaaggaagagtgaggaaatctaaggccaatggaagccaacttagcctttatgagctttttgtttattaaaaactgaatagtagagatgggtcacctgagccagaagtttttgtccctatttgtcaaatttggatgcatcatacagagaagaatgaaataaaatatcctcccccttttgtactcttgtgctttctttggtgctaagaacatcactgggaatcaccaagcatgttagacatctctgacatttcagcctcttgggttctggggtaggggaacattttccagacactattagtttattttcttcctttaataaatactaactggatattgagattagaattgggcagaaactctatgcaccattactctataaactcaggacccagagttgttagagaggtccaattttctgctgtaggataagcccacctgctctcagctgtcaggcatactgtgtagcatggtggtgctggggggttaccaggatgaaaagcagaacctaccgccacaggactactgtgcagaaatctgttcatgggtttgaaatcgggcatccctgacaaacctggaaatgagcttcctaactttcctccatgaagtaggaagtcatatacaattttactttgtcaaagaaagttttctttgcctgtactaatgcgattgctatctgatgccccagtctcagtgttttcattaaaatgggcatttaaaaaatgtatttatctattgtggtaaataatctaaggagcagtgccctgtaatagaggaaagtcctgagcttagaatccaaagacctgagttttgtttctgtaagcaatctgaatcttattgccttatttgtagaatgagaataatgatgcctgacctgcccatcgctgagtgatggtggaggggtttgaatcagcatcatgcacacataagacctgaaagcagaaggagactctggccttgccaaggaagtagagtcactggttggtcattttggatgcagagtacctctttgttctcctggtcaaagtgatcttgttaattagaagattgagtcatcctcttagcagaaagtgtgtgtatgtgtgtgtagttttatttatccaaggtgatcatctacctaatcatcatccctgctcctatctggttttgagagaaagaattgcagataatatttttttaaatgattttgatcactctttgccttctgtctctgttgcttgagactgtgaagaagtcatatatcctttatgtgtttataaacaattaaaactataaagtgcaaataaggaaagcaaacagtgtcccccagcagctcccttccacacctggtttcggggtgactgatgcctccctgttgatccctttctccccaggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgtgcaatgggtctggccaagaccctccagagggctgagatcccagaggcatccattggctggggccttgttttgggttggaagaccatgtcaggacacgatcttatgggctttgttggtggcagcacttcccaagtagcctgctatgtttctaaatttcatggtcaaagtataatcactctgagaaagcaaagcacagtgctcgctgctatgtccttgctcctctggtgatgggactgaggagtcactttatgcagctcatctgataaattaatagcagacgtagcattccagaatccatacagtccagcaagttctttagtattgttccaatgaagtttcaagattctttcctttttgaatatttcaccagaacattaacttctagtgaaaaactcaagcattttgttttttctattcttacgcttgcaaatattgtttatatttgaggcacagcatcttgatcaggcaccgtacatctttttcagatccatttctatctttttaatccagttcctttatccaatagcctgagaggtttcctgtcagtcagtgccttaacacccaggtgactcaggttccatctcagaccaataaaaaccacaacatgtgggagctccagtgtgaggtttgggaccattccatataaattatttttccaccagttttgtgaaatcagagtggcttggacaaatggatataagccaatcaaaataaacacgatataaactaacctataataattgctctcttccttctgagaaaacaaaaccaagagtgggcttcttttgtaaaagccctctcttctgctgtttttttgcactgacatttcttcgatgtgcattgcttttcctcctgtctcatcctatctttgatctccatccaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttttttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttttggatggcttaagcctgtgtataaaaaagaaaacttgtgttcaatctgtgaagcctttatctatgggagattaaaaccagagagaaagaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggcttccgtgagacacaagatggcgcatagtgtgctcggacacagttttgtcttcgtaggttgtgatgatagcactggtttgtttctcaagcgctatccacagaacctttgtcaacttcagttgaaaagaggtggattcatgtccagagctcatttcggggtcaggtgggaaagccaagaacttggaaaagataagacaagctataaattcggaggcaagtttcttttacaatgaacttttcagatctcacttccctccgacccctaacttccatgcccacccgtccttttaactgtgcaagcaaaattgtgcatggtcttcgtcgattaataccttgtgtgcagacactactgctccagacgtcgtttccctgataggtagagcagatccataaaaaggtatgacttatacaattaggggaagctaatggagtttattagctgagtatcaatgtctctgcgttgtacggtggtgatgggttttaatgaatatggaccctgaagcctggaaatcctcatccacgtcgaacccacaggactgtgggaagggcagaatcaatccctaagggaaaggaaacctcaccctgagggcatcacatgcactcatgttcagtgtacacaggtcaagtcccttgctctgggctctagttgggagagtggtttcattccaagtgtactccattgtcagtatgctgtttttgtttccttcactccattcaaaaagtcaaaatacaaaatttggcacagcatgccaacgggaggctgtgcccagaccaagcactggaagtgtgcttctaggcatagtcattggttttgcaaaaagagggctcaaatttaaatagaaatttacagctatttgaatggtcagatataccaagaaagaaaaatatttctgttcctcaagaaaacttgctaccctctgtgaggggaattttgctaaacttgacatctttataacatgagccagattgaaagggagtgattttcattcatcttaggtcatgttatttcatatttgtttctgaaggtgcgatagctctgttttaggttttgcttgcgcctgttaattactggaacaccttatttttcattaaaggctttgaaagccaattctcaaaaattcaaaagtgcaaattaacagaacaaaaggaaatccagtagcaactgcagtcaagcgagggagttgacaagataaaccttacgtccattcaagttatatgctggcctatgagagatgagagttgggtcgtttgttctctttgttgatgattttaaaaaaaccctctagaatacacataataacataatgaaagccatatctccatgatatatatgtgcacatatatatacatacatgtgcatgtatgtatcatattaaggacccatggtactcttaaaacactgtagaactctgtgacgcagtaaggaaggggcagatttgtacaaaaacttttctagattccatcagcaaaaaccaacacaggtttgtcacgctgcatgtctggccagctaatctcgggggaaaagctacaagttatttattttattttaagagaataaagtaggtaataatttaagggatcaaattcaaggaggaatgtgcaattttagagcaaagatttgtttaaggcaaatgagactttgggagcatcccattccagttttgtcttttttttctctgaaagaaaaaagcaaaaaataaaataaaattccacttataccttctgacaagtccctaaaggtcttgaaataaaaggttctatgcaagtgcaaagttttatagttatttttattgctgattattactattactatctctgttgtcttaagagtatgtgctgatttcagagacatctcaaattgaaagaatatcagattgcttttaaagtagctgaacgagccacagaatatctgaaattattcattgttgttcctccaccaccccctttctcatggtctgatttttagaagagtggcatcctcgttctaaaatgtaatgatcaccaaatacggccttccatcaaatttgtgaaaactacaacagtataacagtgacaaacctaattctctagcccaaacctggtctgacaatcatttccatttagaagtcattgaatagttttccaaacactttccatgtgtgttagcaaattattcctattttgtgtagatgaggacgttgagactcagagacattcagaggcacgctagaggtctccagcctagcttccagcaccattgggactgaatccaagtactctcactctgaacttcgtggttctgtccactagagactctaatatgcaaacaagcagttcaggaaagaaagcatgctaacacattcatgaagcagtatatgaagttagaagaacaaaaggaaatacaggagatgacaagcaactgagatattgtgatatataatcatgctcttagcttcagctaaattcagctaaattcttgtacactgaaccaatgtcataatcaggcttatttagaaaacactttgaactatgctataaaagattatatcagaattcatattatacatgtgttcacatcagcgctacctgtgatgttttcatgtatttatgtatgtgttataaatacttgatttatacatatacaaatgcacatacgtagtgtgtttgtgtgtttatgtataaatttataggcacacaataatagaggtaattataagtaggatgcggtatgaataatttgcttaaaatatgctaaataaccaaaactgtttaacgtcatgttgctgttagtgcttccatactccacgtgggtaggactacatcacacttttcaactctgtgcagtactgcatgggtggaagacatatttaagataatgtgcttcccaaaacaactgaataaaagccatcccactacattgagtgctttctctggctccttgcaaagaaagatactttttgtaatggtccaggaaaggaacattgctttctttttgtctttcagcacatttgtattatgctcaccttgtctctgtctcactgtgacccctttacacttgagttcagagttcaagcattccaaatataaattggaatgttggcagcccagtggcttgaaggccaatgatgagcagtccaagaccccacagcgagatgagcaactcttaggaattcccacatcctagagtgaatgcaccaactaacagtatagaatgctgtccttttcaaagcgtcctaacagcaggattacctggtcaagtatggactttctttgaatctttcttttcacaaattggactgcctgtaataccaataacattgttgtatctaactaaataaatgactgcatatacacacataccctcaattctcttgcttccccattttctttttcatcccctgtctcaggacttttattttcaatgttgacctttggtttggccatatatcactgttataggaaatctcatgagaggaatggctagtgacccaactctccaaatgtctaagttagtagttacagctgattttttatgatgcataattggaatgtggagcctctgaggttgtgatagcttgtacatgaatttcaaatgtcattctaaagaatgaggggtgggagggatttatagttagaaacgacagtgcaggaaggggtattttcttgttgtcagggctggaatgaatcactgctgctcaagtcaaaggttcttgaatatccttagtttttgcatttcccctccttttcctttgacctttatttatttaattatgtatttatttatttatttatatacttttgctccattcagcacaaacacaaagcaaagcaaaaaaaaaaatatatatatatatatctgtatatgtgttgtaggcaaaacactgtgaatttcacaacaaccaccaccaagcaactattttgccatcttaacatacatctcaggagacgaaatgagaaaagatggggatgtcattttttagtctatgcgtttgaggccaggtccatgtttatttatttctttagtctatgcattaatgaaaatgatcctgagtggaggttagctgaacgttcaatgtactggagcaagcatcataaaagctgctagtagccatgtgtttgaacaggaaaaatattacagaaaatgaaatgtaaaggcctatatcttgcagcttgtatatcttactattgcttaaaaaatgtataaagcagctggaaatgttttaaatacaaggtctttgaattaaatgtggattttaaatatgtaatcccttgacaaatgaccaaattatggtgaactattgctccctgcgttctttgatcattacctatgacttacaaatctgcctggagatgtggacattctgcatttgcttctgtatctggagagatgtttgtatatatccaggccgtatacacacacatttccatatctctctacagatatatttccccttcaatcgtgacctggtatttggaactctccttttcatttggcttatcttccttttaatgtgatgtctctgtgctaatacttaccagttcttgttttgcaatctgttttgaggtccattgctttactaagacccactgcatcttggctgatttcaaagtgacacctgaatacagtgtttaaaaaaaaaaaagttttgtttgtaaatcatgtgaccagcttctctcaacctgacatggaaagtctcttgtactacagtgtatttaataaaaatgatgtcttacaataaataacatactccaaaagagagactaaaaatgacatgatgattaatttttaaaaatgtatagaatttccacaagcatggtgttctctttattctatatgtatatatgtctgtgtttggttttggttttgtttaaagacaggttcttgtaatgttgcccaggctggagtgcactggctattcacaagcatgatcatagctcactgcagactcaaacccctgggctcaagccatcctcctgccttagccttctgactccctgggctcaagccatcctcctgccttagccttctgactccctgggactataggtgcacaccactgcacccagctatatgtatgtatttttagataggatcactgtagatgcctgtagtgctcattagttgaaggtagtgagagtaagtggttagtcatagaaataagtttcctgtctgatctatccataattctgatattttcaacttacaccttagataactagaacatcactgtcaattgctttactttctgaaacaatataaatgccctatctgtactgtccaatatggtagcctctacccacatgtggctagtggacacttgaaacatggccagtgtgactaaagaactgaatttgaattttgatttaatttcaattagcttgtatttaaatagccacatatggctagtggctaccatgttggacggcacagagcaagaagacagaatcaccagggttttgaaaagattaaaccttagaaacatcccaagagatgtgtgtattgtggcatcctagggttgaggccgctttgaggatctgaatgactcaggagtataagtaactgaattaaaaatgcctcactctcttggcctttctatgcaccagtgtttctgaaatcataatggtgggggaggacaaaattagggtggcttttcaggggtcctacgggctgtctctttcttaccatcagaatggtctgcccacattcttgttctcagtatttcacagttggatttcccagggtctggcctcttctcaaccctctgagaggcacaccagcatctgggcaacattcctgccataggcttggcaatagacgctccaaaactcagaatcctcagaaacattgcctcctgaatacctcctctcagtggtgcaggtatgtttttcttgagttaaaaaaaatacaatcaggtgaaaactcagcagagacttggaaaatgcaatgccataaaaggggcaaaacgacttgtgtacatccccctcaaagaaactgtggattgaaggaggaaagtttaatgactaatgccttggcaagccacaatccagtttggactactaaagatcctgacttttaccagactacatttgtatattcctgttattggtacaattataatggtatcaatttaaattccaaacctgaagccgtgtcccagagccctctcttgcttccctgtgtatcccatctggccttccctcttcaaatactccttccatgcatgcataagggtgcctattttcttggatgagaaaaatgctcctgaagtattactattaataacatcattagaacagacatacttacttttagaataaaccaacaaaatgaatccttcttctgtgccagggtgttatacatgtgtattagtatcttgtggctgctgtaataaattaccacagactaggtggcttaagacaacagaagtttaatttcttacagttctggaggccagaaatctgaaagtaagaggttggcagagctgcactcccttggaaggctctgcgggagaatcgtttccttacttgccccagccattggtggctccagacgttccttgctggtggttacatcactccagtctctgccttcttgatcaaattaccttctcctcttcatatgtcttcttccctgggtgtctgcttttttcttttcttttcttttctttcctttcctttcttttctcttcttttctttcttcttttcttttctttctttcttttcttttcctttctttttttttttttgatggagtcttgctgtattgccaggctggagtgcagtggcgtgatctcggctcactgcaacctctgcctcccaggttcaggcaattatcctgcctcagcctcctgagtagctgggactacaggtgcacaccaccacgcccagctaatttttgtatttttagtagagacggggtttcaccatgttggccaggatggtctcgatctcctgacctcatgacccacctgcccaagcctcccaaagtgctgggattacaggtgtgatgggtatctgttttataaggatacatgggattgcctttagggctcacccagaaaatccagataagtgccttctctcaagatctttaacttcatcacaacttttgccatataagttaatattcacaggttctggagattaggaggtgggtatatctttttttggaggggacattactcatctcactacagattcttaactcatccaacccttacacctatcccaggaggcaggtactattattattcccagtttacagatgagaaaactgagtcactaagagttaaggaagctgtcaaaaactgtcaaaagaaattaaccagtaaagataatgcttagtatttgccaaggagtttcatacattaactcatttaatccttagtcaactctatgaaattgaagaacgcagggggctcagctccaggcaataggcagaaaggcaggtacctgactggcataaggaagccttgaagttagggtctgggctggccatatgacttaggttcagggtctgggctccaggccaccgagagactggtataaagcagttccgtggcccagtcctgtaggaatgaggttatcagcaggagctaaagccaagattcaaagttcaaggagactagacagtctctagcaaattgaacctgggatgtgaggaaggactttcgtcattagggacaggatgagaatttagccactaagcttaagcaaaaagtcacgccagagccaccagctaggtatttttggtgccttcctatggcccagtgcttaggttggtgcaaaagcaattccagtctttgacacaactttggcaaaaaccacaattgctttttgcacaacttaatactaatcccacccactttcactcattagtctaggggaggatgagtctccaggtgaagggagctgcctagcaatggggctctggagctagaaaaggggtgatgttagaactcagatttaggaacgcctctcttgcaataagatctctgcaaatttggccatttgccaaacgtcagagtctttggtagcctcccatgtttagagctggataaggcctaaaggtcccatgccccatctgccatctacaggtagtgttttacaataaaagtaaggctcagaccaaattcttccaaacaagcaatgatttattatcaagaccacatgttggctatgtagaccagaaacttcccctttctgtctttgggtgaagtcacagccaaaggcagattcaaaaatgtgctaatgccaggaccagcccagcctctgttgaatcagttgacaggggagggatacacagaggacccagggagctctggtcactgaaagtgccactcctggcattagagagctgagcttgctacattcttctgcctccttcatgtaggaatgacagcatctgtacaatattcctaattctcaatcttcaaaatcagtcatttctgccaaaaaataagaaaaactctaatatattttatgctaattaagacactttctgatattgatataaaaattttaaatgccagttaactactcaagtcacttttcatgtgggctctgtttatgttgatcacctctgggatatgaggtgtatttaacgtgtacatgcacatcacactatatacaactgattttagagtcagttgccacacagacaataaaacaatttccataaagacccttttctcctatagtagatatggatttgtagctaccaaacccaaatgtgcaaaatgtcacttgcttcatttcctttaaatcaggctatgtctggttctagcccatatcctgcaggagcaaaatcagccttaagcatcacttggcgtgcctccctttcataaggtaccccatgaatcccaaggcccgttgatacctaggaaatatgagaagggtctctaatgtcctctccatcatgatctagtggctctggtgccacaactgagagctctgtgtctaggacagaatgttcccagacacatcacagccatttccccaaagtctacctcttccctgtgcaatttgaggactccacaccgaccaatatctctaggcttgggaaaatctctgttacaaatcctacctctactctccaccctttccttttccctagctgaatcatctcctaaatacatgattagatcattgttcagcctttttttttttttttttttgagatagagtcttgctctgtcacccaggctgaagtgtagtggcacgatctcagctcactgcaatctccgcctcccaggttcaagtgattctcctgcctcagcctccagagtatctgggactacaggtgcaggccaccattctctggctgatttttctatttttagtagagacagcatttcaccatgctggccaggctggtcttgaactcctgacctcatgatctgcccgcctcggtctctcaaagtgctaggattacaggcatgagacactgtgtctgacccattgttaactttttatattattatgacaatgaaagtgctatttggagctgaggcatacagtaaaccatgactattttccttttctgtattttgttttcttaggagttagtaattgacttttgtttgtttgctgtcttagttttctaattatcgttattcaaacccaggctcttagctatttgtctaaatttcctctcaaaacattccagtgcatcatgtattttacccattcaatccacctggacaatgtctcctgtagccttctcatctgatgcaatctagacatatgacctcccaacctgttgcagagccatcatctgggatctttctcttccagaacttggacttttcccgtttttgttctgcatgtatctccttccttcctgcctccactattctatgtcttccttttcttggtttacctcttgatttggtggaactcatcctccaatagctttctaagaaaaggcaaacaagaaatttttggagactcattgtgtctgaaaatgcttttattgtaccctgaaacttaactaacagtttgcctgaatatagaatattagtttgaattttttcttaaaatttttgaaggcatatattgattgtcttctaactttaagtgaggctgttgagaggtccaaagtgtcctgattattgatttcaaaaatgtaatcctttttttaaatctggaaattttaaaaatcttttcatatttagtattctgaaattttacgaagatgtgtcttaggtttacgttaatgcactgtgctggatacttcaatgagctgtttccatctagaaactcatttttttcagttctgggaaattttcttgaattatattgttgattaattcttctctgtgttttctctcaggaaattctatcatttaaatactaaaccaccctcttggactggacttcaaattcttacttatgtcttcaattttctaggagaacttttaaaaatttattttgagttctgtcattctcatttttttctttaaaaatgacttttcatttcacttagaataaaacttgaattccctgtcatggtctacaaggtcacaaaagatagtgctgttgaaaatgtctgaaacttctcctcacaccatatttgccttctctcacctatattccaatacctttcatcactcaagaattttgcatattttatttcctcttctggaaaatcttttgctccaactttttaatggacctttttcatattgcagattttgcaatatccttttttaagaagacttccataacctcataaacaaaatattctttcctgttattctcttcctagtactcagttttctttctttaaagtctttattaattctttcagtaagggtgtgtaagtagaaaactcttagtttttctctgcatggaaaggtgctagtatagctgaaaatggaatcctggctcagcagtcactttcctccagcctttggaaatattactttcattgtttggcattgtttgttatgaaaaggtttctgtcaatattctcattcctctttagatcatctgccatttctttctagtagcattttagattttctctttgtctttcatattatttagtttcattaaaatgtgtgtagatatacattttttttacttcttatgtgggacttagtttcaatctcaggacttgtgtcatttttcagtgctgtttcatcccaccattctcttttggatatattgctcaagggcatactatgttttttcttctagaacttgaggtagacatgtgttggagctcctcattctctccttcatttctcctctcttgttatttgcctttgcagcatttagggatttt

SEQ ID NO: 370 - DNA, 122837 bp, Homo sapiens
aatcacaactcactgcaaccttgatctcctgggctcaagcaatcctcttgcctcagcctcccgagtagctgggataccaccatactggctaattctttttctttttcttttctttttaaaattttttaaatttaaatttaaattttattttacgtatttattttttttgaggcagagtctcgctctgttgaccaggctggagtgcagtggcacaacctcagctcactgcaacctctgcctcctgggttcaagtgattctcctgcctcagccttctgagtagctgtgattacaggtgcatgccaccatgcccagctaatttttgtatttttagtagagacagggttttaccatgttggtcaggctggtctcaaactcctgacctcaagtgatccgcccgcctcagcctccgaaagtgctgggattacaggtgtgagccactgcacccggcttcttttttttttctttttctttttttagagatggggtcttgctatgttgcccaagctagtcttgaactcctggcctcaagggatcttccccccttggccttccaaagtgctgggattacaggctgagccatggcccctggccctgatccacttttctaatatatggctttttaatttgaaaaactgatttccttatacactgtgaaacagcatttctatagctccctggactatgctagttccctcacccaatgtctccacttctaaagtcctcagttactgtgaaactcatttatctttctgcaacattaattttgagaaagttgaagtgagcaaaacttcctggaatctgaaaagaagatccattgtccccgtaccaggctcacaatcagccaaagggggaagtagattttcctgtctgtacaaaagaaggtaattagaattttggttgtaataaattatctatagtctcctctttgaagctgttttagagaatgttcctgtaggccagggtcttagaaagtttcttttgaacgccttgaccatattcagggctcctgggcccctcatcatgagagaagtattgctaaaacggcttctgaccagcagtaactaaataccagaggaagccccacctccaaagccttatggcttgtctgcagacagccatgaaatcttagtttggtggaaatgacatcagatctcttcactgttaactgtgctttgtgccatagaataaagtgattcagttgttcaattattataaaaagtcacttgctggccaggcgcggtgcctcacgcctgtaatcccagcactttggtaggccgaggagggtagatcacctgaggtcaggagttcaagaccagcctggtcaacatggtgaaacgccatctctactaaaaatacaaaaattagccgggcgtggcagtgcatgcctgtagtcccacctcctcaggagactgaggcaggagaattgctggaacccgggaggcgaagactgcagtgagccgagatcgcgccactgccctccagcctgggcgacagagcgagactctcaaaaaaaaaaaaaaaagtaacttggtgcttattatgtgtcaagtgctatagatgccaaaatgaggagaggacatgctattgtcaattttagcctagcacttaaatagcagatctagtatcagtgctggtcagtccaggtcagcatagaaggcagtctgagctgaaagcagatggaggagggaaagctgctcaggaaatggtattgaaatcccaaagcagtccctatgggtggtagggaggagacattctaggaagggggaacatcatgagcacaaactcagaggtgtgatagaacatagcactggaatggaatggcaatcaatccaatcaaggaaagaggaggggcaggtagcaaaggtgggttgatgtcagattacaaagtccatgtgtaattagactaatgaattcatgcccctgaagaatattccacagagaagtgacatgatttattttgttttatttttttgagacagaggctggagtgcaatggcgcaatctcagctcactgcaacctctgcctctcaggttcgagtgattcttgtgcctcagcctcccaaatagctgggattcaggcgtgcaccgacatgcccagctaattttttgtatttttagtagatgggatttcgccatgttggctaggctggattaatttgcattttggaaagcaactctggtttcagtgtacaagagatttgaacaggagattaactaggaagctaaagtaatagttatgaaaggtgatgagagcctgaaattaggtcagtgtctatgagaacaaaggggatggatttcagaaacgtttctaaatcataaatgactgaaccagaagaactgaagctgatgtcagatttctcgcttgggtgatgaggaacaaggcaggaagagcagcaatgaggatagaggtggaagggcagctcaggaatttccctggagttttcccatcttgagacttcggtcttggaagacagaatggctgtgacataatgtggactttttacttccacctctaggaaagcgttctttggaacacctttgctgagtctctctctcctccgctcaagggtaaggcttacttggtagtggggccagattgcacagtgtcaacatgctttctaaggaaaatcccagaaggcggcattcgtccagataaccttgctggctgcatacatatttgaagcttatgtgcacaaatggagttcttccagaaagagagaatggcatttgtggagggtgaatcaattaattcagctactgctttttccaacctcagtttctcaccgtaaacagacagaacagcatgagcaaagtatctggtgttttagggtaaaaagagggaggaaagggcggctaacttatccaccaggcatactaaagtatatgtggttctttacttttaagcaacccacatattcaacattgatatccctattgttttttattttcataatatgtatttatagcacttcttcagaatcagatgaagaatcatgatatacagtttttttttttttcctaaggcggacagagtctcactctgtcgcccaggctggagtgaagtggtgcgatctcggctcactgcaacctccgcctcccgggttcacgccattctcctgccttggcctcccaagtagttgggactacaggtgcccgacaccacgcctggctaatttttgtatttttagtggagacggggtttcaccatgttagccaggatggtctcaatctcctgacctcgtgatctgcccgcctcagcctcccaaagtgctgggattacaggcatgagccaccgtgcctggctgtatatacaaatttttaccttaagtttgttaactttttttttttttttttttgagacagagttttgctctgttgcccagggtggagtgcagtggcatgatcttggctcatggcaacctctgcctcccaggttcaagccattctcctgcctcagtctccctagtagctggggttacaggcacatgtcaccactcctggctgatttttgtatttttagtagagacagggtcttgccatgttgcccaggttggtctccaactcctgagctcaagcaatcctccttcctcagcctcccaaagtgctgggattacaggcatgtgccaccgagcctggctaactttgttaactttttaacataagtaaacatacttgcagaaaagagcccagataggcatatagcatgatggatcttcacaaaggaaacatgaccatgtaagcatcacccggatcaaggagggcatggttggcacaccaggggcagccctaatgcatgctccctgccagccaccaccccccctaagtagcagcctactaatggaatcaattggctttgtctttgaactttatatatattaatcagtagaatcacacaagaactggcttctttcaatcaacatctatgagagtcacccatgttgtcgtagccagtttgtcattgctgggtcgtactacgttctagtgtgagaaaacaccacatttatctgttctgctgatgaacatttggtttgtttctagttttgatctattatgaattatgctgctattttggtgaacatatgtatgcatattcatttatatgtgtgtaggagtggaacgttgagctattcacatgtctctctcttttttttttttttgagacggagtctcgctgtgttgcccaggctggagtgcagtggcaccatctcggctcactgcaacttccacctcccaagttcaagtgattctcctgcctcagcctcccgagtagctgggattacagatgcgcaacaccacacccggctaatttttgtacttttagtagagacgaggtttcaccatgttggtcaggctggtctcaaactcctgaccttgtgatccgcccacatcagcctcccaaagtgctgggatttcaggtgtgagccactgcacctggccagccaccgcgcccggccgacatgtctctttatcgtttttatttttttgggtcttgctttgtcacccaggctggagtgcagtggcacaaacatggctcactgcagcctcaaccttctgtgctcaagtgatcctcccacctcagcctcccaagtagctgggactacaggcagtcacaaccacacccagctaatttttgcattttttgtagaaacggggttttttcaccatgttgcccaggctagtctggaattcctgagctcacgtgatccacctgccttggctcccaaagtgttgggattacaggcatgagccactgcacccaggtctttatcatttttcatatgacaaaatcaaacttctttttatttttgagacagagtttcgctattgttgcccaggctagagtgcaatggcatgatctcagctcacagcaacctctgcctcctgggttcaagcaatccttctgcctcagcctcctgagtagctgggattacaggcacacaccaccatgcttggctaatttttgtatttgtagtaggtatggggattcatgttgaccaggctagtctcaaactcctgacctcaggtgatttgcctgcctcggcctcccaaagcattgggattacaggcatgagccactgtgtctggttcatatgacaaagtcaaacttctattacctggtgagcaaacattaaaaattctcacctggaggagctgtgccccagcagtctaatttggacaaacatgttgttgaagaacagttcattcacttcactttattcaatgcttcctgcatgccagaatccgggctgggtgctacagagacactgactgacagaatccttgcccttggccaggcacaggtgctcacgcctgtaatcccagcactttgagaggctgaggtgggtggatcacttaagtccaggagttcaagatctgcctggtcaacatggtgaaacctcgtctctactaaaaatacaaaaatcagccgggtgtggtggcacgcggctgcaatcctagctactcgggaggctgaggcaggagaatcccttgaacctgggaggcagaggttgcagtgtgccgagatcatgccactacactccagcctgggcaacagagggagactccgtcaccaaaaaaaaagaaagaaaaagaaaaacaaatgctgataatagtgataagcgtaagtctcataatccaaagcaaaagtgataaggttagagtctgaatcatgagcaataccatctcacccaaatctatttggcttctcagctttggaaggtgagtagtgcaatttcaaatagtgagggatttgtccaaaaaatgtatccaaatctgttcagttcctgagttcaaacagtgagatctagaatagtgacagatacaaagtatagaatactatacttttacctaagttatatctacttatactttttagggtaataaggcattttacaacatttttaccttttggaaataagatcttccagtaaatactacttggacatgttttcagcaataacctacatacaaacatgagagaccacctgcttcttcccactgacaccagcccctcccttatccaggcctttgttctctgctcaggtcatttacctccttccttcatcttctttgccttcaggattccgctgacacattgcattcttgggagaaccttccaattccaattatggactagctgctcctaccctgtgctcttcgcttggtgactattcttatcccttttcagcccttctcacactgttttgtgactgtctctttatctgtattaagttggatatgaatttggctcctttcacacagaccaaaatataaatagcttaagcaatataaagatcacacacacaagtgaggcaaatgaccatctgagggttgaggaaactctgctgcaagggttgcccacgatcctggtttcttgtgttttattactttgtcattccctaggatgttgtctccatttacaaggccaaaacaggttcatcatcagctcatcactctctagtcccgggaagggcagcatggagttaaaatgacaggtagcaccttcttttttaaacaagttatgacttttcaaggacatagccagggtctttgcttctgggagaaggtgtgttgagttcaatgtaggctgccctgagttaatgatgggttaatgcaacccaagtcacttccttataaggatgtaaccagaagctgttcccatcgcttctgtttatattatactagccagatgtttgttagtcactttcctggcagcaagagcccttcttactaaaaggtagaagaaaagaatggacattatagggcgataagctctctgccacacacaccacactgggcattaagttctgagtttgttcaccattatgttagtaatgctcagtacaaagtgtttaatgaaatggctaaatctttgacagtgctagaacagaggacataattccgggagtttctgaacagaggactggatctttttcacaagagaaagaaaagttagaccgctgtagaccagaattcagactgttccgcgagtccccttgaacaggctctgaaccttgttctttttgatgatatggggataactctatttgatccctagtatgagttgggagcgttaagataacatttggcagtgtgtagtacacagatcatgctgaaaaatatgatcttcccttccatttgcagaagtgctggcaacatccactgtcacactacctgtcgcagtatctgcctgctgttcaacatgtaccatacctgactggcaaagccaacgaacacgcagccagtctgctctcttatgcgttctacattttatgtcgaggttaagctaaactaccagcaagttggatacttagacctaacatttaatagtcaagaagatttttgctttttctcataacccacatctatgatatacctgactgtgtttctcaggattgggtggatgtcaagcagagttgaatctgctcctcaaatttaagaccttctggtgcatattccaattttcccttcattcttttttttttttttttgagacagagtctcactctgtcaccaggttggagtgcagtggcacgatctcggctcactgcaacctctgcctcctgagttcaagcaattctcttgcctcagcctcccgagtagctgggactacaggccatgccaccacacccagctaatttttgtatttttagtagagacggggtttcaccatattgatcaggatggtcttgatctcttgacctcgtgatccgcccgccttggcttcccaaaatgttggaattacaggcgtgagccaccgcacccggcttcccttcattcttaatcacctacctttagtatgtgatcctgatttgcctttttttttcttttttggtgttccctcttctggtgtcctaaggtaccctcttcttcatgccctttcactgggcatggtcatactctgctgagatgtctgaatccttctgcgaactcctcagaaaaacgactgtgttggctgggcacagtgactcacgcctgtaatcccagcactttgggaggccaaggtggaaggataacaaggtcaggagatcgagaccatcctggctaacacggtgaaaccccgtctctactaaaaatacaaaaaattagccgggcgtggtggcaggcacctgtagtcccagctacttgggaggctgaggcaggagaatggcaggaacccgggaggtggaggttgcagtgagccgagattgcaccactgcactccagcctgggcaacacagcaagactccgtctcaaaaaaagaaaaaaaaaaagactgttttattgacctttgtaaccctgatttgcttttagtaacattttttcaccacattctttttgtaaattttttttttttttgagacagagtctcactctgttgcctaggctggagtgcagtggtgcgatcttggctcactgcaacctccgcctccgggttcatgcgattctcctgcctcagcttcctgagtagctgggattacaggtgcctgccaccacgcccggctaattttcatatttttagtagagacggggtttcaccatgttggccaggttggtcaagaactcccgacctcaggcgatctgcccgccttggcctagtgctgggattacaggcataagccaccacgcctggccttgtaacatttttttttctttttgtagagatgtggggggtctcactatgttgcccaggctgctctcgaactcctgaactcaagtgatcctcccacttaggcctcccaaacatgctaggattacaggcatgtgccactgtgactggtccacattcttaaaagtagcctaaaaatttttgtagaatgaggtgaagtaaaaatttaagaagaaagaaaagtaggtaacccgacccatctatatataacttccggatatattgtgagcaacactgtaaattatgagttgaacacaacaaaaatcaagcccttcacaaagtattgcctagggactcatcaaacatatagaggccaaaggagagtcaaatctgggacagtttgaatatcataatgataataatggataatatattaaaaatagtaatacttgactttgatgaggaatggactttatagagtttcaaagtaacttcccataaaatacacatacattacaaagtgaaaaaaaaagagtaaagagtaactttgtagtgtgagaaacctggaagaactacctcaagtgatcacagtgaacatcatgagtaacaggacaaactgaaatcgcatgccacatgacaagcgcacagtgtcactttgtaatctgccaaagatgcataacttgagtctaatcacaaggaaaacatcagacacatccacactcaaggaattttacaaagtaactggcctgaaaccttcacaagtgtcaaaagtcaaacctgaagaaatgttccacgcttaaaagagattaaagaatgtagcaactaactgcagtggcctccttttaaagcagtggtccccaaccttttaggctcaggcactggtttcgtggaagataatttttccacagacagggtcaggggaggtggtttcaggaagaaactgttccacctcagatcatcaggcatcagattctcataaggagggtacaacctaggtccctcaagtgcacagttcacaacagggttcacgcttctatgaaagtctaatgctgccactgatctaacaggaggtggagctaaggcagtaatgctcgctcgcccaccactaacctcccactgtgcgtcctggttcctaacaggagacagataggtacctgtctccaacctgggggttagggacctgttttaaaggacattatcaggacaactagaggaacgtgaatggaggaggattagatggcagtgatgtatcaatgtattaattccctgactttgatggtgggttatgtaggagaatatcttcaagtgtagaaaatacacatgacagtatttgggagtgatagggcatcaggttggcacttattcctagatggttgtggaaggcgggggaggagatctctgtaacttttctgtatagtcaaaatagttcaaagtaaaagttttatttgaaaaatgtaacagtcattttatttcagcagtttaaaaattgtcctttttcttaaagaggaagaaggcattttcacacaaggctggccagatgggaagaatcttcagcttcagcttcagcttggcctcattcatttgaaaataaaatgtttacatgaggccgcgcctgtgtccagctgaaagtgggtccttcagagcgtgtgggggattctctgccggcttgatgggctagctcctctaagccggctgctggagacatcaccggctgagggactcctgcaaacgttcatacatgatttgatcctgaaaggagggagaacacagaatacagagaccgtcactgcttgttttgggctgaatggtgccccccaaaattcacatgctgcagtccgcacccgcaggacctcagaatgtgattgtaactggagagagggtctttatagaggagactggattaaaatgaggtcatacaggtagactcttatccaatatgactgctctccttacaaaaagaggggattagggcacaggagggaagagcatgtgcgcagagggaaaagcacatgcaggcgctgggagaagacagccatcagtgaggacaaaggctccagaagaaccaatcctgcccaacactctccagaactgtgagaaaataaattttccactttttaagccacccagtctgtggtactttgtcatagtagctcctgctgactaacttactgttgaagagaggtgatattttaccttcctgcatctaaatcctaatctaaatcctacacatgctcctttccacaggggactccatgacattcacaatcgttgactcaagttttcctaaaaaatcaggtcaagagtcttatgtctatctaattagtgaagaaagcacaattctaaactacactgaatccagatggaaaggaggcaaaggcagaagcttctttttttgttttttgaaacggagtctcactctgtcgcccaggctggaatgcagcggtgcaatctcggctcactgcaatctctgcctcctgggttcaagggattcccctgcctcggcctcctgagtagctggaactacaggtgcgcaccactacgcccggcaaattttttgcattttagtagagatggggtttcaccatgttggccaggatggtctcaaactcctgacctcatgatccacccgcctcggcctctcaaagtgctgggattacaggtgtgagccactgcgccaggccgggaaagtagaagcttcttacactacattaacattcataagaaactgccagaatgggccgggcgcggtggctcacacctgtaatcccagcactttgggaggctgagatgggtggatcacgaggtcaggagatcgagaccatcctggctaacatggtgaaaccctgtctctacaaaaatacaaaaaaattagctgggcatggtggcgggcgcctgtagtcccagctactcgggaggctgaggcaggagaatggtgtgaacctgggaggcggagcttgcagtgagccgagatcgcgccattgcgacagagcgagactccgtctcaaaaaaaaaaaaaaaaaaaaaagaaattgccagaatgttttccagtgtggttgtatctacattttcagcaacaatgtataagagttccaggccaggcgtggtggctcaggcctgtaacccagcactttgggaggctgaggcgggccaatcacctgaggttgggagttggagaccaggctgaccaacatggagaaaccctgtctctactaaaaatacaaaaaattagccgggtgtggtggcacatgcctgtaatcccagctactcgggaggctgaagcaggagaatagcttgaactcaggaggcagaggttgtggtgagctgcgattgtgccattgcattccagcctgggcaacaagagtgaaactctgtctcaaaaaaataaataaataaataaataaataaaaagagttccagctgtttcatatccttgccaccatttagtgttgccaatattttaaattttagtcattgtggtaggtgtgtagtagaatctcactgtggtcaaattaaaaaaaaatttttttttttgagacggagtctcaatctgtcgcccaggctggagtgcagtggtgcaatcttggctcactgcaacctctgcctcccaggttcaagcgattcttctgcttcagcctcctgagtagctgggactacaggtgcgcagtagctgggactacaggtgcgcgcccagctaatttttgtatttttagtagagatgagatttcactatattggccaggctggtcttgaactcctgacttcgtgatctgcccgcctcagcctcccaaagtgctgggattacagaagtgagccaccgcgtctggcaaattaacattttaaatgttgggtggcaattccactcctgtgtattcatcccaaagaaatacttgaagtgtgttttttcttctgtgtttatttgtttgtttttgagacaaggtttcgttctgtaaccgaggctggagtacaatggtgtgatcatggctcagtgtagcctcaacctcctgggctcaagtaatccttctgcctcggtctcctaagtagctgggactacaggtgcatgacaccatgcctggctaagttttaatttttttgtagagacagggtctcaccatgttgcccaggctgatcttgaactcctgggctcaagccattctcccacctctgcctcctgagtagctgagataacaggcataagcccctgtgcccagctccagagtgatttttttttaacccttctcccacctatggtgaagatgtttttatttccctgaaatgtatgggtaagtccctatggcttagtttgggtacagtctagctccaagaaatacaaagccatttatcaaaaagcgtagagtaggtcaaataatacttgaatcagatgattaaaattctgagattgtgggctgggcgcagtggctcacgcctgtaatcccagcactttgggaggccaaggcgggtggatcacgaggtcaagagtttgagaccagcctcaccaatatggtgaaaccctgtctctactaaaaatacaaaaaattagccaggcatggtggtgcgcacctatagtcccagctactcaggaggctgagacagaagaatcgcttgaacccaggaggcagaggttgcagtgagccaagatcatgccactacactccagactgggtgacagagcgagactctgtctcaaaaaaataaaaaaaaaatctgagattgtggaggcagaagaggtcattctctttctgaataaagttgttagagaatctagttaggaaaactgtgttctagtccctaagaaacatataaaattaaaatctctcaagaacattctcacaaaggcaattattttgcttgttttcagatcaaaatgaaccatgtaatttctttttaggaagtagaagtagtatacaaaacaatctgtaaaagagtttaattcagccgggcgcggtggctcacgcctgtaatcccagcactttgggaggcagagacgggcggatcacgaggtcaggagatcgagaccatcctggctaacatggtgaaaccccgtctctactaaaaatgcaaaaaattagccggggatggtggcgggcacctgtagtcccagctacttgggaggctgaggcaggagaatggtgtgaacccgggaggcagagcttgcagtgagcagagatcgcaccactgcactccagcatggacgacagagcaagactccgtctcaaaaaaaaaaaaaaagagtttaattcatgaggtcatatctactggtctaaaattctagtttcctttctctatgcatttaatggcattgcttaccttttttgatatagatgatcttactttcttgaaagcttcttcaaaatgcttatgactaaccttgagttcacctatggagtaaatgcacaaatatacacatctcagtatcgtatggtaactgacttagaacttaacttcctttgaaagacttcaaaactttcaaggggtccactaaagagatcagtgatgagatgggctctgttctttttcagaacagtattctagccagatatattctgctcatcagattttaatccaaaaccacccaaagagatctgccactcataagttggtaactttttgtaggcctctttgcattgtttaacttaatggtgatgcctatgaacaagagccagaattattcagataattcaaataaatgtaactggaatagaaagtaggattccatagtattaatatttaagagtatgcaacacacaatgagatcttatggagccataatatcatagaatattttatatataatatatctcagcactggtttagaagggagctttaggtcgggcgcggtggctcaggcttgtaatcccagcactttgggaggccgaggtgggcggatcatgagatcaggagttcgagaccagcctgaccaatatggtgaaatcccgtctctactaaaaatacaaaaaaaattaagtgggtgtggtggcacacgcctgtagtcccagctactcgggaagctgaggcaggagaattgcttgaaccaggaggtggaggttgcagtgagccgagatcgcggcactgcactccagcctgggcgacagagcaagactcaagtttagaaaataaataaataaataaataaaaatacagacagggaggccgggcgcagtggctcacacctgtaatcccagcactttgggaggccgaggcaggcggatcacgaagtcaggagatcgagaccatcctggctaacatggtgaaaccccgtctctactaaaaatacaaaaaaaaaaattagtcaggtgtggtggccggcgcctgtaatcctagctacttgggaggctgaggcaggagaatggcatgaacccgagaggcggagcttgcagtgagccaagatcgcgccactgcactccagcctgagtgagagcgagactctgtctcaaaaaaaataaataaataaaaataaaaataacaaaataaaaatagagacagggttttgctctgtcactcaggctggagtgcagtggtgcaatcatagctcattgcagcctcgaactcctgggcctcaccctcccaagtagttaggactataggcatgcaccaccatgccagtctaatttttaaattttttatagagatggcatcttggtttgttgcgcaggctgctctcaaactcctgggctcaagcaatcctcctgccgcagcttcccaaagtgctgggattacagatgtgagtcaccacacccagcagacaatttttttcccccatatgcactcaaataataacattaaagacactgtcaaatgtgaaggatggtgcaaagcttttgagatggccccaaagcatcacataacacaatacacagattttatattttgaaaggaaagtctcaacatatggaaagttattccaaatttcacttctcttgtgtattttctaagctctccaatttaggctgcattttaacaggcaagtagatatcaccttagcaaaagaatacgtttttccagaattgataagcagcccagactcatgatgaagacagcgaatggatccatttgcctatagggacagtactctttattagagaggtactaaataactttgctattattataattgtcagcaacagaggttacctaatatttcagaacagcttctaacagtcttattagaaaaacgttagctttaatatcatagataatagacactagaaaatggtcattttccagggcaacagtggttttaagtatcataattagaattgagagattctggagagaattgtacctttttcatttccactcttctgtcttgccatttcctgtctcagggcacagatagaagcttctcgtaccaaagcagagagatctgcgcccctacaataaaataatagttatctacttattcttagatactgcaaaatcccagaaaaaaacccggaaaacagttttcatataagtcatatattaaataatcaggagaaaaagtgaccaataaagatgagaaataaattgattatcaatcaatagaaaagagctcttagcttttatataagatatttctaggccaggtgcagtggctcacgcctataatcccagcactttgggaggccgaggtgggtggatcacttgaacaggagtttgagactagtctcagcaatatggagaaatgccatatctacaaaactacaaaaaaattagctgggcatggtggcatgcacctgtagtcccaggcactggggaggcttaggtgggaggatcacttgagcccgggaggtggcggttgcaatgagccaagatcgcaccactgcactccagcctgggtaacagagtgagactctgtcccaattaaaaaacaaaaacaaaaaaaaactaaactcaagaagaaaggaaattatggaggaaacaatacaatgcataaagggctaaagtgctgactagcatattcatgtattacataatgtctaaagtaagcttattaaaaagtcatttatgggctgggcgcagtgggtcatgcctgtaattccagcactttgggaggctgagatggcagaattgcttgagcctggggggcaaaggctatagtgagcctgggtgacagagtgagaccctgtctcaagaaaaccccccaaaaagtcacttgtggctccaagttcagaagggaaaaatacaaaccctggaaagtctttaatgcacctgattcaagttaaaactgaatgaacacatcataagttacttaaaatatgacaaatacaaaacaggccttcacttatttaattagttcatgtaataatatgctgagtcagcacagttctgagttcaatgaaagacactcatgttgactggagtttcactacattacagctgtaacagggttcttagagattatatgagaaagagtttgagtttggggataaaaacatcacttctatgattcacaagtcttggaaagaaaagatgaaaatgaaaaataaatttttttaaaaaacctcatctctggacattaaacttattatataatgttgataatccccatactatataacttttttttttttgagatggagtcttgctctgtcaccgaggctggagtgcagtggtgtgatcttggctcaccgcaacctctgcgtcctgggtatgagtgattctcctgcctcagacacatactatataaaagtaaagacccacagagcttaaatttttaactgaatctggtgttttgttggctaaatgttagggttataacattatttaataatcacatacctgctggggtattcattccttcccatactatgaaatctaacattggtggaaacaccattaactaacacaagcagatagctatagactgtagtggtgtagtgtctctcaaactgtaattatagtggcatgaaaatccaaaatgtacaccattcaactttagccctaaccccttcacagactgatagcctacttggtatatccaaaagatttagcccagggcaagttccgccaccaaaatcacctgttactcaccgaaaatcttttcagatttgagcacttaaagctgtattattattattttttttgtagagatggggtcttactatgttgcccaagctggtcttgaactcctggcctcaaacaatctgcctgccttggcctcccaaagggctaggattacaggtgtgagccactgctcccacccttaaagcagtaaactactcaagtagtagtctcctaagcataaggccatttctttatttttaattttatttatttttattttttgagatggagtgtcgctctgttgcccagcctggagtgcagtgacacgatctcagctcactgcaacctccacccgctgggttcaagcaattttcctgtctcagcctccctagtagctgcgattacaggtgtgcactaccatgcccggctaatttttgtagttttagtagagacaaggtttcaccatgttggccaggttggtctcaaatttctgacctcaagtgatctgcccacctcagcctccaaagtgctgggattacaggcgtgagccactgtgcctggccacatcatttaaataaagactcgtatggatttgattcctaattagggggtgaggcacatcctatttaaggggaggtagaggcatttacatctgcccctcaccacccctgcctgagactctgatcagtttctcttcactgagaatcactgctacattggaaggacataatagagaaaaaaaaagggccgggtgtggtggctcactgtaatcccagcactttgggatgctgaggcatgagggactacttaagctcaggagttcatgacaagactgggcaatatggcgagaccctaaaactacaaaaattttttaaaaaaattagctggggatggtagcatgcacctgtagtcccagctatccaggaggctgaggtcagaggattgcttgagcccaggaagtcaaggctacagtgagccatgatcatgccactgtactccagcctgggtgaaagagggaaaccctgtatggaaaaaaaaaaaagaaaaaaaagaaaacaaaaagccggagggggcattgtctctgttagttaaacttgagtttcatttcctccctctgtgtccccaaattgggaaagttaacaaacaaatttacttcaaaacatatgaagaaaaactaataactgtaacaacacaaacataggaaggatgaaggcagaaatgtcagatttcctgatgttactacaggctatgtggaggtgaaaatgcatcctgagggctgcaaaatgtggcacttgtagattagtctcttttaaatgctgacgcaccagtacaatttgtaaaggacagcagtgctggttagggtaggttaagtaccaagagtcaacatatgaaaggactcccctgttcccaggaattccttcagggcctccaaatgtgcagtctcttctctaagaagggagatgccagacactttatgtgcttcatgggatacctcatttaatcctcccaacaatctgctgaggtgagcatcatcacccctcattttatagatgaggaaattgaaccccagagagtgaattgacttaagatttaaacacttacgtatagcaatcacagcgaaggtcaccagcaattgcttccaaatttacatctgcatccagtggtggtttggtaccattctaagtaagagagaaaaatgatttttcattggagctttaaagaccatgccgggtgcgatggctcatgcttgtaatcccagcactttgggaggccaaggtgggcagatcacctgaggtcaggagttcgagaccaacctgtggaacatggtaaaaccccatctctactacaaatacaaaaattagctgggcgttatggtatgcacctgtagtcccagctactcgggaggctgaggcacgagaattgctcaagccctggaggtggaggttgtagtgagcagagatcatgccactgcactccagcctgggcgacagagtgagactgagtctcaaagataaagaccatattcatctacataataggttcttaataatggctgtttgactaaatgagtataactgacttccagactggtgctgttaaggtttatacaaatttcaatgttgagaaatgaggctaagaagcagattccaaacttgagaaagctaaaggcaaacaatttatgctcatgaagtttgaggaatttgtgtacagctgcagcaaatactaaacaccatcaacaagaatgaaaactagcacctcgatctttccaaaggtgaagaaacacatttcctttccagcttaaacatggcaaatacttaagcaatgcttagtgttggtgtgaggctggctaggacggaagaaataatactgaacctggccaggagagaaggagcagtatctgctctaaaataaaagcacaaagcactctaagctcagtatattctttcttaatcatttagctaacactcaatcttgattttggtgccaattccccttcagctcatttcaagacacattagcaatgacaagtatgtaacttagaactcttagaatttctcatgagactggatgtagaggaaaaaaaaccaacccagaattttaacacttaacccagtaacttgcatgcatacattatgtttaataatatttttagtgacaaactgcagaggcaaacaaaacaagctttttcttccctccagggtattgctctgtcgcccaggcaggagtgagtggaacaaccacaacagacttgacctcctcggcacaagagatccttctacctcagcctcccgaggagctggaactacatgccaccatgcctggctacttttttttttttttgagacagtctcgctctggagtgcagtggtgcgatcttggctcactgcaacctctgtctcctaggagcgatggggtggcgtgtgcctgtaatcccagctactcgggacactgaggcaggagaatcactggaacccgggaggtggaggctgtagtaagccatgatcgcaccattgcactccagcctgggtgacagttggagagttggagacttggtttcaaaaaaaaaaaaaaaaaaaaaaaagaagaaacacacacaaaagtgaataaacacaagccattaagcttttctcttttctttttttttctttgagacagggtctggctctgtcatccaggcttagtgcaatggcgcaatctcagcttactgcaacctccacctcccgggctcaagccatcctcccacctcagcctcttgggtagctgggactataggcacccaccacacacctggctaatttttgtattttttgtagagatggggtttcacgatgttgcccaggctgatctcaaactcctcagctcaagcgatctgcccgccttggccacccgaagtgctgagattacaggtgagggccacagcacctgcccagtaagcttttcttagtgtaaaacgtcagcctggcaaagtgctccaggcacagggttcggcgacctggctgagaggactggagctgccggccttgtgcactagttacctgttgctctgcccacactcacataccagcgtctcactgcctcccagcagggcatgttcaagaactgcataaattatacatctgttagttgctatcactaaataaaatggacatgttatctaccacaggttcaagaaacagttaatttcccattcaatccattttgacctgggacacaaactatgatcttaggcaaacaatcttgtgcttttttctctaagtaataaaactaaagggtcagaatgtaggattgctaagcatcttttagtgtaaacaattttcaaccgagtcaggatagtggtcaatcctgggggcaggtagaagtgggtagtggctggaagtagaagggcagcttttgtcggtgtgggaatgttctattttattgtggcaaaacatacaaaaaactgaccatttcaaccatttttctgtgtacaggtcagtggcattaagtccatccacattgttgtatcacccctatccggctccagaactcttttatcttcccaaagaaaacaatgcatccattaaacactaactccccattcttcctgcccccgcctcccaacctctggcagtcaccattgtacttcatagttctatgaattagacttggagtgttctctttcttgatctggagactttgtaacaattcatggagctggacatttaccactttttaatttctttcttgaatctctaaatctactttacatttaccacttttctgtaggtgtatcatacttcaataaaaagacctaaacagtgcaagtaacactgggcgaggaattagaaaacctgagttctaaagttcaaatttgcaactgaatggcccttatagaactttgttaatctttattatttaattttttaaagtatcttaatagataagtatcttatttccagatgagtatatataattttgtgctatatttgagaggggaggggggcatcagtgaacatataatagtgatttcttaaaatgaagactagcgtagactttcttgctatggtggtggggctgccacattatgtaggagcccttgttaggtgctttctatgattttaagaacctatcaacttacctcgactgtcacactgtcacattaactgtacggatcttccctaaggacactccgcgtgctgttagacaatctaatctcaaactatccagtgccctgttttaatcaaaagctgaatcataagaagacaattcttttatacttctcaatatctaaattctacccttgggttaagctggacctccacaaggtcctgtgcatcctcagagtgcatttcttggaccttcatcaaattgtatttaatgaactggctttgtgtaataccctcagtttatattaagaaaatgacaagcctcagtcccaagaggcttattgtgtttgtgtcagaaataccgttaaagacattgtgcatcgcatcttagtgttctctttgtgaggacccagaggaggaatttttcttttttctgtctcgctgtgtcaccaggctggagtgcagtgacgcaatctcggctcactgcaacttacgcctcccaggttcaagcgattctcctgcctcagccccgagtagctgggattacaggcatgcgctaccacgctgggtaattttttttttttttttttttttgagacggagtctcactgtcacaggcccaggctggagtgcagtggtgcgatctcagctcactgcaacctccgcccctcaggttcaagcgattctcctgcctcagccccccaagtagctgggattacagttgcccgccaccacgcctggctaattttttgtatttttagtagagatggggtttcaccatgttgtccaggctggtcttgaacttctgacctcaggtgatccacccaccttggcctcccaaagtgctaggattacaggcgtgagccaccgtgcccagccaacgctgggtagtttttgtattttagtagagacggggtttcaccatgttggtcaggctggtctcaaactcctgaccttgtgatctgcccgcctccgcctcccaaagtgctgggattacaggcgtgagccacagcgcccagcagaggaggaattttcctcacatttgcataatgggagcaattgtcagcttcctattcttagcatatcctttgtttaagaaaaatcttttgtgaaagaaagctcagtatataaaggaacacaataaataaatgaggtggggtatgaacttcacaaaacgaattcactgttatatgtttagatactctcagaagtttcctaattcttagaagattaaacctttagaaaaagaaataatttcaagtaccctcacttgaaagaaagtaacaaactgtcctttttttttttttttttttttttttgagacagagtctcgccctgtggcccaggctggagtgtgatggcatgatctcggctcactgcaagctccgcctcccgggttcaagagattctcctgcctcagcttcccaagtagctgggattacagatgtacaccaccatacccggctaattttttgtatgtttagtagagatgggtttcaccatgttggccaggctggtctcaaactcctgacctggtgatccacccaccttggcctcccaaagtgctgggattacaggcacaagctaccacgctcagccaaactctcctttttttgagggcatgaggtgtgctctacctaggatacctccaaaagtttcattagcaacattactttctaattagtagaaataagggctaaggaatctttggatcactgaaatctaactattctttaattgaaatgtggttatgtttctgacttatagtaagaactaaaatgaattctatttattctcaagtgagagcaaagagaaaaattttaaatggcataataaagagcttataaaacaaaatatgaggattttggaaaatcatttattgaaatggtactaggatatttagaagtatttagaagcttaaattaatttggtttttctttatgacattatctctattacgataatattatattattttttaataaaggccctaatggaaatctcaaataggttggtaactatagaaagctaagctaaaggaattattagaaaaagaaggaaaatagtctcttaaggaaattataggccaggcgtggtggctcatgcctgtaatctcagcactttgggaggccgaggcgggtggatcacctgaggtcaggagtttgagactagcctggccaatatggtgaaacaccatctctactaaaaatacaaaacttagccaggtgtggtggcagttgcctgtaatcccagctacttgggacactgaggcaggagaatcgcttgaacccgggaagaggaggttgcagtgagctgagatcaaaccactgcactccagcctagggaacaagagtgagacctcgtctcaaaaaaaaaaaaataaaaagaaaaagaaaaacaggtgtggtggcaggcacctgtaatcccagctacttaggaggctcaggcaggagaatcacttgaacctgggaggcagaggttgcagtgagccaagaccacgccattgcactctagcctggacatcaagaccaaaactccgtctcaaaaaaaaaaaaagttatatcccacaaatattgtatgattctacttgtatgaggtacctagaataggcaaagcatagagacagaaagtagaatggtggttgccaggggtagggaagaaggaatgggcagtttgtgtttaatggggacagagtttcagtttgggaagatgcaaaagttctggagatgagtagtggtgatggttgcacaacaatgtgaatgtacttaatgccacagaaatatatacttaaaaatggctaaaatggtaaattttatgttatgtatctatagtattttactaaaatctgaaaaaagttatggctcatttacactgatattttcctataattcgtattaaacattatatgttatgaaatactcaggttcaaaaagtaattcaagatgtgctactacttttattttaacaaatattttcatttggtcatacaaatctattcttttttttttttttttttgagacggagtctcactctatgcccaggctgtgcagtggcgtgatctcacttcactaggttcaagcgattctcctgcctcagccttccgagtagctgggactacaggtgcacgccaccatgcctggccaattttggtattttcagcagagatgggctttcaccatattggtcaagctggtctcaaactcctgacctcaggtgattcacctgcctcggcctcccaaagtgctgggattacaggtgtgagtcaccatgcccaaccaaatttattcttaaatctattcttaactacacatcagagtttagaatcattaatgcttgtttttttttttttttttgagacagagtttcgtcctgttgcccaggctggagtgcaacggcgcgatcttggctcactgcaacctctgcctctgggttcaagcgattctcctgcctcagcctcccgagtagctggaatttacaggtgtgtgccaccgcacccagctacttttgaatgagatcacctcattcaggtgatctgtccgccttggcctcctaaagtgctgggattacaggtgtgagccaccgtacctggccagtaattttatttatttatttattttttattttaaaatccagcttctgcatgaagcaatttttattcacacagtcgactgtgaaaaattaatgaaagggccgggtgtagtggctcagtcttgtaaccctctaccttgggaggctgaggtgggtacatcgcttgagctcaggagttcaaaaccagcctgggcaacatggtgaaaccctgtttctacaaaaaaaaaaaaaaattagctaggcctggtggcacgttcctgtagtcccagctactcagggagcagaggcgggaggatcacttgagcctgggaggttgaggctgcagcgagccaagaccgcaccactgccctccagcctgggtgacagagcaagaccttgtctcaacaacaacaacaacaaaaaagtttgtaaaaagtttgctcatcagtaaaaggaaaatatttaaatattttgtaagacatacacttcaaagggagtttcaaggtttaagcatgtgtataaatgtaaaatgaaaatactacatggaacagagtaagggcttaataaatgttagctattattatatcaggtattcttaagtcatacttttttttttttttttgagatgaggtctcgatctgtcactcaggctggaatgcagtggtacaatctcggctcactgcaacctccacctcccgggttcaagagattctcctgccttagtctcccaagtagctgggattacaggcaccggccaccacacccagctaatttttgtatttttagtagagacgggattttgccattttggccaagtaggtctcgaactcctgaccttgtgattcgcctgtctcagtctcccaaagtgctggattacaggcgtgagccaccacacccggccttgtcactcttttaaagactgtattttatctgaaagtatttggcagatatcaaataatgtttctggttttctgagatattttaatgacacttaaaaggaagtagaagttatgaaaaaaaaatctgggggccgggcgtggtggctcatgcctataatcccagcactttgggaggccaaggagggcggatcacatgaggtcgggagttcgagaccagcctggccaacatggaaaaaccctgtctctactaaaaatacaaaattagctgggcatggtggcagacacctgtaatctcagctatttgggaggctgaggcaggagaatcacttgaacccaggaggcagaggttgcagtgagctgagatcgcaccattgtactccagcctgggcgacaagagcaaaactccgtctcaaaaaaaaaaatttctacttctcaggcagcttttagtgatagacctcttatcaccacatcatcactagaaataccaaataaaaaatataaaaaagtagtatatggctcgctcttttttatttgaggtggagtctccctctgttgcccaggctggagtgcagtggcgtgatctcggctcactgcaacctccacctctctgcttcaagtgattcttttgcctcagcctcctgactagctaggactacaggcgcatgccaccacgcccggctaatttttgtatttttagtagagatggggtttcgccatgttggtcaggctggtctccattttttttttttgagatggagtctcactctgttgcccaggctggagtgcagtggcgtaatctcggctcactgcaatccctgcctcttgggttcaagtgattcttttgcctcagcctcctgagtagccgggactacaggcacgcaccaccacgcccagctaatttttatatttttagtagagatggggtttcaccatattggccaggctggtctcgaactcctgacctcgtgatccgcccgccttggcctcccaaagtgctgggattacaggtgtgagccactgtacctggcccactcgctcttcttttacaaaacttagatcccaaaagatatgaagaagttgctttgacctacaaaatatttcagacttttaagaacaggactaaagatctttattctaatctccttataatatttcagatgttaataggagaaagagaaaattgtatataaaacaatctgaggaattaaagtcaaaagccagcaaactgaaataaaaagggtaaacattaaaaatgccaattttcctcactttctgttgacttacaaagaacatacatgggcaggaagtctgccttgtgacttctcccctctgaaattagatattgtgcttcctcttcctctcaatctgccctgctttagccatcaacaaagctttttaaacaaaaacattcatgacctctgaaggatgaggtaagataaggatgtgaaattgcactgctaacagctctcttgagagggcaccaggccaacgcaggcagacagggcacagggaggctgcatgtgggtcctgctcctcctgggcagctctgcccaatgaggttccaagtcttagaataggacacagtcagaattggagcaaaaatgcactctcaagtcaaagagaataaactaacaaaagcccttctgccgttggcacagacagaggctgaggactgactatgcagcagtctaaaccacaatctacaaaagttgcttttggcccagcatggtggctcacacctgtaatcccagcactttgagaggccgaggtgggtggatcaccaggtcaggagttccagaccagcctggccaacatggtgaaacctcatttctctaaaaatacaaaaattagccgggcgtggtagcacgtgcctgtaatcccagctactcgggaggtgggatccgtccaccttggcctcccaaagtgctgggattacaggtgtgagccaccatgcccggccaaagttgacctctattgaaatgtcttttttgatttttttcttcttccatattcacaactttgtgcttggaagctgcagggctcctctctgttacccaccccatttatgccagatgacttttttttttttggagacagagttttgctcttgttgcccaggttggagtgcaatagcacgatctcggctcaccacaacctctgcctcccgggttcaagctaattctcctgctttagcctcctgagtagctgggattacaggagcacaccatcacacccagctaatctttgtatttttgtagagacagtgttttgccatgttggccaggctggtcttgaactcctgacctcaagtgatccacctgcctcggcctcccaaagtgctgggattataggcatgaaccactgtgcctggccgaagtggggtactttaaatattcaccctttggtctgaggcctaatgattttggcaaatagcactgaaattctagatgaatgaagtataaagttgttctggtgtgagtaccatacattgaatgaaacacagcaggaagaatgagccaatcattctctggttccaaatctataaagctctgaataccacatgcctcatgtctggcatgtctagaaataaataccaatccaacttttctctttagttcatgaaatcccaaggacaagtgtgaaagcattatcattatgtcaccatgactacaggaaattcatagaaacaaaattggattatatgtgtgtgcttatttgtatatacatacacatccacatacattgaccaaagcaaacaaaatctcaagaccatagttcctaatgacagagccaagaaggccgggcatggtggctcacgcctgtaatcccagcactttgggaggccgtggtgggcggatcacttgaagtcaggagtttgagaccagcctggctaacatggtaaaaccccgtctctactaaaaatacaaaaaaaaaattagcagagtgtggtggcacgcacctgtggccccagctgcgtggggaggctgaagtaggagatatgcttgaacccaggaggtggaggttgcagtgagctgagatcacgctactgcacttcagcctgggcaacaaacagggtctctttttttgacatactgtgtcaaaaaaaaaaaaaaaaaaacagagccaacgaaagggagagaagatgctatgatgcagtcatcatcaagcttgtttgatgcaaagaaataagtatatgcaaccaaagcagggtttcttaactttggcattactgacattttgagtcggataatacttttttttcctttgagacagggtctcagctctgttgctcaggctggagtgcagtgacgtgaccatggcacactgcagcctcgacttcttggggttaagccatcctcccacctcagcctaccaagtagctgggactacgggtgcatgccactatgcccaactaattaaaaaattttcttggccaggcgcagtggctcacgtttgtaatcccagcactttgggagacttgaggcaggtggatcacgaggtcaggagttcgagaccagcctggccaacgtggtgaaaccccgtctctactaaaaatacaaaaattagctgggcttggtggtgcacgcctgtaatcccagctactcaggaggttgaggcaggagaatcacctgaatgcgggaggtggaggttgcagtgaaccgaggtggcaccactgcactccagcctgggcaacagagtgacactctgtctcaaaaaaaaaaaatttgttttcttgtagagacagggtctcactctgttgcccaggctggtctccaactcctagtctcaagtgatcctcctgtctcagcctcccaaagtgctgggattacaggcctgagccaccatgcctggccttggataattctttgttgttggctgtcctgtgcactgtggaatatttagcagcatgatcactcctctgcgtagtggtaaatgtccctagacattgccaaatgttccctggggacgtgaggtggggtggtgggaaaattgccttaggttgagaactactaaactaaagcaacatgttttcatggctttgaccaccagctatgtcctgaagacagacaaaactatagcccagccagaggactctcctgaactcccaaccacagacccaacatcctgctcaacttttccacttgatagtgcccaggcacctgaaactcagagagctcatctcccagacctctaatcctggtagatgccaccagctgcacaagctgcaaattcatctaccttttcctttaactcccaactctacagttaatccaatgtcctactaattaaaacctttaaacagttctcatgtctatatcttctttgttattcccgtgataatgccttagttcgttattttttctttttcattgatgtttctcagtcatattgccttagttctaacatgcttaatttcataacttttactttactggcttccaagctattttccatactgtgcatcaatagaatctttctaccctacaaagatgatcattcttctgttctcatctgccctgttctccctcctcggggtgatttttaggaacattgctaaaggcagttttaagtaacgatggcccagtgaggcaggatcacagaatcttcctttgtcagcatcaaaagaatactaaaaaaagttaaacaatttaccagtagcaaccaaagaaaggggtaaaccttcatgctgcaaatgttgaaaagtgggtgcgaagagaaaatttgaaagtggctgataattaggcgtccattcctgggaaggagtattgaagaaagaaggtaagttaacaaaatcttgtgatgtctattaatattccaagctggagacaagcagcctgaggagaagatagctctagaaaaagttagacacacacaatcaagggatttcagcagattcaggaagaactgccaaggtatgccactttccagggagctggacagaactgggtacaatcccatgggagtgggacagctcccatggggggaggtatctccaactggatggagagagcgggtccaggtacaagtgatttcatccccagaaggattaacaccaccagcttagctccctctcccatcccaaggctatagaaatgtagaaacaaagcacttctacagacctcaaaatgtgatgtgtgaagggcagaaaaactagttccaggtagtgagaagtgggatgacagaagtcattcaatttttttttttgagagagggtcttggtctgttacccaggcttgagtgcagtagcacgatcttggctgactgcaacctccacttcttgggctcaagggattctccagcctcagccaggcatgagccattgaagtccagctaatttttgtattttttgtagagatggggtttccccatgtttcccaggctgatcttgaactcctgaggtcaaagcaatccacctgccttggcttcccaaagtgctgggatgacaggtgtgagccaacgtgtttggcccacttatttatttatttttaaatatagggtcttgcggggtctggtgcggtggctcacgcctgtaatcccagcactttgggaggccgaggcgggtggatcacgaggtcaggagatcgagaccatcctggctaacacggtaaaaccccgtctctactaaaaaacacaaaaaattagccggacgtggtggcgagcacctgtagtcccagctactcgggaggctgaggcaggagaatggcgtgaacctgggaggcagagcttgcagtgagccaagatcatgccactgcactccagcctgggtgacagagcaagactctgcctcaaaaaaaaggatagggtcttgctctgttgcccaggctggagtacagtggtgtgatcacagctccctgcagccttgacctcctgggctcaagcaatccttccacctaagccttctgagtacatggtcccacaggtgggtgccaccatatctggctaattttttctatcttttgtagagacagagtctcagtatattgcccaggctggtaccaaactcctgggttcacctcgccctcccaaagtgccagtttctccaaaagtttctactccatttcaaatatgatctgatgtaaattattttaaagtaataatcgaagatcagttcaccttccctttgggagatataggctgggcaaacacagctacagaaaagaaagtaatcagtcaacgaaaattactacctcttataactgtctctatttaaaacaagagaaacatatacaaaaatataccatttcctttactcacttttgtgatagtttttaagatggcaaggcgatctgcagggggcggtaaacccacaaacagtgttttgtccaggcggcccgggcgcaggattgcagggtcaattatatctagagaagaagggagaaaaaaagtcttaaataaaaccttttatttttatttttttatttttttgagagagggtcttgttccatctcccaggctggagtgcagtggcatgatctcagctcactgcagcctcgacctcccaggctcagatgattctcccacctcagcctcctgagtagctaagactatagatgcatgctatcatgcctggctaattttttttcttttacttactttaattaattaattaatttttatttcaataggtttttggggaacaggtggtgtctggttacatgagtaagttatttggtggtgatttctgagattttggtgcacccatcactggagcagcatatactgtacccagtgtgcagtcttttatccctcaaccgctcccactctttccctcgagtccacaaaagtccactgtatcattcttatgctttgtgtcctcatagcttagctcccacttatgagtgagcacataagatgtttggctggttaattttttatttttagtagagacaggatttcgctatgttgcccaggctagtcttgaactcccgagtgcaagcaatccgcccttctcggcctcccaaagtgctgggattacagacgtgagccactgtgctcagaccaaataaataaaatcttttaaaaaatgcaattaacggctgggcgcgggggctcacacctgtaatcccagcactttgggaggccaaggcaggcagattacctgaggtcaggagttcgagaccagcctggctaatatggtgaaaccccgtctctgctaaaaatacaaaaattagccaggtgtgatggcacacacctgtaatcccacctactcgggaggctgaggcaggaaaattgcttgagcctgggagatggaggttgcagtgagctgagatcgtgccactgcacttcagcctggccaacagagtgatactgtctcaaaaaaaaaaaaaaaaaaaaagcaattaacatgagatgagaataacctctttataaaaaataaaaaattaataaattgcattttatttaaatgaaaagcttctgctcatcaaaatacatctcttcggctatgcatggtggcagatcacctgaggtcaggagtttgaaaccagcctggccaacatggtgaaaccctgtgcctactaaaaaaaacaaaacattagctgggtgtggtggtccacacctgtaatcccagctacttgtgaggttgaggcagaagaatcacttgaacctgggaggcggaggctgcaatgagcggagatcgtgccactgcactccagcctgggcgacagagcaagactcttgtctcaaaaacaataacaaaaaaacaaaacatgtccttaagtaaatgaaaagtccaccccaccttccggccccaaactgctcttcttccaggattccctatctcagataatgatcaccacaccactccaccccaccctacctcccaaataccaggcaggtttctcccttccctctaaccaatttccatcaagcattcctctgattacgtcaaccctcagtaaaggcaaaatgtgagtcctcctaaatggtcctgcctctagacttcctctctctgggcctctttacaatgccgctagtgttattgtcctaaaatacacgtccaattctctcaaattccgctcccactgcagaatgaatcctccagctgtcactatggcaggaaatccctttaggatctgaccatcttcctttctggttttattcttcctacacattcttccaactcccacgccctgtttacaccagatgtcttgctgttccctaaacaatccagaagcttcttgccttctctgtgctctcagtggttcccttccctgaagtgcctccctcctcatttatacctgtgggaattctcaaaggacacctctttcaggaagttttccttgagtccccccagataaactctctcaccttcctttgtgcttgccagacccttggtatcaggagcacagagcaagccccatacctgaagctcattttgaccattcctgactcctccacaaagaccccatttttaataaaatcacatcatttccaacagtcccttaaccattaatatgagggttcttatagctcacaatgttcagacacaggctataattaatgagattcacgtttctaataaacctactaagacttaaccaatgagttactcctctacaaagaggtaaattattattattccctttttagctaaaattccaaacctgttagatgttgttctttaaccaccttatggaacccatatacttattattcaatggtttcatcactattcagcacattgttggaattctctcttggaatgctaggattccatacttggaaataggaaagaatattactgcataacactttcaatatcatactagagcatggttcaacaagcctaagggtcttctgactctacagagcagaggttgtcaaatattcatgtctcagaatccctttgcactcttaaaaattattgaggactcctttgtaacctttctctcctgcccttacctgctctcctttatccttaggcagccacctatctgttttggcactatagattagtttgcattttctaaagttttatgtaagtggaattatacaatatgtactgtgctttctttcatgcaacataatcattttgggtttcacccaagttgtttcatgtgtcagtaattttcttgtacaagtctttgtatatgcttttttttttaatgacagagtctcactctgtcacccaggctagagtgcagtggggcgatctcggctcattgcaacctctgcctcctgggttcaagcagttctctgcatcagcctcccaagtagctgagattacaagtgtgcccccctgccccccacgcccggctaagttttctatttttagtagagacagggtttcaccatcttggccaggctggtcttgagctcctgacctcatgatccacccgccttagcctcccgaagtgctgggattacaggcctgagccacggctcccaggctgtatatgctttcatttctcttcagtaaattacctaagtgtaagataccagtagtatggccatatcaaactgtaggtatatgcttaacttttaagaaattgctggccgggtggagtggctcacgcctgtaatcccagcactttgggaggctgaggcgggaggatcacaaggtcaagagattgagaccatcctggccaacatggtgaaaccccgtctctactaaaaatacaaaaattagctaggcgtggtggcacatgcctgtaatctcagctattcaggaggctgaggcaggagaatcacttgaactcaggaggcggaggttgcagtgagccgagatcaggccactgcactccagccttgggacagagcaaggctcggtctcaaaaaaaaaaaaaaaaagaaaagaaaaaaagaaattgccaaactgttttccaaactacttgtaccattacattcccatcatcagtgcatgaaagttccagttcctccatatccttgccaacatttggcacagccagtcttttcaatcttttagttattctaaggtttgtagtgcttactgtggctttaatttgcatttccctagtgactaatggtgtgaagcatttttcatgagtttgccatttgtacacctcctatggtgaagtaactgtacaaatcttttggccatttttatgtttaaagttgattaaataattttgtaaactgacaaagaaaaatggtatatatttaggttgtacaacatgtttttttttgttttgagatggagtctcactctgtcgcccaggctggagtgcagtggcatgatctcagctcactgcaacctctgcctcccgggttcaagttcattctcctgcctcagcctcctgagcagctgggattacaggtgaccaccaccatgcccggctaacttttgtatttttagtagagacggggtttcaccatattggtcaggctggtctcgaactcctgacctcgtgatccacctgccttggcctcccaaagtgctaggattacaggcatgagccacagtgcctggcatttttttttttttttttttgagatggagttttgctcttgttgcccaggctggagtgcaatggcgcaatctcagctcaccgcaacctctacctcctggattcaagtgattctcctgcgtcagcctcccaagtagctgggattacaggcatgcaccaccatgcccggctaatttgttttttttgttttttttttttttgtatttttagtagaaacagggtttctccatgttggtcaggctggtctcgaactcccaacctcaggtgatctgctcatctcggcctcccaaagtggtgggattacaggcgtgagccactgtgcctggccaacatgtgtttttaaaatgtgtatacattgtggaatggccaagttgagacaactgacacaggcattacctcatattcttattactttttttgtggtagatcacttaaaatctactttcttggcaattttcaagtaccttttggctacttttaaaatggtgtagttttttttttttttttttgagacggagtctctgtcgccaggctggagtacagtggcatgaccttggctcactgaaacctcaactcccaggttcaagcgattctcctgcctcagcctcccaagtagctgggattccaggcatgcaccaccacactcagctactttttgtatttttggtagagacgggatttcaccatgttggctaggatggtctcgatctcctgacctcatgatccgtctgcctcggttcccaaagtgctgggattacaggcatgagccaatgtgcctggcccaaaatggtgtaggttttttttttttttttttttttcctgagacagggtctcgctctgccgtccaggctggaatgcagtggtgcgatcttggctcacggcaagctccacctccctggttctcgccattctcctgcctcagcctccagagtagctgggacttacaggtgcccaccaccatgctcagctaatttcttttgtatttttagtagagacggagtttcaccatgttagccaggttggtctcgatctcctgaccttgtgatccgcccacctgggcctcccaaagtgctgggattacaggcgtgagccaccgcgcctggcctaaaatggtgtagtttttaatcctttatcagatatatgctttgcaaatattttctcctagtctgtggtttatctttatattctcttatttgcatttttgtaagagactgggtctcactacactgcccaggctggcctcgaagtgctgagctcaaaggatcctcccacctcagtctcctgagtagctgggtttacaggcgtgtaccactgtacctggcttattggcacttttgaagagcagttcagtttatctatttgctcttttatggtttacgcttttaatatcatataggaaatctttgcttaattcaaggtagaaaaaaatttctccagtgttttcttccaagagttttataatgttgttttcaatggtctttgattcattttgagttattttttgtatgtggtaaaaggtatgaattaaggttcaatttttctttttgcatatggatattcagttgctccagtaccattgttgaaaagactatacattctccactgcattgcctttgtgctttttaaatacatcaactatctagatatgcataggaatatttctggattttttttctgttccttttatttatctgtctcagctctatgccaattaccatgccgttgaaacatcttttaatttaaacatataaatacatgccaggcatggtggctcatgcctgtaatcccagcactttgggaggctgaggcgggtggatcacttgaggtcaggagttcgagaccagcttggccaacatggtgaaactccataactactgaaaataaaaaaattagctgagcatggtgttgcatgcctgcaatcccagctactcgggaggctaaggcaggagaatcgcttgaacctgggaagcggaggttgcagtgagccaagatcgtgctactgcactccagcctgggcaacagggtgaggctccatctaaaaaaaaaaaaaaaaaaaaaaaacccacagaaaactccccacaaaacacatcttaaagccagttctacatgccccaaggtaaaggggaatactgatgataattataaagcattcttagtttgggagtcctataatcacttaacatctctgacaaatatcacacttaatattatgcagtttattattttaataagttatttacagtaaaaggcattctggacactttatataaattttagtattagatgacttaaactacacttcactaaaggctcctgcaagattctatgtattacatcattagaaatgagatgctaatctcttcctagctcttccctaaacaggcccctaccattgtctttcccgtcttagttaatgtgaactcattctcccggtttttcaggcccagaccttggagccatgcttgattccactttcccacatccttaactactccattagcaaatcaggtcaaccctatgacacaatatattcagattccttctacatccacagctatcacccggctcaaaccaccaccaccttgcacctgcattattcttacagcttcccaactggttccctatctaattatgtcagagacagaattctttttttttccttttgccctctcaacccagcttttcccaactttgggaaatctgggaagagaaagcctaagagacagaattcttaggtagaagacaaaaaataacaattctgatatttacaataaaaatggcactaacaatcccagcactttaaagagaaagtgcattcactcacaaatgagatggttgcctgaaaaagaaccctcctttcatctgttgataagcagcacctactgttctttataaagcacctacctcccctcaaaaaagctattacagcttgccatgggtaaaaaacattaattaaaaaagaaaaaaaaagttaaaattgagaggtaacagtagcaacttttaactttaggaaaacattattttgttataaatggaccctcaatttttaacaaaggtaacaagacaattcaatgggggactaattaatctttgcaacaaaggtgctaggacaagtggttttttgtttgtctgtttgtttgtttgtttgtttctttttttggagacagggtctcactctgtagcgcaggctggagtgcagtggtgtatcatagctcactgcagccttgatctccgggactcaagcaatcctcccgccatagcctcccaagtagctaagactacaggcatgcaccaccatgcccatttaattttgttttgtttttgtgtattttttgtagagatgaggtctcactatgttgcccaggctggtcttgaactcctgagctcaaacaatcctcccatgttggcctcccaaagtgctgggattacaggcatgagtcactgcactgggcccgacaagggatattgacactcaaaagaatcaatttgcacactttcctcacaacacgcaacaaattaactcaaaatggatcaaagacctaaatgtaagagctaaaattttatgagaagaaaatgcaggagttaattttagtgaccttcggttaggcaatgatttttacaccattgataacaccatcaaaattgcaagcggtaaaagacaaacacataaattggaatttatcaaaattaaaaacttgtgtttcaaatgacatcaaaaaagtgaatagacaacccacagattggtgaaaacatatgtagatcacatatctgattttagatttgtatctagaacaaagaactcttactactcaatgacaaggcaaataacctaattgaaaaatgaccagacatatctccaaagaagacatacaaatgaccaacaagcacaataaaagatgctcaacactatcagttatcagggaaatgcaaatcaaatcagaatgaaataccacctcacatccactagaataactataataaaaaaagacaataacaggtattagtaagaatgtgaataaatcagaactgtcatatattttaatgtcaaaattactagtgggaatataaaaatgatgcagccactttggaaaagagtttagcagtttctcaaaatgttaaacagggagttaccatatgatccagcaattccactcctaggtatagacccaggagaaattaaaacatatgtccatacaaaaatgcatacatgaatgttcatagcagcattattcataatagccaaaaaacagaaacagcccagatgtccaactggtgaatacacaaaatgtggtatatccatacaacgggatattatttcataataaaaaggaatggagtattgatacattctataatatgaataaatcttgaaaacattatgctaaagaagccagatttaagagccctcatattgtataatgctatttacataaaatatccagaatagacaaatttatatagacagaaagtagatgatggccagtagcgacacatgcctaaaacctcagtactttgagaggccaaggcagggggcatgctgcaggccaggagtgcgagaccaacctggttaacatgagaccctgtctctacattaaaaaaaaaaaaaaaaaaaaaaaaggaaagtagattagtggttgcctaaggctggagatgagaaaaggaaaactgaatgctaacaggcatgagattttttaagggtgatgaacatttttttttttttgagatagggtctcactctgttgcccaagctggagtgtagtggcacaatctcggctcactgcaacctctgccttctaggttcaagcgattctcctgcctcagcctcctaagtagctgggactctaggtgcgcaccaccatgccctgctaaattttgtatgtttttggtagagacgaggcttcactgtgttggccaggctggtctcaaactcctggcctcaagtggtccactcgcctcagcctcccaaagtgctgggattacaggcatgagccacacatggcccaggtgatgcaaatattctaagattagattgttgggatggctgtaaagctatgtaaatatactcaaaaccattgaatgatatacttaaaatgggtaaattttacgatatgccacttacatctcagtaaagctttttaaaaaaatgaatcctcagactagcaacactataaatatatccattgaaaataattacaagatcagacaaccttcatgaaataggtttctactcatgattcattaaacaaataataataataagaatgatgttttttgtttgtttgttttgagacagagtctccttctgttgcccaagctggagtgcagtggcacaatctccgctcattacaactttcactttccaggttcaagcaattcttgtgcctcagcctcccaagtagctgggattacaggtgtgtgccaccatacccagctaactttttttttttttttttgtatttttagtagagacgagatttttgccacgttaacccaggttggtctcaaactcctggcctcaagtgatctgctcacctcagcctcccaaagcgctgggattacaggcatgagccatcgcatccagccgtaaacaaataattattgagctctactacatatcatagcatctataactcagccaaagttctggctgggcataacctaattttaaaagggcagtactgtgccaaagggcaaaacatacagggttgaccatggcaccaagtcattgttcaattaccttcaaatgcattcaacaatgacccaaagcatccagactagatgtgtaaggaaacactctatttagcttggaacttcagtggtaaatatcttagtacaatgaaataaataccttctctgtgagtcatccactctttcatctgataattactattattttttgagacggagtcttgctctgtcaccaggctgaagtgcagtggcgcgatcactacaacctccacctcccgagttccagcgattctcctgcctcagtctcctgagtagctgggactacaggcacgcgccaccatggccagctaatttttgtattttcagtagagacgggtttcaccatgttggccaggatagtctcgatctcctaacctcgtgatgtgtctgcctcagccttccaaagtgctgggattacaggcatgagccaacacacccagccttcatctgataattattaaacgcttagaatgggcagagcctctaactagaacctatctctcagatataaaagtgcagaatgaatccctgccctgcagaagcttgcacatctaatcataatttgcttatttatttcttcttttccttttttttttttttttttttgagacagggtcttgctctgtcatccaggctggagtgcagtggtgcaatcatagctcactgtggcctcaaacttctagtttcaagtgatcctcctgcctcagcttcccaagtagctgggattacaggtacacaccagtgcatctggctaatttttatttttattttatattttttgagacagagtcttgctctgtcacccaggctggagtgcagtggcgtgatctcggctcactgcaacctctgcctcctgagttcaagcgattcttctgcctcagcctcccgagtagctgggactatgggcacgtgctaccacgcccagctgatttttttatttttagtagagacggggtttcaccatgttggccaggctggtctcgaactcctgacctcatgatctgcccgcctcggcctcccgaagtgttgggattacaggtgtgagccactgcacctggcctaatttttattttgtagagatggggtcttgctttgttgcccaggctaatcttgaactcctagccttaagagatcctcttgcctcagcctcccaaagtgctgggattacaggtgtgagccaccacacttggcccttatttattttttcaactgagccatgcatagaaggcagaaactctttctggattatactactggtagaaaatacgtaattattgagtagaagagaaagtaataagatatttgggtttcataattgtgcaggaatatcttttttaaacagctagataatagattaagggggaacaggtagttccctaactgagaacatcgtttactggagttggtatgtgaaaaagagaatgcaaagatgtgcataggagagactaaggttagggtacaaagaactgcatttcctctggttaagcaaaaggaagttcgcttatttccagaagaagatgtggactttgatatagcacacattagaagagggctagggctatgcacggtggttcacacctgtaatcccagcacattgtgaggctgaggtgggaggatcgcttgagcccaggagtttgagaccagcctgggcaacatagtgagacgtcatctctacaaaaaagttttttttttttttaattagctgggtgtagtggtgcgtgcctgtagtcccagctacgtgagaggctgaggtgggatgatctcttgagcctaggaggttgaggctgcagtgagtggtgattgcactactgcactctagcctaggctatagagtgagaccctgtctcaaaaatacaaataaataaattaaataaaagaagagggctgtcccagttcttcagaataaccaaaggtggaatggtgagaggacagtattttcatttactttctaagcattaatacctcaataattgggaaaaaaattaaaggcaagaagatgaaaaataagaaaaaagaggacatttaggagatcagtccaggagggtttaagatccaagtgctaagcacacaaattaaacaaacaaacaaaaagtcacatagaaggaatgagaatgacatggaacctttaaaagaaaaaaagcaatgtctataaattatgaagaaaaataattttaaactcaaaattatatcccagctaggttactaatcaaaattagggtggaataaagatatttttaaatataaaagaactatgggggatggtctcacatttggaaaaacaaatcaaatatacaagcagtcaaaaaaatctacttcctacataatctttcttagaaaagccactgaaagataagtaccagcaaaatgagggtgtaagcaagataaaaaaagtacacacaaaaaacccatgagatcagaaaaaaagggcaaacaaaggagaacagtcaaggaagtcctgaaataacagctgtttagaccacaggcctaaagcaaccagtccagattagagccaggaaggtggaaagctccagagggaggtctccagaaacaaacaaacaaatggaactggtacatcgtttgaataaataacatcgacagctgtataaaatatgtgatgaacagtaacagaaaacaaagcaaaagaaaaaaatgagggccactgaatccaaggacaagagttatatgagaaaggaaacctaatcagtgtcatgcttgggtcagcagagagaaatagtgacacagccatagtaatgtaaacactagtgacttaaccaagagttctgatcaaactatattacaatactgggagaatggggaagaggacagatgatgtggcagtgatggtgggagtggagggtatggagaaagggtgaacataagataactaaatcttcatctaccttaaaatgaagttaatgggcagtgtttaaaattgataagaaatagccataagagcatatttgaaaatatgaaggaaaaaaatagctcaagtggttgcctctgggcaggggattagaagggatgggagagaaaactacagtttttgttataagcttttcctgccatttgatttgaaactgggtccctccctctatatgtcaaaattacaactggagatgagatttgggtggggacacagagccaaaccatatcactcaccaaggttcaacttttgcacacatgtagttttctcgtagggctgttgtgaggtttacaatggtaaagcatccaacagagggcctggcacttagtaggtgctccaagaacctagttgttattactggtgattgttttaaataatatggacttgtaaagaaaatgaaataaacttattttcatctccttgaacagacattttagaaaagttggtctttttctaaagtgtcctttttctccaagtgtcccctatctcagaagtggcaaaacattttacccagtataggtaaaacaatctaacaataagaatagcccttatttattttctttctcttatcccacatctaattccagaaaatcctattagttttactttcaaaatgtgtctcaaattttaccacttcttacttctcccattaagctcacacaaattctccatggactgtagatcttctggctcagagtatcttttgtgtcaaggacttctttggaatacagaaagtttatagactgcttcttaaacatttttcaatgtataaagtaaaaacatcagaaagattacaaggtgaaaccccatctctactaaaaatacaaaattagccgggtgtggtggcacatgcctgtaatcccagctactcgggaggctgaggcaggagaatcacttgaacctgggaggcagaagttgcggtgagccgagatcatgccactgcgctccagtctgggcgacagagcaagattccgtctcaaaaacaaacaaacaaacaaacaaactccaaaaagattataattatttggcagccgggttgggagagagaccaaggattgtgaagacattgtgagtaaagaggccactgtggaaatggattctctggtccagccactccagctgatagtacgtggatccaagatgaaccacccagacaagcccatcccaaattcctgacctaaaaattgtgagccaaataaaaatggtgatttttttttttttttgtgagatggagtctcactctgtcgcccaggctggaatgcagtggtgctatctgggctcactgcaacctccgcctcctgggttcaagtgattctccttcctgcctcagcctcctgagtagccgggattgcaggcgcccaccaccacgcccaattaatttttgtattattagtagagatggagcttcaccatgttgagcaggctggtcttgaactctttacctcaagtgatccttggcttcccacagtgctgggattacaggtgtgagtcactgcatccagccacaaatggtgattttaaagcactaagctttacagtagtttgttatgcagcaacggctaaccagaacatcaagcaagaagggaattcttaaagctaagcagagaagttataagcaatcaaaacaatgtcacgtgatagtatacaatggagcagaactgccaaataagcatgaaaacaagtgaagaagatctagaacgtttattattattattattttttgagacagagtctcgctttgtcactcaggctggagtgcagtggtgcaatctcggctcactgcaacctccgcttcccgggttcaagtgattctcctgcctcagcctcagcctcgcaagtagctgggactacaggtgtgtgccaccatgcccggctaatcttttttaatttttagtagagacggggtttcaccatgttagctgatggtctcgatcttctaaccttgtgatccgccggcctcggcctcccaaagtgttgggattacaggtgtgagccaccgtgcccggccagaacatttatttttaaatgtaggtcgttaatgcaacagatttgttacaggggaaaaaaggatggaagagttttaggggaagacaatatacacacatagggaaaaaacaaaacaccggtaccacattatgattcatctgccatttctgccattcttaacacaggttttaaaataaacaggccaggcgcagtggctcatgcctgtaatcccagcactttgggaggccgaggaaggcagatcctctgaggtcaggagccgagaccaggctggccagcatggtgaaaccctgtctctactaaaaatacaaaaattagctaggcgtagtggcacgtgcctgtagtcccagctacttgggaggctgagggagaagaaatctttgaacccaggaggcagaggttgcaaggagctgagatcacaccactgcactccagcctgggcagtagaccaagactctgtctcaaaataaataaataaataataaaataaaataaacaaacttaaaatatggtgcgggctgttaacgatagaataggttattacaggaaacgaaagattgatgctgtggtttgaacgtattccccaaatttcacgtgttggaaacttaatccccaataaaacagtgttgagatgtgggacctttaaaaggtgattaggtcatgagggctctgccctcatgaatgatgctggtttcaagagagtgggtaagttattacaggagtggactcttgataaaaggatatgtttcgccactctcactattttttaaataatagagacaaggtctcactatgttgcccaggctggtcttaaactcccaagctcaagcgatcctcctgtctcaacctcgtaaagtgctaggattacaggcataagccaccatgcccagcttggccactttctttcttttttaatgtctactcatttgttaactatgtttctgtatgatgttattaatatactgcacatatgacaagtcatacatcaaaaccagatagtacaaacaattaaacagataataattttagcattttctgtctcaccactaacagatattaagcccatccttactaatttatgctcctcactttaaaaaggatgatcatatactggaaaaaactggatcaatgtatttcttcaatgaggcttttttgagagaaacagggccctcatttcctactccccaggatcccccctctctctgcttctttcttctccagacttcctccagtgaaactaatcttttgctatacaaaatgctttttggtaggctgaagaaaacagttgtttagctcaggcagttgagataaatgtccaaagatagggtaaaattaattaaactttatttgtccacctttactcatgggaccatggtttcttcctgtccaggccactttccttttgctctctcatgcatgctcttgtgctcttctaccctttcgccttggggtgatgcagcaagaaggcccttgacagatgcaggccactcagccttgaccttcccagcttcctgaactagaagaactgaatctcttttctttttaacacaaattacccagtttcaggtattctgttacagcaaaacaaaacagactaagacaagcatcttcttgaaatatgtgagaaaagatctgtatctgcttatgaaagggacgatgtgattctgttcaactctgagggactttcttctaggatgactctgtgattttatgacctaatgactgttcccactactattaccaaactgcttatgaacatgataacaattactaaatagctacgtgctgtttaacaccactgtggcagatacattaccaacatcatttaacttttgtggcaatcctgccaattaagtattatcatcttcatttaaaaagtgccaaaatgatggtcagcaagataaagtaatatagtcccaaggttactatggtataatacagaatataactggtctttgcccacctttcctggcatagatcttcaaaaatccttgcaatttcctgagtgccaggaatatctttgttgagctaatgtggtgacgcatagtggccccacagatagcttcgggcaggggactgatcaccagaaagatcaagcatgtgattagagttgtaactccgagccatcttctgcacttctgtagtcttgagcccttttctgaatccctcaaagaatgcttaaccttgaaaacaattttcagtaattattcagggcagatataggggcatggctccagcataaaatcctaaaaatctatctttaacttctactagagtgaagagtctcgtttttgtttcctataagctagagagaaaccacaaaacacaaattctgaaaatacttttgtggtcaaaagtgtatgctggtcgggtgcagtggctcacgtctgtaatcctagcactttgggaggccgaggtgggcagatcacctgaggtcaggagttcaagaccagcctggccaacatggcgaaaccccatctctactaaaaatacaaaaaatagccgggcatggtggcagcacctgtaatcccagctactcaggaggctgaggcaggagaatcacttgaactcaggaggcagaggttgcagtgagccaaggtcatgccactgcatgccagcctgggtgacagagcgagattctgtctcaaaaaaaaaaaaaaaaaaaagtgtatgctgcaactgttctcagccaaaaagagctttctaagcaccgacacagaaaagcaatctcatgggatccaagcagtaatactatactttttactatagcttatgcaaaagctttctaagcctttatttcaactatgaagtttcctttcacagaaccaaaaatggattgcccaaatttaatcttcctttcctaggatgcatgtgaattatattgtttataaatgctactagtttttacttttatttttaattatctgaatctcttctacggaaatgctgtaagtttttagattcatctgtgttacaatatttttatttcttacctggcctgttagtggctgccataataaaaacctgctggcgtgcttccagaccatccatctctgtaagtagctgattcaccactcggacacttgcccctgtctaaaaagacataaatctggttccatcagctctcaatacaaaggaaaaatacccattttcttccacataaaaataatacatttccccatgcaaaggagataacaatgataattttctgaggcgtcactatatgcagacactgtgcaaaatgtgttctcatcagtggacctccccagcaatcctattattatccagtctaaatgaggaaagtgaggcttagagggattatttgtccaagttctcatcactagataaaggaagaaatgagactcaatctcaggctgaatggatcccaaggtctgatgttttcgagttactcaaagatctaaccgtcacaatacacttcccttggggcaaatctacagctagctttcgtttctttggtagagatggggtcttgctatgctgtccaggctggtcgtgacctcctggcctcaagcaatcctcttgcctcagcctcccaaagtgctgggattataggtgtgagccgctgcaccccaccaagactaagcttttttgtttgtttgtttgttttgttttttgagatgaagtttcactcttgttgcccagaatggagtacaatggtgtgatcttggctcactgcaacctccatctcccaggttcaagcaattctcctgcctctgcctcccaagtagctgggattacaggcgtatgccacgatgcctggctaattttgtaatttcagtagagatgcggtttcaccacgttggtcaggctggtcttcaaactcctgacttcaggtgatctgcccacctcggcctcccaaagtgctgggattacaggagtgagccactgcgcccggccctagactaagcttttgaaccccaaatttcccagtatatcaggtattctagatctcattttattttatttttaaagccagtcaaatttaacagtgggaggttgtataccaactttggtgagactaactttttttttttttttttttttgagacagggttttactctgtagccgaggctagagtgtactggtgtgatatcagctcactgcagccttcccctcctgggctcaagcagtcctccgacctcagcctcccaagtagctgggattactggtgtgtgtcaccacgcctggctaattttcatattttttctagagatcctgttgctatattgcccaggctagtctcgaacccctgagctcaaccaatcctcctgccttggcctcccaaagtgctgggattacaggcttgtgccactgcacctggacgacactaatgttaataagttctgataacccaccaccattagacattagaccagccaggtgttccagatctttttagtgcaacacatacaagagtatctgggacactgaggtattttctcttttccttgaagcaaataatacaaagtacagctacctcagcaatatctaagtgaaaggaaacattcagggagttggtataaattcagggagggggataaatcacttagatacagaaacaacaaaaaagttttaaatgaaggaaatgagaaaagtggtgctgtgtttttggtcattaattgcttttcttcaccataaattttatgtacagaggtggtaatgggcttacctcatttctttctttcttttttctttttttttttgagacaggggtcttgttctgtcacccaggctggaagtacagtggtgagatctcagcttactgcaacctctgccttctaggctcaagcaatcctcctacctcagtctcccaagtggctgggactacaggtatgcaccaccacacctggctaatttttctctctttttctttcttttttttttttttgtagagccgggatttcaccatgttgcccttgctggtcttgaactcctggactcaagcaatctgcccacctcggctgcccaaactgctgggattacaggtatgaactaccgcgcccagcttaccccactgatttctctagaaaaaaaaaaattggtgctccttattatcactccttggtaacataacactaacagaatcataatccatactcaaaaatataaggaagtaatgggtaaaaaacattttttctacataagcaagacaaactcagagtcaatacaagaatgactgatagattttgctgcattaaagccataatattctggccgggcattgtggctcacacctgtaatcccagcactttgggaggccgagacatgtgaatcacctgaggtcaggagtgcaagaccagcctggccaacatggcaaaaccccatctctactaaaaatacaaaaaattagctgggcatggtggtgggaacctgtaatcccagctgcacgggaagctgaggcagaagaattgcttgaacccgggaggcggaggctgcagtaagccaagattgcatcattgcattccagcctgggcgacggagtgagactctcaaaacagaaaacaaacaaacaaacaaacaaaacctataatattctatataataaaattaaatataagtcataagactgggaaaaatagtgtcaacacataattaaataaaagactactttccatcatagagtaccaattaatgtaaaaaaagaaaaagacagcaatagcaaaagggttgaaagataagatcaaataatttcaaatcactggagatagtcaacctcatggtaatcagggacatgtatactaaaatgtaatatgatttgccaataaaactgccaaaaaataaaaagacaggtataatccattgttgataggaaatggttattttcacacactgttggtgggcacatgtaactgacagtttttgtgaaggatgatacagcattatttttcaaaatctaatatatatcaatcttcaaccctgattttcacttccaaaaatctatctcatatagtcccatcacaggtgcacaaaaatacgtgaaacaagttcagcagagttctatttacaactggaaacaatctaaatgtccaaaacaggagaattattatgtaaattctgctgtatccagactattatacaatatctatttttaagttattacgtacatgagaaagtcatcaagacagaatgaccacatttatataaaaaatagaagcctaggtccaggcatgatgtaatcccagcactttgggaggctgaggcaggaggatcgcttgaggccagaagttcaatacaagcctgggcaacacagcaagatcccacctctaaaaacaaaaacttagctgggtgtggtggtgcacacccgtactactagctactcaggcagctgaggtgggatcatttcttgagcccaggagctcaaggcagcaggcagtgagctacaatcacaccactgcactccagcctgggagacagggtaagaccctgtctcaaacaacagcaacaacaacaaaacagaagcgtaaaatataaatttttttatgtttctggaaaaaattctagaatgatgcatactaaatgacaactattagcagtctcgtaataacctccaaaaagagtaatacggaggagaatggaaagaaatttactctctttatacttgtgttttatttgaatttttcacaaatgtgtattcatgtataactagtgcaattaaaaaagaatacatttgccaggcgcggtggctcacgcctgtaatctcaacactttaggaggccgaggcgggcagatcacgaggtcaggagttcgagaccagtctggccaacatagtgaaaccccatctctactaaaaatacacaaaaaattagccaggcgtggtggtgtgcgcctgtaatcccagctactcgggaggctgaggcaggagaatcgcatgaacccaggaggcagaggttgcagtgagccgagattgcgccactgcactccagcctgggcaacagaacgagactctgtctcaaaaaaaacagaatgcattcaaatttaaaatgtttttagaggccaggcatggtggctcatgcctgtaatcctagcactttggaaggctgaggcaggtggatcacctgaggttagaagttcgagaccagcctggccaacatggtgaaaccctgtctctactaaaaaaaaaaaaatacaaaaaatcagctgggcatggtggcacacacctgtagtcccagctactcaggaggctgaggcacaagaatcgcttgaacccaggaggcagaagttgcgaagagctgagatcgcgccactgcactccagcttgagtgagagtgagactctgttttaaaaaaaaaaaaatcaaataaaaagaaacaaaaaataaaaataaaatgtttttagaatctgctttaggtgaaaatgttagaaaagcaaactatagctgggcgtagtggctcacatctgtaatgccagcactttgggaggccaaggcgagtggatcacctgaggtcaggagttcaagaccagcctggccaaagtggtaaaaccccgtctctactaaaaatacaaaattagccaggtgtggtggcacacatctgtagtcccagctacttgggaggctgagtcaggaaaatcgcttgaacctgggaggcagaggctgcagtgagctgagattacaccactgcactccagcttgggtgacagagcaagactctgtctcaaaacaaacaaacaaaacaaaaaacaaaacacaacaggccgtgcgcggtggctcatgcctgtaatcccagcactttgggaggccgaggcgggcggatcgcgaggtcaggagatcgagaccatcccgactaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaacaaaaaaaacaaacaaacaaaaaaaaacacaacaaaaacacaagaaaagaaaaccatatatatcagagtatagaaatgtatggcagtaggctgggcgtggtggctcacgcctctaatcccagtactttgggaggccgaggatggtggatcacttgagaccaagagttcgagaccagcccggccatcatggtgaaaccccatctctactgaaaatacaaatattagctgggcatggtagcaggcgcctgtaatctcagctactcgggaggctgagtcaggaaaatcgcttgaacctgggaggcagaggttgcagtgagctgagatagtgccattgcactccagcctgggtgacagagcaagactctctctcaaaagaaaaaaaaaaaaagaaatgtacggcagtagacatccaagaaacagataaggctgctctgcctatggagcagccattctttattccttaaaaaaaagagagagataaaccagaagttagacatgtacttcatacggctacagacttctttgagggcaacagttgacaatgaacctctccaaatttagatttaccagctgacagtagagagcttcaaaccaattgaaggggctatggacaaatgaagggtttattcatggcaaaagagagagaataaaaaggaaaggaataaaatccagagcatgctgtgccctaaccagctggagataacaaagtgctgtgttttgctccatagcccacagtagactttggaatatgactggggaacctgggaaggatctctgcctcagtcactgacatcactatcaaagataagcctgtagtaagaatcttctatgatggtatcaatgactaggatgaagaaacaaaaccgctaaaatgtgagtcacatttatttatttatttatttatattagtcatccttttttgtgtgtgacttttgaatgttttcggagatttttagcaaaatgaggcatgtaataatgttttatgacctaacaacacacacacacacacacacacacccatattgaaaataaatcacaaaagatttcctaggtttcagaaatgatggtaaaactctgtctctactaaaaactacaaaaattagccaggtgcggtggcgggcgcctgtaatcccagctgctcgggaggctgaggcaggagaatcgcttgaacccgggtggcagaggttgcagtgagccgagatcacaccactgcactccagcctgggagaaagagtgagactctgtttcaacaacaacaacaaaaagaaatgtaaccattccttcagtcatcttacaagaaatgtacttgtggccaggcatggtggctcacccatgtaatcccagcactttttgggaggctgaggcggatacatcacctgaggtcaggagttcaagaccagcctgaccaacatgaggaaaccctgtctctactaaaaatacaaaaattagccaggcatggtggcgggtgcctgtaatcccagctactcaggaggctgagggaggagaatcgcttgaacccaggaggcggaagttgcagtgagccgagatgcaccattgcactccagcctgggagacaagagcaaaactccgtctcgaaaaaaataaaaataaaaataaataaaaatagcagttgctatctgcttcaaaaaggttatatatttattgtttatgttatgcttcactaagcttcaaattgttatacaatagcactcctaataacaactgtttctggtactccgtactgaaatctctaaggactgtgactcagtgtggctgacacaagtggtattcagtgcagatcaattttatatcttctccagatataaaatgggtgttgggtctttttttatcttcatcattttaatgtcctcactttaagagaaaaggttttgggtcttaaaagttaataacctgaccctattttgagtgcatgatatcttaaactgtatgttttcctgtctcaagaacccatttagctcaagaatgttgtaggattacaagattataaggcaagctatttaaaacaatatcatttccatacttacctactcatttgtgtgaattaggatgacctaaagattgtgcaaccaaaataatgtacaggaaaaaaactggatgcagaggcggatacagaatacaactgctatctctaggatttgatttcaaattactaagtgtcttcattaagagtctcaatgctcccaagggatgacttcataagaaatacctggcttggaacatagaaaaggtttattgtgctaaaagaatctgaaaaccactagtccatgatacttacctctcggtctgatcttcgaggacataaagcatccacttcatcaaagaatatcacacagggtgctgagttcttggctcgttgaaaaacttgtcgcacagcacgttcactctcaccaacatactaaacatacacagaaaggaaataaaataccaacagttcaactttgtggtttgggtcaaatgatactaaacagttttatgtgacataaactagttttatgtgtcaaagtccagaaagtatcagaatgaaccatatacaattgctgatatttaaccatttttgacctgtaatagccaactgcatatagttcaacttaataaaattagctactatttaagcctactataaatttccttatttataaaatgaagacttaagtgaaacgtaagttcttctctagctcaaaaaaaatcaccaaaattcaattgcactttagaactaatcttgtaagcctcgtgcatataaaatatccagcagtaattttcattaattcaacagtattttacatacacacaagtcaaattactgttttattgttatttttacacaagtcgtcttactaaataaaggaataactattttgtcatacagcatcagaggaggcaaagtgagccaactaggcacttaacaggtttcataatggcttactctatgttgaaatctaaatcaaaatataaaacattaagataagtcaagaaatatagcaattcacaagcaactataacattaggactaagtaatatgaaaagctacatgtaaggattatttcacttttagcttaggcataagaaatttttcttgtaaaatgtcaaaccagatgattaagaaagagcagtttttttcttaatgaaactgccaaataagatggaatccaaaaacatctttacagtgccaattattattattatttttgttttaagacagggtctctctgtcaaccagacaggagtgcagtggagccatctcggctcactgcaacctccacgcccccaggctcaagtgattctcctgcctcagcctcctgagtagctaggattgcaggcataccaccactaccacctggctaatttttgtatttttagtagagatggggtttcaccatgttggccaggctggtctcgaactcctgaactcaaatatccacctgactcagcctcccaaaatactgggattacaggcatgagccactgcccccggcctacagtgccaactatttcatatcacctatgctatttaatgactatatggccatactaaataatcaaggcaaagagtaccacagacgacagagattaaagtgctattttttcatttgactagaactttctttccctcacatccttttggtacttttctttgaacttttgctcattctgcttcccttacttgaactgctttctaacctacctccaaacatttcttcttgcattctaaaagatcctcattaatcattcttcccataatagttaatttgattaagttgaactatatgcagttggctattacaggtcaaaaatggttaaatatcagcaattgtatatggcttatcctcatcctgatactttctggactttgacacataaaactagttttatgacacataaaactagttttatgacacataaaactagttttatgacacataaaactagttttatgacacataaaactgttttactatcatttgaccgaaaccaaacccaaagtatttctttgctcttaaagtactttgtattattataatatttgagctcttctaccttcactatattatattacaaagcccttggaaagcaggggtcctattcagatattcagattttatcattattgtaacatttgagctcttctaccctcactatattatattacaaagtccttggaaagcaggagtcctattcagatttttctgtcataacatcctgcacagtgtacaaatatagcacacagtgtgcaaatataataaacagtgtacaaatatagtagactttcctggaaaatcgaattcagcaaaaactatacttgcaatgctgaagcaaaatattcagtactattgtaaaagaaggcatatcagggggctgggagacataaagtttcagataggaatagaagagaacaatcaataccgttggcaaagtgactttggaaatggtaaaccaaggtagctaggtaaaaggaaatttaatttagggaaaggtaaacctaaagtttcaacgaggacatattaaaacctacttaatcttaacaaggcaacagtgattaaaaataagtaaataaatgaaaagcccatcttatcctttatttgaaacatatgcaacatttcaagtaaagatcctacatttattatctcaaaatctttattggccatcaaattttcaaccattttattctggcttttgcaaacatcattattaaacatattttccctaaagccaccaatgaccttctaattaccaaatcccaagtcccactctcactatcttttatactgtttagtcacactgacaaggttgaaaaactcatcttcccttggttttcaggcttagaaggtccggggtgttctccatcttatgaccaagcactttcggtctcctttaccagatcttgcttctttatcccttaattgttcgaatctttcagggttctgtcagaggcccttaatgtaactgttcttttacttaacaaacttgtcctaccagactgaacccattcccatggttttagatgccacttggatgatagtgactttcaaatctcttcagagcttcagattcacatttcctactgcctgctggacatctccagatggctgtttaatctaaaatgtcctagagtgaactcattttccaatcccaagatgcccatcttcctcattagatcatctaatctttttttttttttttttttttttgaggcggagtctcactgtgtcgcccaggctggagtgcagtggcgtgatctctgctcaccgttaacctccacctcctgagttcaaacaattctcctgcctcagcttcctgagtagctgggattacagacacccaccaccatgcctggctaatttttttgtatttttacaatggggtttcaccacattggccacactggtcttaaattcttgacctcaagtgatctgcccaccttggcctcccaaagtgcagggattataggcgtgagccaccgcacccagcccagatcatctaatctttcagagacattctgcactcttccatagacctcttccccctacccacccgttaaaaacaaatcagaccacaatgaggcaaaatgtcatatttaccagactggcaaaaatgaaaatatcagacaccaacactgctgttgagaatgtgggacaatctgatacaatcactttataaaaatagttagcaatatccaattttttttttttgagacaggatgttgctctgttgcctaggctggagagcagtggcgtgatcatagctcactgcagcctcgacctctcaggctcacgtgatcctcccacctcagcctcccaaggagatgggactacaggtgtgcatctggctaattttatggggtttttttgtagagacagggtctcactatgttgcccatgctggtctcaaactggcctcaagcaatcctcctgccttgacctctcaaagtgctgggattataggtgtgagccactgtgcccagccaatacctaatatttttgaaagtgcacatactctaagattcagcaattctccttctgggtatataccctaaggggaaaaaaatctcacaaatatatgcaaagatatacatatataatattcaacctaaaaattcatcagaaaaaaaactgatttttaaagtatggttacattcattcaatgaaatgccacacaaaaagttaataaactaaaaatacatcaacagagataagtattataaataaatattgaacaaaaataacaaccaagaataggtgtagtcactcacgcatgtaatcctagcattttgggaggctgagataggaggatcacctgaggccaggagtttgagaccagcctggacaatacagcaaaacctctacttccagagaccctgtctctctctcaaaaaacaaaacaaaacaaaaaccaaaaaactcaaccaaaccaagttgcaaaataatacacactatttaaaggggttttttgtttgttttgctttataccatggagagtttataaggagagttccaaacttataactaaagagatataacagttataaacttcaaatgtacccatcactgaccttcaattattatcaactcgattaatgaccagtcttgcttcatctatactcctggccactttccttgttttattgaagaaaatcctagatgtcctattttatttataaatatttcagtatctctaaaatatgattttaaaatgtcatatcacacttaaaaattagtatttccttaatataaaatattcagtaagcactaacatttccaattatctcataaacctcatacttgaaaaaaattacattaaaaatttttttggtagagacagggtcttggtatgctggtctgtcttaaatgcctggcctcaagtgatcctcttgcctcagcctcccaaagtgctggggattacaggtgtcggccactgtgcctggccttatacttctgaaacatataaaataatactatatattgtttagggataaatatacacatagtaaatatagaaagaagtgcatggaactaataagcaccaaattcagccttgtggtaagttccatgggaaagagaacagggaacatcatgagggagggtttgcaagaagctttaagtgtactgctgtttttttttgttttttttttttttgctgggtgatagatacataggggtatattatattactctttggaattccttatatgtggaaatattttataataaaatttttattaattacaatctttaaaaatatgttacactcttgacttaaagcctctattagctctctgatattctgaagttaacatccaaactttagcttggtataaaggcccttcaatgtctggctataaccttcttttccaatcccagttcccaccaatgccctctgcttcaaggttcacatctaataccacctctgctggaaaatcaaaaccaagtacaagaaaagttacgaggtatgtaaaaagcccataggaaatacttaagtataactcccttattttagggagaaagtaatacacaataggaaagatttaaaaattgaggtagagataaattttaaaaaccttttaaaacaaatgttaccctcatttcttctttgttggaatatatcatagaatggcatttttacttttcacagagagggacaaaaaataaattcaaagtgtcttaaatttggataataagtttcttaaatgcagaaggaagatacagcacttgagtgacttctatctccagaagtatttttatttattaatatggaactcatctgagccacatgacaactggacaaaaagtagatcaggagtcagacaactcagattgaaatctttgctctactgcttctagctgtgggaaaattcaggctcagaggttaacagacttaattgagaaagcatttatacacccaaagtggcagagcagagcaaagctcagcctcctcactcctacagcactgattttaaataccaaaataccacaattgctgaaagatctgagaacattttaccccgtaatttgcatgaccattactttttctaatctaaaataatggttcttgctcaataacttaccatgtttagtaattcggggcccttgacagatataaaatttagtccggactcatttgcaacagcctagcaagaggaaacaaaaagacacaaataagaccaatacacagtaataataacaataataatgatgatgatgtgtgacaatgaaaggactctgtgtgcgtgtgtgtgtgtgtgtgtgtgtgtgtgtgagatttagatggagtcttgctctgtcgcccaggatgaagtgcagtggcgcgatctcggctcactgcaaactctgcctcccgggttgacgccattctcctgcctcagcctcccaagtagctgggactacaggcgcccgccaccacgcccggctaattttttatatttttagtggagatggggtttcaccatgttagccaggatggtctcaatctcctgacctcgtgatcagcctgcctcggcctgccaaagtgctaggattacaggcgtgagctactgcgcctagccctttttgtggtcttaattctgtgtctccctttctatattaatagttacctctttcttattaaaaggaaaaaaggggtgggtgcggtgactcgcctgtaatcctagcactttgggaggccgaggcgggtggatcacctgaggtcaggagtttgagaccagcctgaccaatatggtgaaaccccatctctactaaaaacacaaaaattagtcgggcatggtggcatgtacctatagtctcagctactcgagaggctgagacaggagaattgctcgcacccgggaggcagaggttgcagtgagccaagattgtgccatagcactccagcctgggcgacagagcgagactctgtctcaaaaaaaaaaaaaaaggaaaaaagacaaatgggaaaaggggaatggataaagggaaaatcaaaggaaataaacgttaatgtgttaacgtacaacttttttttttaaatttcactttaatttttttttttttttgagacagaatcttactgtcgcccaggctgcagtgcagtgatgagatcaccactcactgcagtcttgacttcccaggttcaggcaatcctctcacctcagccttccgaggagctgggattacaggagtatgccaccacgctcagctaatttttgtatttttttggtagaggcagggttttgccacattgcccaggctgaaacctacaactttctaagaattactaaggctataaatcaaatggaaatgacacaaaatatttatgtgaacatttgtttacataaacatgcttatgtaaatataaatacatttatagccctagtttggaattccagtgaaatgctagtctctgtactcaagaaatacctcatgggatgaaagcattcattgatttacaaatgaaaatttaacatcagttatcagtctttacgaagagtcagtgttgagaaactcatagttgtatgtgtagaagagtctaagaattacaatctgaatgcagaggtgaaacctgaataaaatcaatcagaacttcaaaatgatcatggaagagagttctttcctattcttagaacctggtatctgagctccccatctatgttccacttactcctcagcaacaccacttggattgcacaagcatttcaaatctaccacttctaaaactggactcccaattcttattcttccaaacctctccaactccagtaactgcatgccctgactttatgctagttacatacttagtatgtgcaggtgccaagaaaaattgtattattttgttatcctgagtaaacaaaacaatcaagatcagccaaatacctaattttatatgtatctctaggtttctaggttctgacctataatttgttccatgagtttatcctaggccacactttgcctctgccattcaaggacattttctatttctggattcttgggcacatagtcttgcaccccttggagaacctgatgaaaggtgttgtgaacactcttccccagaaacaatacatatacacaatacattgcctgggctcatagattcagtgaagctgtgaagtccattcatggagtcctaggtaagagtccctgctcccaaaggtcagatgtaagaaatctgactaaggccgggcacggtggctcatgcctgtaatcccagcactttgggaggctgacacgggtggatcacgaggtcaggagatcgagaccatcctggctaatgcggcaaaaccccgtctctactaaaaatacaaaaaattagctgggcatggtggcaggcacctgtagtcccagctactcaggaggctgaggcaggagaatggcgtgaacccaggaggcggagcttgcagtgagccaaggttgtgccactgcactccagcctgggtgacagcaagactccatctcaaaaaaagaaagaaagaaagaaagaaatctgactaaacagagtggtcctcaattgttggcagttcagtagtggggagaagaagaggagaaatgtagatctatgatgttttagtactatatatgcttttcaagttatccaagctacctcctctctgctgtgaacaggactactcaaaggcagatgtaactaattaaataataaacactataggacacacatgaaagggaagtgcattgacctggagaattcacacaccagcatgcagaaccttctttctggctatatttttccaaaactattgtgaaaaaattgtagatcaatgactgtgttgttctcttctacctccatacccagctctctgaaagcaatgccttttaagagtactgaaagcattaagcaaggaaaattagtagtataaataaaagtaagttttacacacagcactatggatatttgatatttactgaggagctataatttggttgctgttgtacttattaaaaatgttattatttcaatttcttacaattcaaaatatttttaaaagttgataagggttagttatggatgtaatattatacagacactaaaaatgatggataacatactttacacatagggaagacagttctaataagcataattccaatggggaaaaaagcacaaaaagacagaaatttgcccacataaaaatcaaaccaaaaaagctcaaggtgtcaaacatggttacagtcaagataaactaatcaacatttataaataacaaatcttaatatatgaagtgatataaataagaaagaaaatcacatgtatgccattagaaaaataggaaaggatatgaatagacaattcacaaagaaatatagccaataaacatacttaaataaaaaaaactagtttttttttttgagacagagtcttactctgttgcctaagctggcatgcagtggtgtgatcttggcttactgcagcctctgcctctttgggtcaagtgattcttgtgcctcagcctcccgagtagctgggattacaggcatgcaccactacatctggctaatttttgtaatttactttagtagagacagggttttaccatgttgcccaagctggtcttgaaatcatggcctcaagtgatccacccgcctcggcctcccaaagtgctggggttacaggcatgagctaccatgcctggccaaaaaaacactagtaatttttaaaatgcaaattaaactgtaagacagcatttttacctattaaattgtccactattaagagcaatgttcatggccatcactagtttaaggtgtgggaaaattgattctcataccctattgataaaaaaggtaaaaactggtgaaaacctttaggaaggcactttaataatatggctcaaaagccttaaaaacatacattcctttgactggaaaattatttagaaatgcattctaatataattattagtcaaggtacaaaaatataagtgcaaggccatttaaagtagtgttgtttcaatatgggatcatttccataaattatagaacatctatctttatggtagaatattatgcaggcattaaaaatattgatgtgtatcaatatatactgacgtgaagatgttcaggaaatacagctaagtgagaaaaacatgtttaaaaaagcttatatttgtggctgggggtggtggctcacgcctgtaatcccagcactttgggaggccgagatgggcggatcatgaggtcaggagttcgagaccagcctaaccaacatggtgaaaccccatctctactaaaaatacaaaaattagccgggcgtggtggcgtatgcctgtaaccccagctactcgggaggctgaggcaagagaattgattgaactcgggaggcggaagttgcagtgagccaagatcatgccactgtactccagcctgggcgacagaatgagactccgtctcaaaaataataaaataaaataaaaaaagcttatatttgtaaacatgcatgtaaaaacttaaaagttagatattactttgatatgtatgcatagaaaaatatctgaaggattgacaatgaaatgaaataatagtagtaggtggcagtgagagaattacacacaatgcttttcctttttgcttatttttattttctattatgaaaaaacaattttagaaaataattacaagaaatatagaggaaaatacttaagttataaataataacaataccaaagcaggaaactaagtcaagtaaaaactaaaactatggaataatactcactaaaaagctaaaatgtaatacacagaaaatataataattgcatgttaaaattgataggattatggttgatataaacatttttcaatcatgtgcctttgtaatttaaaaaagtaggaaactttaatgaagaaagttgtcagttttgctaaaataaacttctgataaaaattatgcataagacttacctcactgtaatatttaaagttaagttcatattatcctatctgatactaagaaataaattacatgcaattgaacttatatgataccttcgccagcagagtcttcccacagccaggaggaccagcaaggaggaccccagctggagtcaccaatccaagagctttgaactggtctgggttgcgtactggtgcctggaaataatgatacaaacggcgatccattacatgtccattttatactgcaggttcaaattatttccagatacatattttatggtttttttttttttttgagtctccctctgtcacccagctagagtgcagtggtgctatcttggctcactgcaacttctgcctcctgggttcaagcaatcctcccaccttagcctcgtgagtagctgggactacaggcacatgccaccacgtctggctaatttttgtatttttagtagagtcggggtttcaccatgttggccaggctggtcttgaactcctgacctcaggtgatccacctgcctcagcctcccaaagtgctgggattacaggcatgagccactgcgcccagcttctcaggcttattttcaacatgactgtgaggcctgaagatacgaacagtacctggtttacctgttcatgctctgtggtgataaagagaaaagtccctgcacttgaggaatttatacttgaacataatgtctaagaacattttagacataatgatataatatttcaacaaatatgttttagaaaaccatttaaatttctaggttataaaatgtttagacaatggtctcctctaagaaatcagatgcagcagtaacttttgcatagttaaaagccagagatatctgttgactataatcccagtgtattttctctttcagtagtacatacctctaaatcgatcatatttccattaatgaaccatggaatgatgagtagaaaagtaaagtaaataaaaattaatccaaagttttatgtgcattaaaattgccttgatccataagatcaagttcagaaagtctttgtcaaacaatttggtcttaactgaaacctataattttttgtggtttaaactcactgctacagaaatgaagcacaaccaaaaggatcagcataaaataggtctcaatggaatattattcagccacaaaaatgaatgaaatcctgtcatttgcagcaacatggatggaactagaggtcattatgttagtgaaataaactaggcacagaaaggcaaatattgcacattctcactcatagtgggagctaataaagtggatctcatggagacagagagcaaattgatggttaccagaggctgggaagggaaggtggagatgagtataatgaagagaagttggttaacgggtaaaaaaaatagttagataggagtaataagttctggtatttgatagcacggtagggaaattatatttcaaaacagctagaagaaaaaagtatatttcaaaacagctagaagaaaaaaagtataatgttcccaacacaaagaaaacataaacattagaggtgatgaatatcccaattaccctgacttcatcaatacacatttaatatatgtatcaaaatatcacatgtatcccaaaaatatttacaactatgatacatcaatttaaaaaaataaacaaatcggatctcaaacaaaagaaaaaccattgttgggggcttgaaagaagtgctacattcaagtcaagttagacacagtgattatagtcaagtcagtttagccacagaacctagtacacatgcatggagctttatctctggtctttaatccatgacatgccaataatatttggcagctgatatacctaccaatattgccatggtgagctcctctctaatgtcttccagggcaccaatatctgcccatgtcacattagggacagtgacaaagccttcccttttggcagagggttggactgaggatagagcaacaatgaaatcattcagttcaatgcacagtccttgcatctgctcctctgagaggggatcttggtctcttagcaaccccagcagcctttgtaattcatccttgaagggaacaatagaggggaaaaaaataaagaaacaccacaacagctattgaaaagttacattttctacttgtaaaaattattactgtaatatttccgtaagctatcctgaacgtctatgtattttaataattttctctctgacatgagacaagttcattttattcttaaggatcatatgctctggtcaagtaaagatataccaattataattataattaaacatataagaatgacttctatatactagggctaggtatagcaaatataagcgttggcaaatattcatttcagcaaccataatatttcccatgtttcatttataaatattcaagaaacagttgaatcctgatgaaattaaaacacttatgctggaggtagtataattcattaatatggttccttgatggtttatcaactaagtagagggaaggcaattttcctattactatcaaatcttaaacttaaaaggcagatttcttgctttgtggagaagatgaaaggataagtctaaaaaacaggtaaccaattaattcaatttataaaatattaatttatatgcaatattataaaaggaatgagtttgttattttttacagaattaattgcagtttcaaatgtctaagaaaaaaacaaattatctgagaacaaaagatctggattgaagcccctgctctataaagtagaggctgtatgggcttgaggaaatcacaaccacttaagcttagtgcctttgattataaaatggggaaaatgacatttatataaggttacagggatcaaattatataacatacagaagccatctgtgcaagctataaaatgctatatgaaatgatatatatattgaattttcatgactcataaaactaaaaaatttaataccgatcttggactgataactgtcccctattattcacatgactgtcctccagagctgtttgcagctaccgacatggatatagttgtgtcaacagaccactgtaatctacctaaccaaaagttaaccaggagatataattaaatgccaatgctgaaataggggttgacaacctttttctgtaaaggtttagactgtaaacaccgtaggctttgtgggccacggtctctgctgcagactcctgtgtgaattctgccatgaagaacgaaagcagaaacagacaacatgtatacaaatgaacatggctgtgttccaatataactttaatttacaaaaacacgtggtgggtgggtaggccacagtctgccaaccccattccagaatttcataatcattattgtaaaatgaatttattaaaataaactaaacataaaacaactcatatttttgaaatgataaacatcgtgggtataaatgataagtattctatagattaaatgccaataaaacagaaagtaatgaacctcaattgtattgacccttgcttcaatgtaagataacacaaagaacattaaaaggacaatttaaggtgcctttagagaaagcacctgtgtttcagaagtgggctcagttcccagcctttcctcctggactcctttagatggcaaatcttccatttcaggatttttcttctgctgttcctgtagcttcattaagactctattgactgcacacattgctgcctctcggcacagtgccatgagatcagcaccaacaaagcctggagttaggtgtgctaagtgacagaaatcaaaagcttgaggaagcctcagttttctgcacaatgtttgaagtattctgtagaaaagacaggggaaaaaatttctgattcctgatctaatagtaaaaacaagtcaccaactatatttatttgaagtccttcacgtctgccaaaggtatcaaaatggatactatataagatcaaatagttcagtcactcaacaaacgctgtcattattacatgttccatcttattccagaaaggattatggtaaatatctgctttgttaggaaacatgctaagtgctgtgacgaatacatagaatttttaaaaaatattttgcctttaagaatttacaacattacaggggaaataagataaataacttatgggggtacttttagagtagattaaatggatatctaccagaaataaaagcccccacatacacacaaaccattaattatcttcatcattgaaaattatcttgccatatacttcccatttcatattaggacagttacaactccaactttatctttacctattgttcatcccctgtactacatgtgtggaaaattttgttcaacctaactggcaacatggtatctataaacatctggacttctagataattgttattaaaggaatatcttgaacaatttctgataagacctactgaataaaaacttaaaagcagtaaagatattcaagatgagggcaggtgcggtggctcacacctgcaatcccagcactctgggaggctgaggcaggcaaatcacctgaggtcaagagtttgagattagcctggccaacatggcaaaatcccgtctctactaaacatacaaaaattagctgggcatggccaggcacagtggctcacaccttgtaatcccagcactttgggaggccgaggcaggcagatcacgaggtcaggagatcaagaccatcctggctaacacggtgaaaccccgtctctactaaagatacaaaaaattagctgggcgtggtggcgggcacctgtagtcccagctactcgggaggctgaggaaggagaatggcatgaacctgggaggcggagcttgcagtgagctgagatcaggccattgcactccagcctgggcaacagagcgagactctgtctcaaaaaaaaaaaaaaaaaaattagctgggcatgggggcgggtacctgtaatcctagctacacgggagcctgaggaaggagaattgcttgaaccgggaggcagaggttgcagtgagccaagattgtgtcactgcactccagcccggacgacagagcaagactccatctcgaataatttaaaaaaaagatattcaggatgaaaggtctgaagccaaactgcaagagtctgaatcccagctctgttaacctttgttatctgggccagttacttaatctttgtgcttcagtttgttcatttattcaatctatattatagtagcacttattcagagggctgttgctacaaatgaatacatgcaaagcacataaaacaatggctgatctacagttagtgcccaatgaatgttaattctttttttttctgagacggagttttgctcttgttgccctggctggagtgcaatggcacgatctcggctcaccgcaacctccgcctcccaggttcaagcgattctcctgcctcagcctcccaagtagctgggattataggcatgcgccaatgaatgttaattcttatttacatattttgatattataaactaacttggacaaggaaatatattttaaaattaataactttgtaaagaagactaatattttcaaatgtcaagctaataaagaataaattatagaaaaatcatttgggatcatataagtgagcagaatagaagcagataaacattactgacaaattttttaaaatttcactgggatactctgaataatgggaatcaagaaaactttccactaaagaactatttccaaaagatacagatccaatttgctactatgcacaagaatacaaaacactcttcgacttaccatgagtttacattcctgataaacccatcttaagtcaaaaacatcatgataaaccctttgtaaagttgaaaaactataagccaaagcattgtcagttggggactatccgtactaagaacattttggatgttgtgaaaatggctaacagaaaataatatcgcccttttcatagttgtactctatccctaaaaaaagtgggtatttttggtcatcatactgtagaaactccaaaagaagggaaagctaccactgttctagctccagctactgcagccacgtgagaccgcaaggcagaaccatctagctgaggcctttctaaattcttgatccacagaaactgtgagacacaataaaatgagtattgctgtaagacactaaattttggtgtggtctgttttacaccaatagaaactggaacaatttatacgggtttccttttatgtatgctgaaacttttccataatttgatgcttttgaagtacaggatgatatccggaggatcacttgagggcaggagttcaagatgagcctgggcaacatagtgagaccctttctctatataaaaaatagtaataataaaagagacagctatcaatagctaccttatttaaaaaattctctatgtcagatattgtgctaggttatgttaattcaatactcacaggaagcctttgtagtattatgatcactttacagataaagttattactattattattactgcattataggtaaataaactaaagcttggaaatgttaaaaacactggacaaggaccaaggataacaggaggcagaggtggaataattttccttcactggctcaaagtttgggcatctattcattgcctctgcaacccagtcccgcctaggtctggcctttctcctccttacttacacttactcataccctggacctcgtcatcacctggatctagcccctatctgagatcacaatctcacatgcggcactctgcccagtctcacatgtctgagcttatatgtgcaattactcccacactgttcctggacctcaccaggatcttcagtgtaccccttcctcattaaatacctttttttttttgagacagggttttgctgtgtcacccaggctggatggagtacagtggcatgacatcggctcactacaacctccacttcccaggttcaagcgattcccctacctcagtttcctaagtagctgggattacaggcatgcaccatcacgcccggctaatttttttgtgtatttttagtagagatggggtttcaccatgttggctaggctggtcttgaactcctaacctcaagtgatgcacccgcctcggcctcccaaagtgctaggattacaggtgtgagccaccatacccgacctaatatttcagaacaatttttttttttttttttgagacagagtcttgctctgtcgcccaggctggagtgcagtggcgccatctcggctcactgcaagctccgcctcccgggttcacgccattctcctgcctcagcctctcaagtagctgggactacaggagcctgccaccatgcctggctaattttttgtatttttagtagtaacggggtttcaccatgttagccaggatggtctcaatctcctgacctcgtgatccgcccgcctcggcctcccaaagtgcagggattacaggcgtgagccaccgtgcctggcccagaacatttcttaactagatttccactctaccacctcaacagtgcttcctgagatagtctcgcttatgaagttatatttctggttattggtggatatttatttgctctatggacattactcatttgctcaattaccaggaaaggctggtactgcagcaaacagctttcaactgtctggctgccatttcattactggtaacaggacctgtggtctcagacaggttagtgcaataggttaaagtatggtactcagatttaacctataagtggaccagatggctgctgtatgccatagctccagacattgccactaacctggtcagccaactgaagaatgcaagccattgttaataagaccagacaaatgagtatggatacataagtccattactacttctgaaaaaacaacctgaaacaattatcctactgatgagtaaattgttttcttcctctttttttacagaggtggggcctccctctgtcacccaggttggagcacagtgacacaatcataacttactgcagccttgaactcctgggctcaagcaatcctcctgtgcttcagcctcctgagtaactaggactacaggtgtgtgcacagctgattttattttttgtagagacagggtcacactatgttgcccaggctcaaaatcctggtatcaagtgatcctcctgcctcggcctcccaaagtgttgggattacaggcatgagccactgcacccaggcataaatgattttcttaatgtgggcttctccttttccaaatcaatttaattggtacaaaaagaaagagagagaaagaaaaggctacttggtatttctcacctcttactttcaaaccattcagttaagatgacttagtggcatacaaacttcattctataagaatatacctttccctggatgcttcatctgggatacctaggcatatttctcggtcgaaccttcccgcacgtctcaaagcagggtctaacgagtctggtcgattagtagctccaataactaggacccgggctgtagcagccacattattcagatctagtaagagacagagaaagagtagtgaacaaagcacttgacactgacggcaataatggttacagaatcatttcatggttaaagataaagtattacagattttgacagcaacatacatataaaaccaacatttattaaatgtcaaatatgtaaaaggtgtgaggaggataaataaaatacaaactctgtcctcagcagttcacaatctattgagaaacattgagtgtgtaaataaaaaaatggcatcagacaaattttgtgaagtataataacagatataaacaaagcaccatggtaataagagaaaagacatcatgaattccaactgaggaataagggagggttcatggaggtggtaacatttcagaaaaggcttgaagggtaaatacaattttaacaagcagatatataggctaatggaattctatgtagaagaaagagtattagtgaaagcacagagggtcaagcatgcatggcacatccaggcaaggtgagcaggacaacagggaggctggggaggatgccaaagtctgtgtctcagaatagactgataaaattaattcgagcaggggaatacaaaatagtcttcagctgttctggcttaatctaggaatgtatttctaggaatggacaaaactgaggacttaaatcttatctttcctaagtattatttctctcagctgaaccaggattgaacagcagggagtctgaggttattttccctcacaggtaacaagaaggtagtaagatgctaattaaatcatgaggagtttatacagtgtgttctttttttttttttgagacggagtctcgctctgtcgcccaggctgaagtgcagtggcaccatctcagctcatggcaagctctgcctcccaggttcatgccattctcctgcctcagcctcccgagtacctgggactacaggcgcccgccaccacgcccggctaatttttttatttttttattttttagtagagacagagtttcaccgtgttaaccaggatggtctcgatctcctgacctcctgatccacccacctcggcctcccaaagtgctaagattacaggcatgagccactgcgcccagccacagtgtgttctttagctagcaggaagccatgaaagcattttctcagaatgcaggcctcaaagacatggcaagaaaattttagataaaaataaaacagaatcccagcacttcgggaggctgaagcagaaagactgagcccaggagttcgagatcagcctgggcaacatagtgagaccgtctttaaaaaaaaaaaacacccaggcacagtggctcacacctgtaatcccagcacttcaggaggctgaggccagtagatcacctgaggtcaggagttcgagaccagcctggccaacatggaaacaccccgtctcaaaaatcagccaggtgtggtggcacgcacctgtaatcccagctactcaggaggctgaggaggtgaataggttgaacgcaggaggcagaggttgcagcgagttgagatcatgccagtgcactcaagcctaggcaacagagactctgtctcaaaaaaaaaaaaaaaaaaaaaaaagccaggcatggtggtgcacacctgtggtcacagctatttgggaggcttaaatgggaggatcacttgagcccaggaggtcaaggctgcggtgagctgtgattgtgccactgcattccagcctgggtgacagagcaacactctatctcatcaatcaatcaatcagtccatcaatcagaagaagaagcaacctacaatctggtaatgcaaggaacataaaatatatacttcaaattttcttgtgtacacaaaacaagtgctatttctttttatttatttttagaggtagcatctcgctatgttgcccaggctggcctcaaactactaggctcaagcaatcctcctaccttagcctcccaaagtgttaggattacaggcatgagccactgtgcccagtatgactttttttttacactatttgatatttactatatgaatattattttttatcttcatgtattaattacactattttaaaaaatttattctcttaaaatgaatttattattttaaactaaccatccatgcaggttaggagttgggctacaattcttcgttccatatcttttgaagccacttctcttttgggggtaatagcatcaatttcatcaatgaaaatgatacatggtgcatttgactagaaataaaaatatcacaaaaagacaatcataaatgcatcccctatactgaagcacaattaagcatatacattttaaaaaaaatcttcaaggtcaaggatcatttgccaaaagaataaccctaaagaaggcagttcacatgtgttacttctgatttttacctgacttaagagaaccaagatgattagaagtacacagtaagagactgcagatagggtaacacatttatagtctcttcatcaatgcatgttttgtgataaatctactgaaattcttttgtaaattagatacatttgctatgctatgaaacagaaacaatgattttggataagcatatgcacagaaaaaaaaacttaagacaacaagtttataaactttaaattagcaaacccaagctcactagaaacgttatgagggtttctactaacgtaagaatctccaagtctttccctataatttgctataagaggaaatttgagaagcaccagaagctttttaaaaaatctgtggtaaaatatacataaaatttaccattctaaccactttgggtatatagtttagtggcattaaatattttcagactgttgtgtaaacgtcaccactatccatctccagaactttcccagcatccacactgaaaagtaccggaagcttattttaaaggctacactgaataaggaaggatggtaaagttctaatacatcagtgtaaagatcacctccagtttttttgtttttaagaaataaactagacacggttcagaaagaataagttaagatgtaaggatcagctaccgagagtagtcaaattcattaagacaaaaagtagaatggtggtgatggccagggactggtaggagagaggaatggggacttactgtctgggaacatgaagacattctggaaatggatgggggtaatgataacacaacaatatgaatgtacttaatgccacagaattgtacacttaaaaatgtttaaaatggccttttcagttggaactgccatcttccagtaattcaccaaaatgatgaacacaaagagaaagaggagaggcacctgagagatgttctctaggccgttcagaaaacatggagctgttcctttggctatatgtatgcaaatctataagaaatgtcatattgtaggccaggcgccatggctcatgcctgtaatcccagcactttgggaggccaaggcgggtagatcaccagaggtcagaagttcaagaccagcctggccaacatggcaaaacgccgtctctactgaacatacaaaaactagccaggtgtggtggtgcatgtctgtaatcccagctactcgggaggctgaggcaggagaattatttgagcctggaaggcagaggctgcagtgagctgagacattccagcctggacaacagagagatactccatctcaaaaaaaaaaaaaaaaaaaattagctggtgggtagtgcatgcctgtaatcccagctatttgggaggctgaggcaagagaactgcttcaacccgggaggcagaggttgcagtgagctgagattgtcccactgcactccagcctgggcaacagaacgagactctgtctcaaaaaagaaaagaagagaagagaaaaagaaatgtgatactgtagacatcaagggaatgggtactgttcaaaaaggaatgtcccacaagtgttaccaccacaaaactggaagagtctataacgttatccagcatgctgctggcattgttgtaaagaaacaagttaagggcaagattcttgccaagagaatcaatgtgtgcgagaatcaacgtgcatattgagcacattaagcattctaggagccgaggtagctttctgaaacacatggaggaaaatgatcagaaaaaggaaaccaaagggaaagtgtcagcatgctccacccagagaagtgcactctgagaaccaataggaaggagcctgaactgctggagcctcttccctgtgaattcatggcataataggtggtaataaaagacctctggactgtaaaaatgtttctcttcattgagtagaagtgtagtgtcctcttccgcaaagaaacatttaaagcaaatttaaattgttgtcctaattcattgtgtaatatctttactattcaaatttaatgtatttcttgctgaaagatgtgaggtggcttattatgcaacaaattactcagttggttagaaaacagccaggtattatttatgaaatatctgtactggtttgaagatagtccctctaaatcatcatggaagacataaaataatttacaaaaacttaaaaaaatgtttaaaatggtaaattctgttatatatattttaccacaaaaaagagataaggatcagttaaaatgaaaaaaattgaagaaaattatctagatttacaatctaaatcattttactcaatcagttactcaatggttaggagtgacagtgattatgctaagtaaggctgtcagcgtcgcttaaggcatctcaaaaccatgggaacaaccacatcttaaagggaaagatatttagcttatcgctagctggatctcttccctaatcatccttatgacaatgtttgcaaaagacgcctatgactgctagatatattacccagttacaaaggagtaaaattacagaggccaaaagcaccagaaaacaagcacatcagtacttgtcagtgacctggaaagttgaatgggggaaaaaaaagaataaatgatggtcatcagaatgtggcctaaagaaagcatagttttcaaccaagtatcacttgattggatttcacctttttgtttcctgatccacatgctttactggactcattctcattagcgaagaggggaccaggaaaagcggggtgctaggccacatatttactgagcatctactgtgaggtactgtactggctcagtactggtttagtgagaggtttaaacacagaactaacaacctaaagatgccatttgcctcttatccttattcatcgtgtttaccatacgcacaaaatttactacttgtctctggctatgcgtgccaatttaacaatggaatccaccgcgttttggaaaacaggtagcacctgagaaagttcagctttgctctgcactctgccctttccaccttttttctctttatcctcctagtgttgcccacagctttttcaacgtcagcccgcaccataactaagtagatggcctacccattcttgttatttaaaatgttttttttttctcaattactgcttaaatataatttctcttctaatttcacacaggcttctaacagttgtattggatattcatcagctactatatattgtcattgctaataatgacataaacttttcaccattttttagttttaaacacagtgatatttgttcaagtgtgaataatcttacagctaatatttacagggcttgtgctgtgtgcaaggcaccatatcgaaggttttataagaattctctcatttaatactctcaatagccacgtgagatttgggtattattattgccctagtttactagtaaggaatgacagaatttattctggtatttttatggttgcttttataatagcctaaataacaatttttacattgcttacaagttttttttggccaaacttaagttgaggaaagtaaaagtgagtggaaaatatcataaggataatatattttcaacatatgactacagggtatgacggcccagaatttctcaccaattacatttatgtttgatttcaaatgaaaagggttatttatccaacagctggtatcactaaatctactttaaatatttagccatcatgcatagcaaattaccatgtttatattaataaaagaatggccagtgagtgggttaacaaatactagcatcagaaaaagcaggatctttaatataagctggtagcgtctgaccacctggcattagtcattaactgactcaccacagcttgctcaaatagttctctcagcttctgctcagactctccggatactccagacacaatctctggagcagccactttcaaaattggcaggtcaagttcctatgcagacacataaaagaataaccaaatattcaaattttaatttccctactttttcttatccagtcccctcaaattttttaaatagctagtttcctgaggaacttcatctttttatgttggcccagtgaaaaacactatttgaaaatcaatggttttggccgggcatggtggctcaggcctataatcccactactttgggaggctgaggtgggcggatcacctgaggtcaggagttcgagaccaccctgaccaacatggagaaaccccatttttactaaaaatacaaaaattagccatgcatggtggtgcatgcctataatcccagctacttgggaaggctgaggcagaagaattgcttgaacctgggaggcggaggttgtagtgagccgagatcgcgccattgcactccagcctgggcaacaagagcaaaactccatctcaaaaaaaaaaaaaatcaacggtttcatgcaaacacatttaagtggataccttcaacttgtttttattttatacatgtcactataaaattctattatcttttctgaataaagggtcttgactttcaagaggtatgttatccccacttagggctgagccaaagcaattcttcgttttttttggagagactgtgtctcactatgttgcccaggctggtcccaaactcctggcctcaagccatcctcccaattcagcctcccaaagtgctggggatacaggagtgaccattcctggcctatcaaaacaattcttacccatctgctaaggagaaaatagcaagggttgtgacacagatgtttcccacacattctgctagtatttctccaaatcctaacccagagagtagccagttactagtcagaggagggagactctttaagaagaggccaggtgtggacgcccatgcctgtaatcccagcactttgagaggagtttgagaccagcctgggcaacacagtgagaccccacctctaaaaaaataataaattagccaggcatgctgatgcatgcctgcagtcccagttacctgtgaggctgaggcaggaggatcatttgagcctgagaagtcaaagctgcagtgagctgtgatcatgccactgcactcagcctgggcaacagagagaaaatctgtttcaaaaaaaaaaaaaaaaaaaaaaagagagaagagagactactgttctcccattcttgtgcttatcttgaaatttcacttcctcaaccataccttccttgaacccaactctaatttgggaatcctaacataccacataccattttgcacttcttcttgtcttccatttattatagtcattattatgtacagcatttatttatatgaatgactgtttaatgtctctctcatattagaactacgattgtggtacttaacactatattccaaagtctggcatgcagtagtcagtcatgtaatggaattattaaacaaaaatgaagcaaaccaatcaagtccccctttacaaatgattttctttcatagaacattattgtattagcgcttggtataacatgctatttttcttttttcttttttttttgagatagagtctggctcttgttgcccaagctggagtgcaatggcatgatcttggctcaccgcgacctccgcctccaggttcaagtgattctcctgccttagcccccaagtagctgggattgcaggcatgcgccaccacacccggctaattttgtatttttagtagagatgggggtttctccatgttggtcaggctggtcttgaactcccgacctcaggtgatccacatgcctcggcctcccaaagtgctgggattacaggcatgagccactgcgcccggcgagcatgctatttttctaatcgaagttactcggatattttacattactgtcccctacagtttctgaaaaatctgagagggttaaaataagattgctaacttttaatttctcaaagtaagtgtctattattaccattttagaaagaattattttaaaactaaaaagtataagaacatgactctaaataaaaattttgaataaatttagctatatgaaaaataatataaccctagttttcttattttactgctccttagaaccactgggagggcaggtgcagtggcccatgcctgtaatcccagcactttggaagactgagacaggaggactgcttgaggccaggagtttaagaccagccaggcaacatagtgggcttcgtctctacaaaaaaacaaaaacataagctgggcgtggtggtatgtgtctgtgtttccagttactcgggaggctgaggtgggaggaccacttgagcctgggaagttgaggctgtagtgagccatgattgcaccattgcactccagcctgggtgacagtgaaactctgtctcaaaaaaataagtaaactgaaataactattgggttaaagggaaagcaaagtaactaaaatgtaagctatgtgttaataaaaaggtttgtttaaaaccgtattattatggccgggtgcgatgactcacacctgtaatcctagcactttgggaggctgaggcaagtggactgcctgacctcaggagctcaagaccagcctgggcaagagggtgaaaccccgtctctactataatacaaaaaatcagccgggcgtggtggcgtatgcctgtagtcccagctactggggaggctgaggcaggagaattgcttgaacccgggaggcggaggttgcagtaagccaagatcacgacactgcattccagcctgggtgacagagtgagactctgtctccaaaaaaaaaaaaactgtattattttactttttatctaactcttgccatataaacaattacatacattaaaaaaaaaaatccctcaagttgctcgtgagaaacaataaataaactaaatgaataaattccacaaataataccagcatgataacaaagggatcagttccaatgactatgttctcttcctgaagaatgccatgtctggtttaagttgaccaaagagaaaaaacaaaaacaaataataacaacaaaaacagcaaaagcaaacaaatgtcagcaagcctcaccccagcaattgcatgtgcaagtaatgtcttcccacagcctggtggtccatgaaggagaactccacgagggggcacgacgcccaggtggtggtacacctccgggtgacgcatgtgtatgagcatcttgcagacctcctagcagaggataagcacaaagatgtctttcaagacagaacaatcaaagtagaatgaaatgtcctatttttcggagcagtgaaatggagtagataggtagaatatacaccttagacttagatcagactttgaatcctggctctggtacctactgtgtgatttcagcaataacctctctgaggagctatttcctaagctgtaacattatataccttgaggatgtaatgcaaagttaactagcatggcagatgaaaaagagtaggcattaaaaataaagttaccattacggccaggcatggtggctcacgcctgtaatcccagcactttgggaggctgaggtgggcagatcacgaagtcaggagatcaagaccatcctggccaacatggtgaagccctgtctctactaaaaatacaaaaattagctgggcgtggtggcacatgcctgtaaacccaactactcgggtggctgaggcagaagaatctcttgaacctgggaggcggaggttgcagtgagccaagatcgcgccactgcactccagcctggtgacagagctacactccttctcaaaataaataaataaaataaaataaaaaataaataaaaataaagttaccattactattagtattgctaagacaatattacttataaagcatggatcttatatatactataattaaaataatagaaaagttcaaaatagtatgcatcttttctcctgcaatgccctaaagggtacaggtcaggtttgcccttctcaaccttcccagtttccttttctacacccagatcatattagaaacaaagaggtaggctttttcctcataactgattagtaatatatccatttgaggtaaaattcagaatttgcactaacttttaatgtcatatcattgcctcccacatcttcaaacttcacgttggagatctggaattctaaccccctggctttagctggtaaacaaaaatgaggagatgaaaagattaatgattcagtagtaactcataattataatgaatagtctttaagtaaacaaaggtccattaaatatagaaatatttcctggtaaacatttctgcacatagaaggtccctcaagcaaaatagcttgggacagaatgatgcttctctcactgcaaacatgaccactgccaccaacaagactcacaccttacctttcttttgcaggacagcttcaatttctccatctacttcctgaagatcttctttcttccttttgcttcctttattctttagcttgcctttccgtttcatatcactctccaaaagagaagaatcttttgaatcctggaaagaaaataaatttaaatatgccatgcttaaaattctatgccaataattgttttactttttaaagaggggcattgtaaagaaaattcattcctgccctagcactttcacctctgttaactattcccaatctctttgctcaaagatgctgtctattgtgaaagtccttctcctcattcccttaaagctcagtttaaatcttaacatttggtgctggccttggcagcacatatactaaaattggaatgatacaaagattagcatggcccctgtgcaaggatgacatggaaatttgtgaagcatcccatatggggaaaaaaaaaaaaagaaaaaagaaatcttaacatttgaatgccgcttcttttccagattctttcagttagagtttgtttttgtttttgttttgagacagagtttcagtcttgtcacccaggctggagtgcaacagcgcgatctcagctcactgcaacctccacctcctaggttcaaacaattctcctgcctcagcctcccaagtagcccaccaccatgcccagctaatttttatattatcagtagagatggggttttgccatgttggccaggctggtatcgaactcctgacctcaggtgatctgcccacctcagcctcccaaagtgctgggattacaggcgtgagccgccctgcacggccctctttcagttagatttaatcttgtcctcacattcccaagacactgcatttgcagctattatcagttggaataatctgccttgtatgagtgattcacttatctctgtctttctcactgaattgtgagctccttgattaaggacactgatatttgccttttatttctcactgagtcttctatatagttgtcttcatctgacagctgatgattcactaaattaaatataactacagagctgctttgacagtcataacaaagtgtaattcagccaagcacactgggacacacctgtagccccagctacttgagaggcagaaggaccacttgagctcagggtttcaaggctatagtgttctgtgatcaagcctgtgaaaagtgactgcactctagcctgggtgatgtagcaatattccaactcttaaaaaaaaattttttttttttgagacggagtctcgctctgtcacccaggatggagtgcagtggcacgatctcagcgcactgcaagctccgcctgccgggttcacgtcattctcctgcctcagcctcctaagtagctgggactacaggcgcccgccatgacgcctggctaactttttgtatttttagtagagacagggtttcactgtgttagccaggatggtctcaatctcctgacctcatgatctgcccgccttggtctcccaaagtgctgggaatacaggtgtgagccactgcacccggccaaaaaaaattgtttttaagtatgattcaggctgaggtgggtggatcacttgagctcaggagttcaagaccagtctgagcaacatggccaaacgccatctctacaaaaaatacaaaacttagccaggtgtggtggtgggcacctgtagtccccagctacttggaagactgaggtggggggatggcttatgcccagggggtggaggttatagtgagccgtgatcatgccactccaccatgtcagtctgggtgacaaggcagaccctgtctcaaaccaaaaaaagtatttcagcattaagactcgagttcttgccaaccataacaatgttccctatagatggatgatatggataattaaagcaaagagatttggaaaggcctattaataaataaaaaggggaaaggttctgccaaatcaaagggcttggttcttagaaatcagttgaagcatcattgtccatgaggaatatgtgagccacatatgaaattcatttaataatctattttacttaacccagtatatccaaaatattatcatttcaacagtcaatataaaatattattaatgagatgttttacattctatttttttagtgagtcttcaaagtctaatgtacactttaagttaatagcacatctcaatttggaccctaaattttcatgggaaacacctgatttgtacttagagtttgtaaaatttacagctgaggaaatagattcacatacctaacagggtggtaggagatgaaactgaaaagaaagtcaggcagcgaaatcataaaggacgttagtggctgtcacaggcctttggatttgaaactgaatgaagccactggagggttttaaatagaagaatgataatatgtggtggctcacgcctacaatcccagaactttgggagtccgaggcgggtggattgcttgaccccaagagttcaagaccagcttgggcaaccctgcaaaacaccatctctagaaaagatataagttagctaggtgtggtggcacatgcctgtagtcttagttacatgggaggctgaggtgggggatggcttgagcctggaaggcagaggttgcaatgagccaagatcacaccactgcactccagcctcagcgacagagccagacccagtctcaaaaaaaaaaaaaaaaaaaaaaagctatctctctgtgtaaagaataaactaggggaacaagaaaggacacagactccagctagaaggctgtttcaataattaagtcaagaatgagaaaaggcttagactaggatagaaagaatggaaagcagtgcaatgtgatcaaattctccatatattttaaagttcctatgccttccacaaaacacaagtatctgattgatattatattcaactaaaaggttgaaatgtacttcgatgatatggggctaaaatttcattacaaaaatacctgtatctcagttattggcttcttaggattacttttctcacatgacaggtccaagaaaaaactgtctttctttacacttggggttttgtcaataaaccatcctccttcagaatctttggcaggggtcttcaagggaatggagcctgttttggaacttatccgtggtgttgaagaggtggtttctctttgctccatctcaggagtatttgaaacagaatcaggatttcctttccgatataaagacagcagggaactgttcatgtgatttgctgactggcagaaagataaaacaaaattgtagcataaattactcaacaggtactcataaaagttgtattgcctatagtaataagttttctatattttgttttttaacaacttctctcagaacatttataatcagaatatataggtgttaggctgggcacagtggcttatgcctgtaatcccagcactttgggaggccgaggtgggcagatcacttgaggtcaggagttcaagaccagcctagccaacatggtgtaacaccgtctctagtaaaaatacaaaaattagccgggcgcagtggtaggcacctgtaatcccagctacttgggaggctgaggcaggagaatcacttgaacccagcaggcggaagttgcagtgagccgagatcacaccactgcactccagcctgggtgacagagtgagactccatctcaaaaaaaaaaaaaaaaagaaaagaatatatgggtgttcacaataagatgactcacaaacaagcatttactattcaaaaagacttcactcggccgggcgcagtggctcacgcctgtaatcccagcactttgggaagccgaggcgggcggatcacgaggtcaggagatcaaaaccatcctggctaacacggtgaaaccctgtctctactaaaaatacaaaaaattagccaggcgtgatggcggacgcctgtagtcccagctactcgggaggctgaggcaggagaatggcgagaacccgggaggcggagcttgcagtgagccgagatcacgccactgcactccagcctgggtgacagagcgggactctgtctcaacaaaaaaaaaaaaaaaaaaagacttcactccattccaatggaaaccaattcataattggtggttaaataaaataaagtaagtatggttgcttcgaaaaaaaatacactaaagaagtatgaaaatgagctggttgccaatgagagtcactgttattccatcaaagcaaaattgggactgggcgtggtagctcacgccctgtaatcctaatgctttcggaggccaaactgggagaactgcttgaggcctagagttcgagaccatcctgggcaacacagcgagaccctgtgtctacaaaaaatttaaaatttacccaggcatggtggcacatgcctgttatcctagctacttgggaggctaaggtaggaggacaacttgagcccaagagtttgaggttgcagtgagctaggaccatgccactgtactccagcctgggtgacagagcgagaccctgtccccgtgaaaactggatcaaatattttgataatatattcaaaacttatataccaagggaaaaaataaaaagcaaattataaataatttgacaaacagttggccctctatatccaagggttctgcatccagggattcaatgaacctcaatggaaaatatttgggaaataaaaagcaattaaaaaacacagtacaccaataaaaataatacaaattttaagaaataaagtgtatgctgggcatgttgtctcatgtctgttattccagcactttgggaggccaaggtgggtggatcactcaaggccaggagttcaagaccagcctggccaacatggtgaaaccacatctctactaaaaatgccaaaaagtagctaggtgtggtggcgcacaccttaatctcagctactcaggaggctgaggcacgagaatcacttgaacttgggaggcagaggttgcagtgagccgagatgacaccactgaactccagcctgggtgacagagcgagaccctgcctgtaattccagctcctcaggaagctgaggcaggagaatcacttgagctggggaggtggaggctgcagtgagccgagatcgcaccactgcactccagcctcggtgatcacaccactgcacttcagcctgggcgacagagtgagactccctcgcaaaaaaaaaaaaaaaaaaagaaagaaatatagtgtaaaaactatttacatctcatttacattgtattattacaagtaatccagagataatttaaagtatacaagaggatgtatataacgttatatgcaaacatgatgccattttatgtaagggacttgagcatttgcaggtattcatgtggggctctggggccaatcccccatggatagtgagggccgactatattatctccatattctcctttaatcaagccttttcattactaatgccatctccttgacaaaaagtatatccctttttccatttttactattaattactctattcttgtctgcccttatttctagctattctcttcccttctttttccttgtataactgacttataaacataaatactggaaggatggttaatccatcaccaacactgaacacagaaagtgttcaattatttattgatgaagacttccgaagtctcttattctattccctgtccttcctttctccctccctttagccctaacccttttttttctttccctctttctttccttctcctctctctctctctcttttgcaataaggtctgtcgcccaggctgaagtggaatggcacaatcatagctcaccgcagcctcaaactcctgggctcaagcgatcctccagcctcagcctcctgagtagctaggactatgggtgtatgccaccagatccagctaatttttatttgttttttgtagagacagagtcttgctaggttgcctaggctggtcttaaactcctggcttcaagtgatcttcctgcctcagcctcccaaagtgctgggattacagacgtgagccataacccctggccttttattctattccttactgatttttatttatttatttttttggagacaggatctggttttgttgctcaggctggagtgcagtagtgcaatcccagctcactgcaacctctgcaacctgggctcaagtgatcctcccacctcagcttcctgagtagctgggaccacaggtgcaagccattacacctggctaattttggggggttttttggtagagatggggttgtgccatgttgcacaggctggtctcaaactcctgggctaaagtgatccaccctccttggccttccaaagtgctgggattacaggcgtgagccacgacagctagccttatttttttttttaaaaggtagggtctcactctgtcacccaggctggagtgcagtggtgcaatcacggctcactgcagctcactacagccttgacctcctgggctcaagtgattctcccacctcagccccccaagtagctgggaccacaggtgcatgccaccatgcccggctaacttttgtattttttgtagagacaaggtttcaccatgttggccagacttattttttcatactttttatagagacaaggttttgccatgttgcccaggctggtctcaaattcctgggctcaagtgatctgcatgcctcagcctcccaaagtgttgggattagaggtgtgagtcaccatgtccagctaatactgagtttttcaagggaggtaccataacaactaaaaaagaaaaaatctaagtggacccactaaatgtttggcttacctgtggatctgggtagtcttccatacttgaatcatcatcagaatagctttcagtatacctcagtaaaaggagggaaaaatgttttaaagactttctctcccatatcctaaaaaaatgactacccaaaacaagtaaatatattcagccaaaagattatggtggttaagagtccaaactctggaatcagagaaactaggattcaaaatccaacttaaccagttattacttaacctctctaagcgtcagcttccttatctataaaacggagatttaataagtaatgtctgtctcccagggttattaaaggattaaataaacacttgcaaagtccttatgcatttacaaaatataataaatgcaaaataaattatagttatatttatcctagcaataaataaaagtgagatacaaattccctcaggcccaagggtcccatttagggatatcagattcaggtagaggaaatatttcagcaacctataattaagtactctgagtaacaaattcacaaagtcaacatgaccaaagcatgtaaccaaatacaacttctgcaagactgttcatgagggatgaaggagcaaataaatttcctgtatcaaaaaagaggtataaagcctaataaactacaagctgagaatgtagtcttaattcattataactgaaagttgttatctaatagcttcaagtaacttcaggacactgctagtatttaatacttctttggaaattatttaaataggcccggcatggtggctcacgcctgtaatcccagcactttgggaggccgaggtgggtggattacctgaggtcaggagttcgagactagcctggccaacatggtgaaaccccgtctctactaaaaatacaaaaattagccaggtgtggtgaaaatacgcctgtaatcccagctactcgggaggctgaggcaggaaaattacttgagcccgggagacggaggttgcagtgagccaagatcgtgccactacactccagcctggcccacagtacgagactctgcctaaaaaaaaaaaaaaaactatttaaataagaaaaaaaaaaagcccttttcttatttaaataatttttttttttttttaggtagaaagctttatatgaatgcaatgaaatgctgttataattaagatattaagatacaaattctagcctgggcaactaagggagactctgtctctacaaaaaaattaaaaaattagctgggcatgctggcacacacctgtaatcccagctacctgtgaggctgcggtgggaggatcgcttgggcctgggacgtcaagactgcggtaagccatgattgtgccagtgcactgaagcctgggtgacagagcgagacgctgtctcaaaaaaaaaaaaaaaaaaaaaacaagcaaattctgtattcattaaaattaatcagcattacttgggagcaattctaatcaatgtaaataaggtatatcattcaactatttgaaaaaaaaaaaagttttgccttacaactcatgccctaaaaaaagaaaaaaaaaattccaagtggattaaagagttaaacataaagaaagaagaaaaaagtgtaagtaattattttacacactcttgtgagagaggtctttctaagcatatcagcataaaacaaaaggaaaaagactgatagatttgactacataaaaatgcaaaacttctctaatcaaaagatggtgcaagcgaaaattaaaaaagaagtggcaacatggggaaagcagttgtaatgcatataaagaggtattattttatgcaaaaccctctgacaactaataaggaaaatgcaaatacctctcaaatgaaatagaaaaaactccataagcaagcaattcgcaaaacaaatatgaaataacaaaaaaactaacctcaataattataaaatcacaaataaaaatatgatcaaggccagaggcggtggctcaagcctgtaaccccagcactttgggaggccaaggtgggcggatcgcctgaggtcaggagttcgagaccagcctggccaacatggtgaaaccctgtctctactaaacatacaaaaattggccagcagtggtggtgggtgcctgtaatcccaactactcgggaggctgaggcaggagaattgcttgaacctgggaggcagaggatgcagtgagtcgagatcgcaccactggactccagcctgggtgacagagcgagattctgtctcaaaaaaagaaaaaatatatatgatcaatattttgcctataaaaacagcaaagattaaattatagtataacaaagattgcagggatgcagagaaatgtgccctttatacaaagttgttgggagtataaactgaggcaacctttttaggaaggtaagtccaaatgcactggaaatctcaaaaatataaatctttgaccccagaaattccacctcaaaaattcaacataaaaaagtgatgtgtacaaagatatatgcagtaaagcagtaaagagttatttattatgcaatagtgtaacacaaataaatatccatgaatatggaactggttaagaaaattatgataaatctaaatgaaaaaggctgagctacaaacagtaaaatggggctatcaccccaaatcctgtagacattaaaaggataacaagagaatattgcagaagcattatgccaccaaattccacacctgagagaaaatgaacaaatgattaaaaaatacaatttatcacaattgacataaggagagatgtaaggaagagctgtatatctagcaaaattaaaatttatcgaaatccttcagaaaaagaagactcggggggaagttgactctaggcctagaaaaactgtggtcgaacactaacaaatattcaaaaaagaatttccataatgtgttttcataaaatagagaacaaaagaacactttcccactaatatcatgaggccggtgtaaccctaacaccaaaatatgacagacattccaaaaatgaacaaaagaaaattcagaccaatatgacatacagatgcaaacatctgtagaaaaagattagtaaatcgaatccaattaataccctttttttcaaaaattagccgggcatggtggcatgtgcctgtaatcccagctactcaggaggctgaggcaggagaatggcttaaacccgggaggcggtggttgcagcgagctgagatcacgctattgcactccagcctgggcgacaagagtgagactccatctcaaaaaaacaacgtcaaacaaatactctttacaaataactctgtttctttttttttttttttagagacaaggcctcactctctcacccaggctggagtgcagtggcataattatagctcattgtaaccttcaactctggggctcaagcaatcctcctacctcaacttccaaagaagctgggatagaaccatgcaccactatgcctggctaatttttaaattttctgtagagacagagtcttgctgtgttgcccaagctgccaacaatacattaaaaagataacatatcaggaccaagtagagtttatccccaggaggcaagattggcttaatactgggaaccaatgtaattcatcaaattaatagactaaaggggaaaggccataatgagaaatttcaacagatgcagaaaagcatttgacaaatgcaatacctattcatgacaaaaattctcagcaatctaggaatattaggaaacttcctcaatctgacaaaggacatctacaaaaaaacctaaagctaatgtcatatttacagtgaaacactactgaaaattaaacactgaccataacaaatatcagcaatttgtggaaagagtagaattctcataaactgctaatgtaaaagtaaaatggtataaagacattggaaaatagtttggcaatttcttaaatatgcatctatcacacgacccagctattctaatcttagatatttaacaagggaaatgaaaatactgtccacacaaagacctggctttaggcaaccattgatttgctttctgtcactatatgttacattgcattttgtagaattttatgagcataaatgttcatagcagcttaatttgtaatagccagaaactggaaacaaaccaactgcccaacaagagataaacagataggtcaggcaaggtggttcacacctgtaatcccagcattctgggagtccgaggcaagaggattgcttgagcccaggggtacaagaccagcctgacaacatagtgagacccccatttctacaaaaaattagaaaattaactgggcatggtagcatgcacccgtatgggagaatcgcctgagcccaggaggtagaggctgcagtgagttatgatatgcctctccactacattccagcctgagcaacaaagtgagactctgtctcaaaaaaaacaaacaaaaaaacagataaatagataaaataattgcagcatgtccatacatacttatcaataaaaagcaatgaactattgatacacacaacattgataaatctcaaaatcatgctaagtgaaagaatgaaagaatccagactttaaaagtatgattccaaataaaattctacaaaatgcaatgtaacatacagtgacagaaagcaaatcaatggttgcctaaagctgggtgctgtggctcgcacctataatcccaacactttgggaggatgaggcgggcagactgcttgagcccaggagtttgagaccaacctgggcaacatggcaaaaccccatttctacgaaaaattagctaggtgtggtagcatgtgcctgcagctacttgggaggctgaaggagaagaatcaagtaacctgggaagtcaaggctgcaatgagctgtgatcgcactccagcctgggtgacagagtaaaaccctgtctcaaaaaaaaaaaaaaaagaaaaagaaaaaagtttgcctagaagcaggggtggagggagaaatgaattgcaaagcggaacaagaagacttttgatatttatggaaaggttcagtatcttgcttatggtgatagttcagtgagtatatctatatgtcaaaacttaacaaattgtacactttaaaaatgaagaggttggccaggcgcaatggctcacgcctgtaatcccagcactttgggaggccaagatgtgcggatcactagaagtcaggagttcgagaccagcctggccaacatggtgaaaccccgtctctaccaaaaatataaaaaattagccgggtgtggtggcacatgactgtaatcccagctacttgggaggctgaggcaagagaatcgcttgaacccggggggcagaggttgcagtgagccgagatggtgccactgcactccagcctgggtgacagagtgagacttaatctcaaaagaaaaaaaaaaaaaaaagtagagcttactgatgtcaattatacctcaataaagctattttttaaactctcaatactatttcttaaacaaaattaatcagcacctttttatatatctgatattgtattagggcagaaaaagaaggtaatgagacagtactgttggtaatgcaaacaagtaagcaaataatttcaatgccgtatgatatgataaggattataacaaatatctgtaactagaagctaaggaaacatttaaaaaggggtcttaggcctaataaaggcagtaacatttcaactgattcttgagggctgtgtgggagtttgtgaaagggaaatgacactctaactcaataaaaccacccatacaaaggcacagccaaagagaatttgatctctttggggaataaagaacattcaatatggctgaagaggttaggtaaatatcacgcagggctttgttggcaatgaagagccactgaaagttttacaagcaggaatgtaacatgataaagttcatggtttaaaaaaaccctgcatttggtatacttactcattatcctcttcaccttgtcttgccctttttgccaaatgttcatcttctaattctgttaaattcttaagttccttctcactactaattatgctaaatactgaaacaaaaagaaaaacgctatgagctaaaacaatcgtttgtataactttattgataatttagctctaacaataagactcacctttttctacctgaatcctaaaagcatttctttttcttcgaccatagtctatactgaaaaaagaaaacaagaagtttaccatagtagtctccaccaatatttttccattaagttcaatctaaatggatcaaataaattttcatgaatatttcattgttacagtatagacacttgccataaccctattttcaaacttctaagtttatatatttactattgtgacctttctccattttcccccttttttaaactaaccttttttgcttcaaatatttttattttaaaatttcaaagttactaaaaatatgaaagaaataatgtaatcaacactcgtatattctttacctatagtattctcaaactgccacatttactttacttctgtctacatatagagatttcttttggaggggtagagcaaaaccatttgaaaataagttctaggccaggcacagtggctcatgcctgtaatcccagcactttgggaggctgaggtgggagaatcacttgagcctaggagtttgagaccatccctgccaacatagggaaaccctatccctacaaaatattaaaaattagccaggtatggtagtacgtggctgtagtcccagctacttgggaggctgaggtgggagaacagcttgagtctgggaggtgaaggctgcagtgagccgtgattgcgccaatgcactcagcttggccaacagagcaagatctcatctcaaaaaaaataataaattaaaaaactaagaagaagaaactaagttacagacccttcgtctcaaaaattctcagcatgtatctctttaaaaaagaatatctgcagccaggtgcggtggctcactcctgtaattccagaactttgggaggctgaggtgggaggatcatgaggtcaggagattgagaccagcctggctaacacggtgaaacctcgtctcttctaaaaataaaaaaaaaaaaaattagccaggcgtggtggtgggcgcctgtagtcccagctactggggagcctgaggcaacagaatggcgtgaacccaggaggcagagcttgcagtgagccaagatcgtgccactgcactccagcctgggcgacaaagcgggactccgtctcaaaaaaaaaaaaaaaaatcagctgggtgtggtggtgcacacttgtggtcccagttacttgggaggctgaggcaggagaatcccatgaacccaggaggcggaggttgcagtgagccgagatcacaccactgcactccagcctggggacagagcaagactccgtctcaaaaaaaaaaaaaaaaaaaaaaaggatatctgcatagctacaatacaattagcacaaataagaaatttaatattgataaattatctaatatacagtccatattaaaatttctcaaattattcccaaaaaatggtctttatagttgtttttctttctttctttttgtttttttgaaacggagtctcgctctgtggcccaggctggagtgcagtggtgcaatctcggctcactgcagactccgcttccggggttcacgccattctcctgcctcagcctcctgagtagctgggactacaggcgcctgccaccacacccggctatttttttgtatttttagtagagacaggatatagttgtttttctttgacccagagtctagtcaaggttcatgcatttacttggttgttgtgtctctttggactcttttaacttgtaataatctcttcacctttgtgcatgtaacactgacatttttgaaggatccaggccagctaatttataaaatgtcccacaatctgaatttatgtctcctcattattaaattcaagttaaacatttttagcaagaccatctgctaaaaatataggtgaaagtttgatgagtacaggatatttgtataatctgaaaatatattcttataaattatttattaatttcaaattaatttacagtggatcgatcaaaactaacattaccgaataacaccccacacagatattctgtgccttttgaagtcaaattgcttctttggttttccttccaaaaacatataacctgattccaaccatgtgaaaacagcagaaaaatccaaattgagggatattctatatagtaactacctgtaatcttcaaaaatgtaaagatcatgaaaaacaaaaaaaggttgaggaactgttgcagattaaaggaaactaaaaagcaaaacaagcataatttaggggctggatttcagttctggaaaaaaaattccgataaaataatagctataaagaacattattgagacaggcaaactctgaatatgaatggtggattcgataatattactgaatcaagattacattttctggttttaataaataaactgtggttatataataaaagcctttgtccttagggaatagatagtatgcatggataaagggacattctaggtagagtatatgggtgttctttgtactattttttccattttcctctttataaaaatctgtgccagcgcagtggctcacacttgtaatcccagtactttgggaggccaagatgggcggatcatttgcggtcaggagttcgaaactagcctggccaacatggtaaaaccccatctctactaaaaatacaaaaatcagccaggcatggtggtgggtgcctgtaatcccagctacttgggaggctgaggcaggagtatcacttgagcccaggaggtggaggttgcagtgggcagacatcacaccaccacactccagcctgggtgactgagtgagactccatctcaaaaaaaaaaaaaactttatgtttttgagacagggtctcactcagtcaggctgaagtgtagttgtgcaatcagagcttgccacaacctcaacctcctggtctcatgcaatcctcccaccccagcatccgagtaggtacgatgacagacacgtgccagcacacctagttaattttttgattttttttgcagagatgggggtctcactatgttgtctaagctcgtctgggtcagtttttcttaaatgtgaaattacttcaaaacacaaagttttagatgaggcaaatattgtactaaatcatgaccatttaaaaaggcaacttggggcctggcacggtggctcatgcctggaatcctagcactttaggaggctgaggcgagaggatcacttgagctcaggagttcaaggccagctgggcaacatggcaaaaccccatctctacaaaaaatacaaagaatcagcggggcatggtggcatgtgccttagttccagccatctgggggctgaggcagaaggatgagcccagggggctgaagctgcagtgagccgagattgagccactgcactccaacctggatgatagagcgagactgtgtctccaaaaaataaataaataattaattaaaaattaaacaaagagagaaagaaagacgtaaaagcgattcttcactcatgagccatacaaaacaaggtggtaggcaggaactggtttgagggccatagtttgccaacacctggataagagaagatggcagatggatgtaggcagaatgtttaaaagctgaaacaggccaggtgtagtggctcatgcctataatcctaacactttgggatgccaaggcaggaggatcacttgaggtcaagagttcaagaccagactggccaacatggcgaaaccacatctctactaaaaatacaaaaattatttttagtaataatttttaaataaattttaaataaatttttagggtgtggtggtgtacacctgtagtcctggctacttgggaggctgaggcaggagagtcacttgaacccaggaggcggaggttgcagtgagccgagattgccccgctgcactccaccctgagcaacagagtaagattccacctcaaaaaaaaaaaaaaaaactgaaacagtagtctagacaagaaataatgaggctctggattaggctagtatagtaatggtagggaaaggagagaacaggcatcatgaaatatttaagagaccacagcaaggcttcttggtgacttattatagacatggcagggggattcaaggctaggtagaaggaagtggacaacatacagattaacctgggtgactggctgagtaacagtcataccaccaactaagaaaaaaggttaccaacaaaacacaactcacagatttcaatggagtgagtggcggggatagaaacaatcttagtttagtctttatttttattttttaagagacagggtcttgctctgtcacccacgcttcagtgcagcggtgcaatcgtagctcactgcagccttgaattcctggcctcaagtgatcctcctgcttcaacttcctgagtagctaagacagactacaggtgcatgccacgctaattttttttttttttttttttggtagagacagaatcttgctatgttgcccagtctggtctcaaactcctagcctcaagcaatcctcctgtgtcagcctctctaagtgctgaaattacaggtgtgagccactgtgccctggccttagaccactcattaaataaattctgatcaggggaaggaaaaatactactgagtggtagccaaagtgaggtatactattgttttaaaaagctttctgtcttagtttctcttcttttcttccttcctaatacagattttggtattgataagtatagtgctactgtgacaaataccttaaaatgtagaaatggtttcagaactaggtagtagaggccagagagttttgaggtgcatgttagaagaaacctagatggctctgaagtgactgctgttagaaatatggacaccgcagggcgtggtggctcatgcctataatcctagcatgttgggagaatgaggcgggcagattgcctgagctcaggagttcaagaccagcctgggcaacacagtgaaaccctgtcgctactaaaatacaaaaaattagccaggcatggtggcgtgcacccgtagtcccagcccctcgggaggctgaggcaggagaatcgcttgaaccagggaggcagaggttgcagtgagctgagattgcgccactgcactccagcctgggtgacagagtgagactccatctccaaaaaaaaaaagacacggaaggcaattctggtaagagctcagaaagacaagagaagagctgtacaggaaggttctatagttatatacacacagagagagaatgctattagaaatatgaatgttaaagatgcttctggtgaggtctcagacagaaatgagaagcaggatattggaaattggaagaaaggcagtccatgttacgaagtggcagaggacttgtgttttactgttttaaaagtagaacttgtaagtgatgaatctagatatttcactcacatttccaagcaaagtgttgaagtgtggcctgatttctccttgctgcttatagtaaaattttacagtatagagagacataaagaaggaattgttcaacaaaaaggaaactagaacctgaagattggaaaattctcagtttatccatattgtaaaaaatgaaaaagcataatctaaagagaacatcaagggtgtggggggacaacaatttgctaaagcgattaccagcatatgacttatggatccagtcagccatcttagcagaagccaggaatagacatggggttaaagcaacagaaacactgccagcttggactgaagggaccgagatggggacaaaattaaggaaggctgttggacttccaggattctataggacagggccaataaaaccatccagttgtgaacacaagttatccttcaagaaaagggaagaacgacccttcaggaggctcaaaagaaggcagggctgccactgccaacacaaacccagagggcacaggtccggcaggtggggctgcctcctcctaggtaacagggcaggatcaccaccctacggagcccacagggcagggcatcaagccaaagaggattattctaacatctgaaaatctaatgacatttgccctgcttggttttagatttgcttgggacccatgaccctttcttttttccaattgctctcttttagaataggaatgaatgtctaacctacacctatgcctgtcctgccattgtacaattgtgcatcactaaacaatggagacacattctgagaagtgtatcattaagcattttcattgtgtgaaaacaaaaataagtaagagtatacttacacaaacctagatgggctagcctattacacacctagactacatggtatagcctactgtgcctacaaacctatacagcacattattgtactaaatactataggcaactgtaacacaatggtattgtgtttttaaacatatctaaacacagaaaaggtacagtacaaatatgatgtaataatcttatgggatcaccatcatacatgaggtccatcattgactgaaacactgttatatagcacatgcctgtattttggaagcagataacttgtctggtttcacaggttaatagatgaagaggaattttgccccaggataaatcataccttgaatctcagccattaccaattaatttagataacattatttttatttattttatttttagagacagggtcttgctctgttacccagctggagtgcactggtgcaatcatagctcactgcaaccttgaactcctgggctcaagcgatcctcccacctcagcctcttgagtagcaaggactacaggttcaggccaccatgcccagctaattatttctattttcattttgtagagatggggtctcactatgttccccaagttggtcttgaactctatggccttaagccaatggcccctcaaaatgctgggattataggtgtgagtccttgcatctggcctgatttagatgatattgagatgagagtttggacttaagagttgatgctaaaatgagttaagacttttggggcttgtggaatggaatgaatgtatctgcacatgagaaggccatgaattttgggagccacaggacagagtccaataagctgaattgtgtttcccttatattcttatgttgatgtcctaacccccagtacctctgaatatgactgcatttggagatagagcctctagaaataattaaggtattcttggccaggtgcggtggctcccacctataaccccagcactttgggaggctgaggtaggcagatcacctgaggtcaggagttcaagaccagcctggccaacatggtgaaaccccatctctattaaaaatacaaaaattagttgggtgtggttagcacacgcctgtaatcccagctactcaggaggctgaggcaggagaatcgcttaaacccaggaggcagagcttgcagtgagccgagatcgcgccactgcactccagcctgggcgacagagcaagactccgtctcagaaaaaaaaaaaaagactcaggaagctggctgggcatggtggctcatgcgtgtcatcctagcacttagggaggcgaaggtggaaggatcacttgaggtcaggtgttccagaccaacctgggcaaatacagaaggccctgtctccacaaaaaataaaaataaaaactgtatttaaaaaaaaaaaaaaagaggctgggcgctgtggctcacgtctgtaatcccagcactttgggaggccaaggtgggcggatcacctgaggtcaggagttcgagaccagcctggccaacatggtgaagccctgtctctactaaaaatacaaaattacccaggtgtggtggcacatgcctgtaattccagctacttgggaagctgaggcaggagaattgcttgaacctgggaagcggaggttgcggtgagctgaggtcatgccattgcactccagcctgggcaacaagagcgaaattctgtctcaaaaagaaaggagtcaggaaactcagggagatcatacctgctggtgatggttttaattttctttcttttttgggacaggatcttattctgtcactgaggttagagtgcagtggcgtgaccacagctcactacagccttgacctcctgggctcaagtgatcctcccacctcagcctcccaagtaggtgggaccacaggtgcatgccaccaagcctggcaaatttttgtatattttttgtacagatggggtttcaccatgttgcccaggctggtctcaaactcctgggcttaagccatcctcccacctcagcctcccaaagtgttgagattacaggcatgagccattatgactggcccggttttaattttctaatgtagcaggaaaggaagtgatataataacatctctatctcttgaccagactgtcaggtactaaaagataagcagtgacccatttcccacagtacaaaagacattttactgcacataataggtatttgataaatgtttgcataactgaattgagttccaagattatggattggtgaactaatgccagcagctactgatatcaactggaaatttaggcaggatataaacttttaaaatggtaaaggagacataaaaatccaaggatccggaaactatatttatttacctgtacactctttgtaaatcagacgctaagactccaatgtccacatatttgccacatttgttactggtaaggtactaaaacagaaaatataacaaatacaaaacacccaatatttcaaactcagtgattttaatcaacagattgagctatctgaacacattatactttaagataaactcttcgttaataaagtgtaccagaaacataaataaaagtaaccaaataattgtcaaatatgaaatcagaaaatttaattaacattattaatcactataatacaatactaataattatcagaatagttataaggcagtaagtgagggcttacttactaatatcctaggtttccaaacaccccagaacactgcagtaaactcataagggtaggaggggatattttaaacttcaaggaacacagtgatatttgacatctgtcagatactgcagaactactagcttgaggcaatttagtttcaatattaaatcaccttttggctgggcatggtggctcatatctgtaatcccaacactttgggagcccaggagtttgagaccaccctgggcaacaaagtttgacctcatctctacaaaaaaattaaaaagttggttggatgtggtggcttgtgcttatactcccagcattttgggaggccaaggtgggagatcgcttaagcccagacttagaggttgcagtgagctatgatcgagccactgcactccagcctggataacagaacgagaccttatctcaaaaataaatacataaataagcccgggcgtggtggctcacacccgtaatcccagcactttgagaggccaaggcgggaggattgcttcagtccaggtgttcgagaccagcctgggcaaggtggtaagatctcatctctacaaaaaattttaaaattagccagacatggtggtgcatacctgtggtcccagctacatgggaggctgaggtgggagaatcacttgaccccacgagtttgagatggcagtgagcagtgttcacaccactgcactccagcctgggtgacagagctagacccagtctcaaaaataaaaaattaaaattaaattaaatatatagctaagtgaaaatttatttaaaatattgtgtaagactatcttcaggctatgtgtgtaaggtgtatatgaaacataaataaacttcatgtttaacttgggtcccatccccaaatatctcattatgtatatgcaaacattccaaaacctgaaaaaaatcaatctgaaacattttttggtcttaagcatttagaataagggatattcatttgtacttttataatgaaccaaagtgaaagctatagaggaaaactgataatgtcaaacgctgaaaagagtcaagtgtgaggacagagaagaggccactagatccagtaattaggagtcactgctcagaaacctcaataaagtgaaggagcaagttgtgggacgcgggaacatccagaggaagagtaattcagagtgactgaacaacgagaacaaaggtcctgtgcttggcatgtttgagaaggtctgtgtggctgggacaggagaggaaaagtaaactaggacaacagaggccagaatatgcagggcttttcagactgggttttactctagatgtctgtgactccactgaaaggttttgagcagggctatggcaagctctgatttccccccccttttttttagttatactttaagttctgggatacatgtgcagaacatgcgggtttgttacataggtatacaggtgccatggtggtttcctgcacccatcaacccgtcatctacattaggtatttttcctaatgctatccctcccctagcccgatttttccctttaaaaggatgtcttggccacgcctgtaatcccagcactttgggaggctgaggcgggcagatcacctgaggtcaggagttcgagactagcctggccaacatggtgaaatcccatccctactaaaaatacaaaaagtagccaggcgtgatggcatgcacttgtaatcccacgtactcgggaggctgaggcaggagaatcacttgaacccaggaggcagaggttgcagtgagcagaaaaaaaaaaaaaaattagatgtctctggctgctctgtggggaataggctttaggtaaaagcagaatcagagagatcagttaggaggctattgtaatagtataaggtagagatgatggtttggactaagatggttacagggaaagacagtaagaagtacttggaatatattttgaaagtaaagccaaccaggctgttgacagatggtatacaggaaatgaaagactcagaatgatccttaaggtttttggccttaacaacaggacgaacggtagtatcatttactgagatacagaacactaagaaagggcagatttgaaggaagaaaaaaatcacaaattccacttggccattttaatttggagatatgctgactaggcagctggatatatcaatctgtacttcaagataaaatctggactggagatataaagttagcagtcataaatatacagaggccagtgcagcagcttgcaccggtaatcccagcactttgggaggctgaggcccgatcgcttgagcccaggagttagagaccagccagagtaacatagtggaaccccgtctctacaaataataataataataataaattagccaggtgtggtggtgcacacctgtagtcccagctactggggaggctgaggagggaggatcacttgagtcagggaggccgagggtgcagtgagttatgattgtgcccataaacagccactgcactctagcctgggcaacagagcgagactatgtctcagaaaaataaaaataaaatgaaataaatacatagataatagagtatgtagatactactcaaaggttattacactaaatgagatcacataggaagtatggatagataagaaaggtgtatgaggaaagaggaggaaggggaggtaagagaacagtggcacagagcacttccaacatttacaagttggtaggaaaagatgggtccgaaaaggagattgtttaggggctggtgaagtgaaagaaaaacaaggagaatgtgtagctcacaaattcctaagtgaagaaaattctctcccaccttttaactcagactgcttgcttacattctgaggtatttgccacacactgctttttactgatggtcatgaaaatgagaaaaccgtaggcaaagtgcctgttactgttgccagacccatgttatctcgttttagtgtgtaagttccttgagaacggaaattaacatattatttatgccaccccttctcaaggacctcttacaatgcgagcgtttgaagaccattcctgtgctaacttcacaagccaaagaggttaaaattcaaaggctacctccactctactgaatgatctgcgctgaagacgaccagacaacttgggcagccctaccaagctgcaccctcccaccatccccggcttctccctgagactccgcaccaacgtgggtagggaaggccccggcagcaccaactaaggagaaacagacgcacgcccagacccagactggggaaagaagactagttgagttccacctggatgccacccgacaaaaggggagtggcaccctggggcagcgatcggggcccttggcgaggccaagcggtgcagaatacacacctggatgactcgctgcttgagtttattatccacgaaccctgcaggtctgggcttcatcgcgtcggtcttccaagccacagctcggaccgccagctcctagtcaaccgggggcctcgtaggggttgcccgccgcgatcgccgggccagttgcacctgaaatgcgcccctcctggggcctagcccgcgccgtttccgtcagaataaaagtaatgcgaatgaaggggaaaaaattccgaggagagggagaagacttgaaaacctcagggagtttctaggggccttattttgcaggcctgcccagtggaccctggaagattaggacccctttgaacgcgctcaactttattggttccccgccgggcgaaccaggtgggaggaagttcctaccccggcgcggtgtgcggagacgctgtcaacggcgtcctctggaaaacttggtttgctttcctcaggcgttccagccacacctcattctgatacaaagctagtcttcgcaaaaccagccacggtagatacttggagtgataaaatcagggtaaaaacacaccaccagccgctgcttgctttcccacgtagttatcttacattttagaggcccgacaaaagggctaggtgaaaaagaaaaggaaggacggatttatccagataactaagtcatttgttacttttagaactcgtttgacttacgctgttatcatcggcaggtaatttgttgaatatatccagtgcaggactccttggcccagaattttatcaaacgtttgtatttgccccaagaagtttatcctgcacttagggagacacaaagggacagttaccaagcattaaaaaaaaaatgctggctttagtttctgtcttcttgtttatttcaaccgtgttttgagtattcttatttcaggtcctccttggcttatgacaaggttaagtgcagtgtattaaggggcagaggggagagaaaatggaattaagagaagggcgtgaggccgggcacggtggctcacacctgtaatcccagcactttgggaggccgaggcgggcagatcacttgaggtcaggagttcacgaccagcctggccaacatggtgaaaccttgtctctactaaaaatataaaaattagcactgaattaagtattagatttcccactcaaaatattgatccgtttggttgcaacttcatttcctacttcttcactatgtgtagttttattttttatttttttagttgtaaaatataagaacattcaccatcttaaacattttaaagtgtgcagtttagtgataatacattcataatatgcaaccatcactgccatctagttccagaactcttttcatcttgtacaactaaaactctatactaattaaaaaataactccccattcctccctccccccagcccctggcaactaccattctacttactgtctttatgattttgactacactaacttcctcatataagtggaatcttccagtatttgacttttgtgactggcttgtttcttagcttaatgccctcatatagcatgtgttagaatttccttctttcttttcttttttttttttttttttttttgatacagagtcttgctctgttgcccaggctggagtgcagtggcgcaatctcagctcactgcaaccttcgcctcctgggttcaagagattctaccacctcagcctcccaagtagttgggactacaggtgtgtaccaccacacccggctaattttttgtatttttagtagaaatggcgttttgccatgttggccaggctgatctccaactcctgacctgaggtgatccacctgccttggcctcccaaagtgctgggattacaggtataagccaccgcacctggcctttccttcacttttaaggctgaataaaatttggctcttttgttgccattctgccttttgccatgggatgacacagcaagaaggccctcaccaaataacaactccttgatattggactttccagccttcttgcattcattcaacaagtgtttattgagtgcctaccagtttcagtctctgctctgcgctttaggcttgtggggaaaagtggaagaattataactaactttttataacatttaaaaaatttgattaggtatttatgtgcttgattaaatgttagcaaagattccctacagcatatagtacaaatgtagtcaatgctcagtaatttttaaaatgaaatgtaattctgtgcatgccaaatgtccaacatagaatgaaaacacactgaggccaggcatggtggctcatgcctatactaccagcactttgggaggcagaggcaggtggatcacctgaggtcaggagttcaagactagcctgaccaatgtggtgaaaccctgtctctattaaaaatacaaaattatccgggtgtggtggcccatgcctgtaatcctagctacttgggaggctgaggcaggagaatcacttgaacctgggaggcagaggttgcagtgagctgagattgcgccattgcactctagcctgggcaacaagagcaaaactccatctcaaaaaaacgaacaaataaacaaccacattgaaaggcctagtagtatcatgacatgtactaggcaatatagtttattagtctataatttgtcatagaatactatcctacacttagggttgacttcatgggtatgtgacctctgcagtcacacagggccctgtgctcagaagggccccacaggtggtttaatgctgtactgttgccatcttgaaatgctttctgaataagctgtcccttattttcattttgcactgggtcttacaaattatgtaaccagccattcatatgtaaacttgaagtactctagaatgctgccttcttcttctttttcttctttttttttttaggtggagtctcactatattgccaggctagagtgcagtggtacgatcttggctcactgtaacctccgcctcccgggttcaagcgattcttctgcctcagcctcccaagtagctgggactccaggtgcatgccaccatgcccagctaatttttgtatttttagtagagacagggtttcaccatattggccaggctcgtcttgaactcctgacctcgtgattcgcctgtctcggcctctcaaagtgctgggattacaggcatgagccactgcacccagccacctccttcttaaaggcagggaatgtgttgttcatctcactactgcttcaggtgcagaaggcaataattgaaagtgaattaatactagatgataatatgcttgaacatttctcgttggaattatttcatcaattattgccctgaagaccattttacattgattccaatgtttggatttacaatatcatgcatcaaaaccaaaaagattactgaacagtaacctaagtgcatatacactttaagcacttccttttttaattgaagcatcctccattctttggtggtgtaaccccacctagtggtagtggcgtattttatcttttgtctttcacactttctcctaaacctcatacagtatttcacaagcaaacagcttctggtctaattgtgcttcataactagggtgatttatgtccagatttgctcaggacagtcctgatttttgattcagcaaaattattgctagtatcccctttgtggaaatacatgaagaccaaatacataagaagaggtgaagactatttgttcagagtttgctataacaagggagtcagccaccatcacttgtgttttggcagagcctcaaagacaggcagaggagtgggaaaactttatggtggggaataggggaaggcttcaggtacgccctaactgaagactgttgtcatagggaagctataggtgggctaaatagaactagcagagcatcctatgtgtttggttgggatgcacagttggttttctttttggtcctatgttgacagcaggtccaaaaattagaaaagctatcatttattaataaagtttttgccatctggggccgtttgttacaggggttgttgctgggttcctggattgtttgctagtgatagtgatctaacttcctacatgtctgacttgtagatgatatattggttttctggtctggttgctgcagattgtgagtcagagttctatttttgcatttggtctggccatttttcattcacatgttcagtgtcttccttttatctctcaaaaaggttctagtttggacaatgtatgaccactctatgtatagtaggaacatggagaaaaagatgaagtttgcatgtcagaggatccttactgagatgcaaaaatgaggcttcctgcttgctgggagctggagactgagttctgttctgttatgttcttttcttttctttttcgagacagggttatatggtttggctatgtcgccactcaaatctcatcttgaattgtggcttccataattcttatgaattgtaggaaggacctagtggcagataaatgaatcatgggggtggtttcccccatactgttctggtggtagtgaataagtctcatgagatctgatgattttataaggtgtttcctcttttgcttggctctaattctgtctcatctgccatcatgtaagacgtgcctttactcttccaccatgattgtgagacctccccagccacgaggaactataggtccattaagtctgtttttctttataaattacccagtcttgggtatgtctttatcagcagtgtgaaaattgactaatacagagcatcccactctgtcgaccaggctagagtgcagtggcatgatttcagctcactgcaacctctgcttccctgttttttttgtttttgtttttgtttttttgagatgtagtcttgctctgtcgcccaggctggagtgcagtggcacgatctcagctcactgcatcctccgcctcccaagtgcaagcaattctctgcttcagcctcccgagtagctgggattgcaagtgcccaccatcacacccagctaatttttttgtatttttaatagagatggggtttcatcatcttggccaggctggtcttgaactcctgacctcgtgatccatccgccttggcctcctaaagtgctgggattacaggcgtgagccactgctcccggccacttccctggtttaagcaattctcccaccccaacctcctgagtagctgggactacttgtacgtgccaccacacccagctaacttttgtattttttggtagagacaggtttcatcacattggccaggctggtctcaaactcctgacctcaagtgatccgctcgcttcagcctcccaaactgctgggattacaggcatgggccactgcgcccggccttgagttttttgagattaaaaaaaatctttaatttattttatttggtaatggctaacgattccattttctaatcaggtttaccattctttgaggtgattgcctcatttatgttcctaatcctgaatagaatgaaaataatattttgagcttggcattttatacattcattctacaaatatttattgtctcctgtgtaccagttactatgccgaaatcaaaaaaaacagtgatgaccaaaacagatatggccttggaacttatattctacagtgtccctttagagagggacaggagatgaactggtaaatcaataaatgtttaattaaaaaatgagaagtaaggaggatttcatagcccatggtatagaatctttttatttatttatttatttatttatttagagacagagtttcgctcttgttgtccaagctggagtgcaatggagtgatcttggcttactgcaacctccacctcccgggttcaagcaattctcctgcctcagcctcccaagtagctgggattacaggcgtgcaccaccatgcccagctaagtttttgtatttttagtagaaacggggtttcaccatgttagccaggctggtcttgaactcctgacctcaggtgatccgcctgcttcggcctcccaaagtgccggtattacaggggtgagccactgtgccctgcctatttttttaattattattttttgagatggagtctcactctgtcacccaggctggagtgcagtggcgtgagcttggctcactgcaacctccacctcccgggtttcaagctattcaagcgattctcctgcctcagcctcccaagtagctggaattacaggcacgcaccaccatgcctggctaatttttttgtgtttttagtagagatggggttttgttatgttggccaggctgatctcgaactcctgacctcaagtgatccacccacctccacctcccaaattgctgggattacaggtgtgagccattgctcctggcctgaatctttcatatagaaattttttagtaaataattgttaagtaaatgaatgaaaattgtgaagtaaataatcagagtactgtgatagaaaataacaaggccaggtgcagtggctcacgcctgtaatcccagcactttgggaggccgaggcgggcagatcacctgagattgggagtttgagaccagcctgaccaacatggagaaaccctgtctctactaaaaatacaaaattagccaggggtggtggcgcatgcctgtaatcccagctacttgggagtttgaggcaggagaatcacttgaacccgggaggcggaggttgcggtgagctgagattgtgccactgcactccatcctgggcaacaagagcgaaactctgtctcaaaaaaagggaagaaaataacaaatccttttgtagttcctaagtgtgaagaatgggtgttcatgcagaaggataagatgtgctaccctcaaaccttgttccgtgcatattacacgtctgacatggaaaaaaaagaagaaaataaaaaagggagactacctcagtccctggtcaagggaggtctttctgagaatgtgacaggtaaggactttaagtatagcagaagccaattgtacaaggagagtgggaagagtttgaggtagagagagaataatgtgtgccaagactttaagcagaaaagaagttgacctgttctaggaacagaaacagagaaaaataagcttatttgttgtttcaaccaccattatttcagatttctgtcactcaaaaccaacattaatttgaacaaatacaggtatctggaggaattttaaaagtcgaatctaagattgatgcagaagagaaaatgacagaaaagagccaaaacattcctgaataagaacctggtatcattaacattttttaaaaaacactattgaggtataatttacctataataaaaagggtccatttaaagtgtataactcagtgattttatccatttatttatttatttttaaaagatggtctcaggccaggcgcggtggctcatgcctgtaatcccagcactttgggaggccgaggtgggcagatcacctgaggtcaggagttcgagaccagcctgaccaacatggagaaaccccatctctactaaaaatacaaaaattagccgggtgtggtagcgcatgcctgtaatcccagctactcaggaggctgaggcaggagaatcgcttgaacccgggatgcagaggttgtggtgagctgagattgcgccattgcactccagcctgggccacaagagtgaaactccatctcaaaaaaaaaaaaaaaaaaaagaaagtctcactcttgtggcccaggctggggtacaatggtgatcatagctcactgtaggttcagcctcctgaactcaagtgaccctcctgcctcagcctcctgagtagttaggattacaggcatgtgtcactgtgctggctttttttttttttttaaactgggtcttgctgtgttacccaggctggtttcgaacccctggcttcaaccaatccttctgcctcagcctccaagaatgctgggattacaggtgtgagccaccatgctggggaaatttttttttaattgaggtaaatatacatagcataaaattcaccattttattcattttaaagtatacaattcagtggcatttagtatgtttacagggttatgcagacattaccactatatagttccagaacatttcattagcccagaaagaaaccctgtaactattaagcagtcacttcagttttcccctcttcccagcccctggaaaccacaaatctactttttgtttctatggatttgcctattttggacatttcatataaatggaattatacaatatgtgaccttttgtgtctgacttctttcacttagcataatgtgtccaaggtttctccatgttatagcatatattaatacttcattccttttcattgctgagtaatattctgtggtatagatatatcccattttagttatcagttcatcacctgatagacatttgggttatttccactttaagtttcagttctgtggggtatacagtacacccaggagtggaattgttatggagcaagggctcactgcctgataggcatagaagccaatactgaggcaggagaatagggtgtggagacagggagccttcacttcagcttctgattagtcgcaggccaagtctttatttgcatagagtataacttacttcagcttccaattggtcaggggccaagtcttcatctacatagggtgtaaccaataggaaacttctaaagggtacttaaaccccagaagattttgcaaccaggagctcttgagctgcttgctcaagcccgctcccctctgtggcatgtactttcgcttcaataaatcggtgcttcattgcttcattcttttgttgctttgtttgtgcattttgctcaattctttgttcaacacaccaagaacctggacaactcgtcaagacctggacaacctagtcaagaccctccaccagtaacaataccatggcaacttgcttttgagaaaatagaaacctttattgcaaagttgacttggcatgctcaaatctgtctccctgagctggagaatggggacaggttttataggcagatagttacaatgaggaagataggaaaatgcaatgaggtagaccaggcgtggcggctcatgcctataatctcaacactttgggaggcccaggcaggtggatcacttgaggtcaggagttcgagaccaacctaacaaacatggagaaacctcatctctactaaaaatacaaaaattagctgggcatggtggtgcacacctgtggtcccagctgcttggggcgctgaggcaggagaatcacttgaacttgggaagtggaggttgcaatgagctgagatcacgccactgcactccagcctgggagacaaagtaagactccatcaaaaaaaaaaaaaatggaaaaatgcaatgagatatgatctgattgggtcatgctgagggtccttggctcttaagtctgtactgcaacaaaatagggtactccttgtttctgaatttggtccctgttccttgatccaagcactttggttctgcttgtgactgactttttcattcctcctggctcctaagtcaccaatggggcacacttggctcatctgggtatgcttaggttatgtaacttgcaacctgggggttggctgcactgagaaaccactcagaactttgtttcacaaaggttgaaccagatggaattgattccgctgttacagaattgctgggtcatataattcagtatttaactttttgaagaatcactgaactgttccctccagctgctgcaacattttacatttgtaccagcaatgtattgaaggttcagatttctctgtatcccccccaacagttaatttctcttttgttttttaattactgtggggaaaagcaagagagatcagattgttactgtgtctgtgtagaaagaagtagacataggagactccattttgttatgtactaagaaaaatccttctgccttgagattctgttaatctataaccttacccccaaccccgtgctctctgaaacatgtgctgtgtcaactcagagttgaatggattaacggcggtgcaagatgtgctttgttaaacagatgcttgaaggcagcatgctccttaagagtcatcaccactccctaatctcaagtacccagggacacaaaaactgcggaaggccgcagggacctctgcctaggaaagccaggtattgtccaa

SEQ ID NO: 371 - DNA, 451392 bp, Homo sapiens
tggggaactgattgcattccaggccttctgccctggaaggggtctgccctatcaccaacatcctcacccctacatgattcagcaggctcttcactcttgactcacagtggtaaaactccacccctttttactcataacctctgcctgggctcactcccttgatctgaattaatatactctcataaagctacttctttttttcttcagaggaataactgaagtcctcatccatcccccgtggctttctacttgatcagtgtccccctatcaactttctgacccactgtcatccgcagcccccacctctctagctgcataccacttgggtttctcagaaaagctcaaaggacgaggcttcaccctttatgctactgaattccatttatctccttattactcaccgtccacacctatgatcattgactgatttaaaatctccccacctcccccagtcacttttcataccagacataaacaccagtgcgtaatagctgcctacccagcccagttagaagctcccaattcctcagagtggcctgaggcagaatagtgtccctaaggtcatctcagcttctagatcccaagtctgattctctttccttgccttctcactcatctgctaagcttgtttattgggcaacactaagcaaagttaatgattattccagtctttaactaggacgtgagaagctctctccccatcttcacccatttctgtgaagctttcagggactatgggcctcgcactgatagcacctccccaggctgggctggcccagacagtcgaagagtaggaccagccacttctcagcccagctgacatttggcagctttgtgattttggataagacatcttctcttgggaggtcagacaagatcaactcttccagctatgacattgcgtgaggcaatgaagaggggaaagtccatgaatggaaggtggaacttgattggatctgttttgtgggttcaggagaggtcctatcacaactcactggaggtaggcaaggtaggtgaagacttccatggaaacttctggctctggggtgcctgcttcactgatgattgagtgggcatcctaaagggtacacctctgtcaaagtaattcaaagtcctgctcatcattcagacttggcttgtcaggaatcaggtacacttggataacctagccttaattccattcaatttccttttatctcttagaaaaatatgattacagttgttcctcagtatccaagagggattggtttcaggactccctgcagataccaaaatctacagatgctcaagttccttataaaaaaaaatggtgtagtgttttatataatctagacacatcttcccatatactttaaatcatctccagattccttacaatacctaatacaatgtaaatgctttataaataggtgttatactatattgtttttatttgtattatgtttcattgttgtattgttggctttttaaaaatattttggatgcactgttggttgaattaccaaatgtagagtccacggagggctgactgcatttttaggcttataatgccaacatttctttgacaagttcactctgtgttatattaatttagctttcatctgcacaatcattagtaccatattcaatttataattcataaataataaagcatattaacaaatgcatatgctgtctctatggaaaagtaattacctaaaaatgttataaataatctgttttgattttaccctgcagaaagtcttcttaagaaacaatatattcaatgaaactacagtcacagttacagaagtcaaacgagcacactgggtctgtgatatttctacaacaggctttttcaacacctgttaatcagtcaatcagaggaaacctcaggggctgaagatacgccagcttggtggaaattccttcccaaaatagcaatagctgagcaaattgctaggctgacagaagtagagtatgcacagttcttgggattttgtgtgagacagcaactgtcttcgacggttggcattttatcaaagtttaaattctttggtccaacagctgatttcctcctttgtcatattctttcctatttgcttccccaggcagtgacagccatgtccttccacattagacttcttgggtaagcagcttctgaaattgttctacagctgttagtagctgtctggcagagaccactccatttgcaaggttgctgaatatcgctaagtatctccatgaggcatataaaatgcaaactttaagagaaacaaaatattgttcattttgatttaggtcaaataaatgtcaaagcctttctaaataactaattatcttggtagatttgccttttctttctagtagaggaaaaaaaaatcaccctatacagtttattgatgtcttcatacgtagtaaaatgtcaaaagcaactcagtttaaagcattaaaacttccagccatgcaaagagtcttaactttttttaagttatattcggacttcaaagactattgattttcttcctgtttcccttagcataatataatcggcatttttcctttaatataaacacatcagaaaaatcatattttatggctactttaaaattccatgagtttaagccattccataacatgcacatttagattgctttgattttttcttctataaataatacagaattaaatgtgtttttatgtaaagtgtttactgtagttaggattctgtccttggaacagatcagagagagagtggatcaaaggttatgacattttaaaagtagccagatgaaggtgaatgttcatacagtatatgcagaatatggttcgcttgtatatgggtctgatttgcaaatcagctcacaagagctgatccacagtagaggaaatctggtttaagatttttaaagtcagtaaagtttttttttattctccaaatagaaacatactgcattcaaaatttctttaattgattattctctattttatacccaaagacttaaaaaaattttactctctagtggattaaacaattaagaaaggtttttttaagattaaatggacttcaggctcatgaccggaattttttttttttttttttttttttcctttttgagaaatggagtcttattatgttacccaggctggcctcaaagtcctgggctcaagggatcctcctgcctcattctcccgcatagctgggactacagacaggtaccactgagcacagcaatttgatgataaatataatgcaaatacatacaaatttcaaacacaaaaagaaaaaaatgaaggtttcctttaatcttaccttccggatataataactagtatacgatgtgtttgtttcacttaatgctatatttgggatagcttatttctgtatcacctcttgttttagtaccttagaaaacacatttaaaaatcataattattgatagggaaaagtataaagagtaagaaacagtaacagtcaagataatctctgatgccattttttttctctgatgccatttttaaaataacaatacagcatgtatgttggagtcaacatacaaccctatttgcatcctagtcagaatgcattttctcaccaaaattaacctatcatcttcgaggaaaacttcaaaatgttttattcatatgtcaggaaagagagagaaattataaaaatagatataagtatacatacaaatatgatgatgctctaacacactctcatgtatactctttttatcctaaatctatcttgaatatatttctatgactacatacatatttatccattccactatgattttttttccaattcatgtgagccaaaagaacttcaatttgctgaatgaagtgaaataggaatccagttttttaataatgagggggaagtcagtggaactgaacaaggccaagaaataaatcaaaacgtatgtagttatttaatatatgctgccaattcaaaataatgttctttccatacaagaataaaatatgtcattttattcatccattcctccattccttgtatcgccataagaaatctgttagtactccagtagcaatgaagggctactcctctgcccttagcgttccttttcacacaatcttcctagatattttgccatgctaatttgtctaggtaaattttgtgtcagtttttctaagtccagcaaaaaatgctactttattttttatttttgtttttattttttagaaagaagactttgctctgccacccagaatggagtgtgcagtggcacaatcatggctcactgcagcctgaaactcttgggctcaagcgatcctcccgcctcagcctcccaagtggctgagactacaggaacacaccaccacacctggctaaattttttaatttttctagagacaaggtctcactatattgcccaggctgatcttgaactcctggcctcaagcaattctccttcctcagcctcctaaagtgttgggattacaagtgtgaaccgctgtacctggcaaaaatgctattttaattgagattatatgacagttgtagattattttgataaagaactgattacattacaaaatcaattcttcctatataagaacgggatatagcattccatttatttcgttatttcattcctttctcttctttagtatacattaaaacctgcatattagttgttagtattccttggtgttttatctcattactatatattgcatcatatgtgtgtatggataaatgtgtgtatgtatacacagtcacacatgcacctataccttaaaatataatgttaaagtagaaccattctcttcacttctcacaaaagttttttttttccattgggactagacattgaattttgtctgaagactcactaacaatatatggagctgaccatatggcttttttcttttgagtttcttttgaagaattaaatactagaagtttggatgttaagccaacttttatgacttggctaaaacccaattgtccaaagtgtattattcttttaatacattgttggcttttatttattactatttttttcaaattttattttactattcaaaacaccaatgtgcactcgtctgtcttcattcaattttatattactgaataatgacataatgataaaaggataatataatgatataatgatgttattctgtctttgtaaattccaagacttattttatttgcttaaattcaataaaatctgcttttgaaattaattttactggctttttcaccctaaataatacttgtctctacatttggacccttgtaaggcagatagaaaatgagattatttctaaggatcataatagctaactgtaccccaatactcgtatacagacatagattttgtttccagactatctcaattctacttctattacctatcatcataagattatgtttctctcttcatttttgtgcatatgcacaagttagcaaacatcccaagtagcagaaacatgtgaccaaaagatcacccacaggctcaggctacatttatgcagatttaatcacagttcataaaatcgagctcatgagggacaaatctggagttccctgctacgtacagatagatataccagtttaatcagacaagtctttggggccatacctgattctgtgacatgtacacaagccagatacaaagtatgaggaagaagtagaaagactggtcgtggcttgaaagacacttgttcccaggatccccagatggaccattgggacaattctgcaagtgtttcatgcctccaattttagtgtgttccttgatcagccttctcaattaccattttctcacatgctccgtgatccttgtttcctggtggttgacgctgggaatgaagagaggaataaaagtgaaaagggagtaagtagacttgtttcttgaaacttaggattttcaaacttcctggatcgtaagaaaaagaaaacgtccaagggggatgaatgagcaagtctgctgcattcctttgcacacccctttcatcaaggaaactttgaatacctttactttttctattggctgcccaagagtttgtatctcctaaaacaaagtttgtaaaccagtatcctcgattgacctgaacctgggaggcagactgatagataatctcaaaacagagtgatctacagcctggaaattctggtgaagaagaaaaatcagtgtatgagagagctagaggaagaaagtttacagtcaaataacatgtttgaacgtgcagttgtgaaaacagagcatgccccaatgtggctataggactgatgggttaaagggaatagaggtgtggtagccaactgccaagatgaccaccaatgcattgtcttgccaactggtttttacgcctctatgcagtctcctcccacagtggatactgccaatttgtataactaaaggatactgcgggaaagacgaaatatgacctccaaggctggatcataaaagatataatggggccgggcgcggtggctcacacctgtaatcccaaaactatgggaggctgaggtgggtggatcacctgaggtcaggagtttgtgaccagcctggccaacatggtgaaaccccatctctactaaaaatacaaaaaaatatctgggcgtggtggtgggcacctgtaatcccagctacttgggaggctgaggcaggagaatcacttgaacccaggaggtggaggttgcagtgagctgaggtcatgccactgcactccagcaacaagagcaaaactccactttaaaaaaaaagacattgtggcacaatccagctgccatgaagctaggaaactcaggcagtgacacagagaagtcaacagggttccagccaataacaggactaactttccaggcacgtgagtgagctgccttggaagcagattttccagccccagccatgcttccacctgaaagaagctggggcaacatcttcagtactatctcatgataccctgatctggaattacccagctaagactaatggattcctgacacatagaaactgtgtgaaataacaaatatatattgttttaagacattaatttttgcagtaatttgttatgaagcagtagataagttatatctgattttggaggtggaggaggtctgtttgtgtgatctgtaagaggaacagagatgaagattcatagagaaaagcaggtccaaaaccaatatgccaacatatagaatagacaaatgggtgctgagtcacccagaataatggcagggtgtggagtgaagaagagaaccaagagcccaactagatccaaagtcttaattttaaaaagtgggatggaggatggttgatgcaaatataagtgcttcaaaagagcaggaatttctataagaagaagtaatcatttgaaagctgaactggagccccatgaaggagccacagactccctttcccaaccttcgtgcacacagaaatgggctctggtggaaaatatgaaagtgcatgagaaatgatattactgtccacacactaatctcatccttaatatcaactggaccttgctatactaacttaagagtgttgatcaaactttctaaatttttttgatgccaattttctaaggaaaagaacttcttataagatttttaaaacaagcttggtttgctgcactatttgcaatacacacacaaaaaggtcacatttctgtgtccttttgagtaaagtcatatccatctttgaagcctctctcaggaccacaagctgtttttttttcttttttcttcttatggcttcatcacttcactggtgttataccaggatttaggaaccaagcaatccaaagaaatgtgggagaggcctcgtctggccagtagtccaacatgattgcctctggaattcaccatgagactcacagttcaccagaaggcagaggcaaaaatcagagttgccaattaaaattatttctaaagatgggttcactgcttcctattcccaagcctttctgagactccatggggtgaatcacttgcttcttttctgtatctcctcctgcaggcatttaagctttgtaatttagttacatgcatacttatatttatctctttccaacaattttgttcatttctgatatcttctattgtcttccctcccaatttctgcccttttcagtttttactattatcttgtggttttaggaaaaagcagatataaatatgtgtttaagcaatgctatggtttgaaggtttttgtccccttcaaaatttttgttgattcctaatcccctatgcaacagtatcaggaggtgtaacgtttagaaggtgattcaggaggactcctcatgaatgggatttgatgcccttagggcttgatggaggaagtttgaccccctcttgcccttccaccttctgccatgtgaggacacagtgctcaaggcatcactgtggaagcagagacaggaacttcaccagacaacaaacctgctggcaccttgatcttagacttcccagcctccagaactatgagaaatcaatttctgttctttgtaaattacccagtctgtggcattttgttataatgacacaaactaagacaatcaatcagagttatatttccttgtaagtataaattttatttttttatttttatttttattttttttaagaaggagtctcgctctgtcacccaggctggagtgcagtgatgggatctcggctcactgcaagctccgcctcccgggttcacaccattctcctgcctcagcctcccaagtggctgggactacaggcacccgccaccacgcccagctaattttttgtatttttagtagagagggggtttcactgtgttagccaggatggtctcaatctcctgacctcatgatccacccacctcggcctcccaaagtactgcaattacaggcataagccaccacgcccagccgtaagtataaattttaaaatcacttcttaattaatataatagatgaaatgacccacagaagtatccactcacagaaaggaccatttctaaaggaccagtttggcctataaagaaaatacaatagcagaccttcacaaattttctaacatcagaaaagaaaaaatatttagatattaaactgaatcaaatgtgatggtcttacccagacaaaggaagactcagcaccccatttccaagttaactgggagcttttgtgttgctctttttgccccccttatatttgattctgctacctgacctttaaacagaaaagctttctcttcttgctatctatgtttgttatttaaaagatcaaaatattaaactcttgctatatctatttgtcatttgaaagatcaaaatattaaatgattgtgaaacattttttgcaactgtaagagggttgatacttttcctgaatattattcattcaacattcatttatttctttgacaaatatttaagagatgctcatgatgtcctaggcattgagctaagaactcaatgttgcaatgtggataagatccagtccctgtgtgttcatacttatttaatactattatagacaaggcctttaatacataccatagtcatatatcaatttttaattagcaatatgaaataagagaacaatgggactttccactcaatttgacaggtggctaaattttcagttactgaatttactattttagggtaatctagcacatgaccaaaatttaaatgcacagaacagaagatcagagtaagaagagcttccatttggattatcactttttctacttggagtcacatactgtactttaaattgattaagaacatgttaaaggtccaggtggtgatttccagctacaagtccaaagtatagaagaatgtgtttaaatcctacgtttatcagatccataaatatagttccttctatgttaagtggctttatttctaagaacccagccctcggtcctgggggtgcttcccagcccgctgctggaattcctgatcgtggcagtctgctgaaacatgagctcagttaccaaatatagctgagtggagtaagaggacagatgagagtctgaggccacagttgcctcaaagtgaccacggaccaggcagtctctaatgaataggcaaggccacaacctccattctcccagaaaagaagaaatgctcatctgaaattcatcacctctctggagtcttcaaactgaccaagcattgaaaaggtctgtaaggtgtatcttaatatactaactagtagggcaacattttaaggacttaaaaaaaaaaaaactaaaaatacaaaagtttttctgaagatatgatactatttacaagataccttaattattcttttgcttggagaggaaacgtaatgagaatgttacggttttgccaaaaacagataatacgtaagatttgcctgcccacttcatctctgcctttgctgtcagagaattacactttctgttataagcttaagcatgctaagatggtgctatcaattccaaaaggattaaatgtatttatggagccagcttttgtcaagatcgtgtatgtgttatgtttcacagaaaaggaaaacgcagctttctagaccctcacccatatttaagctagataagtgatgatggcttaaagtgatagaccttagatttcagtaacattataaattgttaattacactttcaaaagattctaaaagtaactcactggacataattaaatgagttgggatagtaacagcaggtattttaaattatattcatgcataaaatttacatacatatttttaataagataacgcttactaagggaaaccacagtgcaatctcgagtccagtcaagtttaaacatcacagaataatttttatcatgttgttttaagttgcacatgaaattgtcttgaatccaatataggaggttgacataaaatgatttcaggctcatattacttattaacatttgctaaaaatactaattgccttctagtatgaataatgtggtgacatataaagccatttcttggcaatataaaactattacaaatctattcaatcacatatatgcagaaattaaatcctcatttcatgataaatgtgccttccaatgttttttctcacagaaagaacttgaatactcacctcaattattcagatttttttttcagatttttaaaatcaaagtctctttgacaagttattgctaacagcagaaaaggccgatgaggtttatctggccactaactgccctgtaaatacatgattacacattcctagaatataaattagtcctctggcatcctagaatctggtatggattagggtctgtatcccaggggttctgtgtcagctcttcctctgggtttctctgttattgctagagctgaatattaaaactggccttatagcatatttcacaatagaatgaggatctggattgcactggacaagtacaatcactttgacctccttacctcattttttaaaaatgtagagggcaatcattattcaggtttaaaaataaatatgacaagttctttaagagataccaagtggaatctgcaaggcccagacaagagctccacttcttaaacaatatgtgtgtggaggctgtcaaagggtattgcaattactgagctccagttagaaattcaggccatctagagttaatgactgtgtcccggtgaaattacagcaaagaaaacaaagattgaacaaagtatcttcgactaaaatttctaactgttaaatcatattagagaatatagaagcaaatttggtaaataggttttgaatttaagtgagaagaataaagccctgaattggataatggtaatggaaatggataattcagaagtaaaatctaaatatttgcaatggactcagtatggtgaataaagttgataagatgaacaggacatgggataacttcaaaaactctgtaaagtatcttatttggctgtttctgcattaaatgagctattagattatgtccttgaaattgagattaaataagctgtttaaagagatatttaaaactgtaggataaatatatctgcctgcattgacaatttaataattagaaaggaaaataatccatgtgtatttattaagaaataaattataaaattgtagtgcattttctgcatcaaacataaaatttcataaaattttcgtgtttgacttttgccctaaaggaccctttgtagcaaaaaaaaaaaaaaaaaaaaaaaaaaggaaggaagaaagaaagggagacggggaagaaggaagggagaagggagggaggaagggagggaggatgggagggaggatgggagggaggatgggagggaggaagggagggagacatggaagaagggggaagggaggcagaagggagggaggggggagggaggaagggagggactttattgatttagtctaggggggttgcctgtgattctgaagcatgaaaattaagtgttaaagcttttctaactttggttttcatagtttaggttttattaaaagatatttcaatatctaatatttgtatcaatggtttgcattacttttttagtaattgcttaaatatgaaaataaaactgctaaacctaaaattaaaaatcacttataactttttttcaaaaattacaaaataagcaacaaaagatccccctgcatgtcccacctttcaactcctacccctgcctaaatccccccacagaggtcagtgttgattgtttggtgtatgttattccaaccattttcatatatttattcctatctatgtatacatttttaaatgactatgggaatttagctattccacctggactctctaaagaatctgctgaatgtggtacatggtattaagtgatccttactgcctgtcaatgtttttctaacatcaaactttttctttcaaaattgtagcagttcttcatcgactcaaagtatttcacaaacagacttcaaaagttttccccttatctaaatttttaaagtaatttcctataatatctccaatgagagaagaaaactttgcagttaaatgcaggcttccaccctgagtctgccactttctgatggctcaggttgggccaaataattgaaactttttctgctgcagttgtgggtaatacaaacaataaaatagaaaaataacatctactacatggattgttctgaggatcaaactgttcacttttgaaagcaggtaacttccaagctgttatgtaggaacaacttgcattgtcactgaattctttctacttactagactctgctctttctcatgtatattccttgtcttccccaagttcctccacgtcaaagaaatctgttgtaatttcaacagtcaatagtgccttgattcatggggatcatgccagggggtggtcccataagtcttgtttgtttgttttttgagtcagggtctcactcttttgcccaagctggaatgcagtgacctgatcatcgctcactgcagcctagaactcttggactcagacaatcctcccacctcagcctctggagtagctggggctacaggcacacaccatcacactcagctaagtttttgggtttttttttgtatttttgtagagatgaaatctaactatgttgcccaggctggtattgaactcctgggctcaagcgatcttcctgcctcagcctccaacagtgctgggagtacagatgtgagccaccatgcccagccccctataaatatttcttaactgacaacatagaggattctcccaaatatcatagagctggctttcaggtaatctatccccaaaagtcagcaactttaaaggcaaatggtagtcataatttttaaatttgtctattttttctatcatttgtatattcatatatgaatgtgaaccatatacatttatgcctatagtacatattcaggatctaaaaaataaatgttttgccaaatattaggatagtcatgccaagataagattcacaaaattacttatgtcaaatgtgtaatatacataccaatgaaaacttatttatatgttctatattttatagtataccatgaatctaacagaattcagatgacactaacttagggagaagttgcgaaccataaaattacaattaaaattaatctataaattaagtgacataaaattccttaagaaagaatgaaatagccaggcctggtggcttgtgcctgtaatcccagcaactcaggagcctgaggcaggaggattgcagaggccaagagttcaagacaatactgggcaatgaaaggagaccctatctctacagaaaataaaaaagaattagcaggacttggtgacatgcacctgtagtcccagctacttgggaagctaaagtaaaaggatcctttgagcccactagatcaaggttgcagtgagctatgatcacaccatcgcactactacagcaggggcaaaattgaaaagaaaggaaaagagaagaagaagaatgagatatgcccagggagttaacaaaataggtcaccgtggacatttacctttgaaagcaatatttgcttaggataagccaagatgcttataaggatataagctgcctgttgacaattcaaggttgataggattctgtaatgactcacaatatttgccaaccctcccaaacctttgcttcaccaaatgtttgcttaagatgaagagtttggcattaggcacatgttgaaattcacctgggagaatttcccttcagagcgccatgaggtgacatggcagctgcccccatggtacactctgaaggaacctaaaggaccattgacctgagcatgttctcctcttgtgactttcaccaccctccccgccaagggtgtgccccccaaaacaacagtggtctgtagatgtgaacattaacatgcgaatgtgcacttcattttatcttatatgtctgcaccctaacaactttcaaagctagtttgaggctgtatgcaataaaagcatagtacaattgcccaaaatcaattaagaaaatgcagatcaaaccaagtataaaaagctttgaacttgaaatgttttctcaatttactacctttgtcctttctcttcttagaatcttaactccctaggacagagaatctatcttctttccagctatgtccctggcctatgaaagaggtgcctagcacatagtaggcactcaataaataaatgctgactgaataaaacaatgagaaaagtaagcaaaataaattttttttttagctaaaaacatctgaatttctatgactggaaatttaaccctgagcttgctagtatccgtgtgaaagagtcatcaaagtttacagaattctttgtctaacagaattgccagaaaatagaataaatgcttttctagttccaaattttttcatgagaaactttctttgagggtaatgagaaagactgacatccacgtctttatagatacttttttttaacacaatgtctgacctatgactgattttgctttagcgaaatgagcaggtaaagtgtattttatatgtagacacaaacagttatgtgttatatgtatacactaacatttagcactgattactctatcaagtttttaccagaaaacagagcccgggacacaagcaacagttgataaaacagaagaaaaacctagtttaagagcagaataatgtttagctgcactcagtggctcacatctgtaatcccagaactttgggaggccaaggcaggaggagcccttgagtccaggagtttgagactggcataggcgaaaaagggagacctcgtttctacaaaaatatattttaaaatttagccaggcctgacgatgcacacgcgtagttctagctactcaggaggatgaggcaggaggatcccttgagcccaggaattcaaggctacagtgagctatgatcatgccattgcagtccaggccgggagacagaatgagaccctcactcaaaagagcagaataacacttagctgaagagagcatgtcccagagaaatgtcgcagcaggttctgggaggctgaaagcaaatcagtcatcagaacatttcctgcctcgtgcctttgttcacatgtgtgtcaaatcctatccagggctcaaaccacatttcaaacacccggtatttcttagcttttctccatcagctgctgtaacccagtgtgctaagcatttgccatacaaagacgccagtcacagctcctgcttccattgggctcacagttgaatgaggaaagcattctctaaacaaatacttgtaatttaatatgatgactgctgtgagaaacgcaatgcaaagtaacatgcttggaagaagaagcaaattatattgattggggaactgttagaaagcaccaaaaagtggtaaaatttaagaaagttttcaaggatgaaccggagtttgaaaaacagaaagagggctggatgcagtggctcatgcctgtaatcccagcactttgggaggccaaggcgggtggatgacaaggtcaagagatcgagaccatcctgctaacaaggggaaaccctgtctctactaaaaatacaaaaattagccgggcatggtggtgggcgcctgtagtcccagctactcaggaggctgaggcaagagaatggtgtgaacctgggaggcggaggttgcagtgagccaagatggagccactgcactccagcctgggcaacagagcgagactccatctcaaaaaaaaaaaaaaagaaaaagaaaaagagaaaggaagcacattttaagcaaaaggagcagcaagtgcaaaggtgtgaaaaccagaaagaatctgaattgtttgaggaatggtgagtgggccagggaggcctgagtgcatgtgtgttggtgatgacagagggtgaggctggagcatttccatcagctcaggctgtccacgggtatgtttaacctgcacatcgtgctttggaacttttctcatcagccggggagcatcataggaaaaaaataaaaaccaaaagagtgacgtgacacaatttgtacctatgatctctcttaccatttttatcccttactgcaatttgttgaaactattttaatagaaattatcacgctcctccttgtaactgagttattttttactcttgtctaatccctcctactggattgtaagatcatttaaggagaataactacgcctgcctcatctttgtcctccttgaagcttctcttgcacaactaagcagttgttccgttgatttcatgttcaacttactattccaggaaagggaagtagaagaaaggaagcatgactgtaagatgggcgaggccaaggaagagtcatttcctccatggtgaagaacataatgctacgcaacttcaagcaaattaaaaaacagttgtggttggccaggcatggtggctcacacctgtaatcccagcattttgggaggctaaggtgggcagatcacaaggtcaggagttcaagaccagcctggccaatatggtgaaaccctgtctctactaaaaatacaaaaatcagctgggagtggtggcaggcacctgtagccccagctactcgggagactgaggaaggagaatctcttgaacccggcaggtggatcttgcagtgaactgagatcatgccactgcactccagcctgggcgacaaagcaagactccaactcaaaaaaaaaaaaaaaatggctgtggctaatgagcgttttagggaaaatgacaattaagctaaactgctaaagctggagatgatggataagacaaggatgagaaaaagaagaagacagaagaatttctaggaaattcagattccttctgagaaaagtgaggaggcaggggacaggacaatttaaagatgccaaagaatcctttattcttcaaaatttcaaaatctttcaatgctacttactaaagtagaaccactttaatggcgttggtgtttacctcatttcctcttcactcattaacagcagtattagtgggtctttttagtctatttcatcttctgtgtctatcacaccggcatagaattaccaagagcactgtttgacagaaaacatgaaatctcaggcaaatgatggagatgtttgtgattgtgtttcattccttttgattttgaccttttcattttggagtgctgactgacatggaaatctctgaagcacaattttccagtgaacttggcccgcttggaaaccgcccttgttcatcctcattgaatgagcattttccctagaccacgtgcatgttcccgcggcaataactggcttgcaaattaagcctgaaccagatatgccatagaactattattttctttttcaatgtgcaagcagttttaaagctacacctaatcctgactactggatcctgtcagatggcgcctctttaaaaccaaaatatgagttaataagcaggtgagataatctgcctccagcaaacactccctacattaagaattgaaaatgttttcatcattcagaagtttgctttaagctttgttatataatgctccttgtgaagttttaaaatgtatcatattatgttcatttggaactaaaaagcaattgaattaatagcagaactctgatttctgatccacagttttgttagtttgatacattgcttaggattctcaattatgaaaactacaatggtaagatggtaaagtgcatagaacatgagctctggagttattccctgggcttaaaccttggttctcccactcagattttctgcctccatttcctcctttctaaaccagaggctgctgtgagggttttaaatgaaataatctacatgatgactctgggcacaatgcccaccgcagggtaagcagtccattattagccattatcattatcaatcatcgtgatcattaattgcctttatatgtgttatatgaagtcattaggtagctaatgttctatagaaggggttggcaattttttcctgtaaaagtgcaggtaaatattttagacttcatgtgccatatagtctctgttgcaactactcaactctgacattggttcaaaaaaacaaagacaatctctacattcaaactcctacccatgaattccaacccagcatatatgtcaaaggccacctattccttgaccatattttcaatggccttgcccacttccctcccattttacctgcatgtcaaactgggatcatctatctctgtaccttcacctggatggctgagctctggtggagagaattgcacaatcacacagattaatgacactataaatacatcacatctaacttcaaccaggccctcacctctacccataaatccttcttacaaaacttccttccccctttttctacaacagctatttcaaatcatcttctgtcctcataaacctccaatgcacagaagtctcagtttgggaactctcctttctttctattacaaattttgcagagaatctcatgtttctctctctctccctttctctcttaccgccccccatgccccaacacacatacaccctttgttacttctctcctttaacaatgaaagaactgcccccttcctactggaagctgaacacctcatactccgtttgtcctataataactcatttcttcttacatcttttgagagctgacctataaatcatccccgcttttttacatttattttcagcttctcccttcttactgcctaatttggtttgtataaaacatgttacagcgctctatcctaaaaatgaacaaacctcaccagagtctatacttttgttcaactactaccttctgtctctccttctttctatgatcttttcaaaacaaaccaccacacctgtaatattttctttctttccttctttcctttccttccatgtagcaatctggcttatatttctgttgcatacaccgaaagtgctgttgcaatggtgctaaatattcccaagttgctaaaatcaaaaatcaaaaggacatgtactgcttcctgagatattttctttcccagcttccacgatatctagcttttcttgcttccctgtgattattcgaaggattctatcttctccttcttttttcctcgatgaccttatgcattcccatgtcttaaagtgccacccataggctaataatccccaatccagctctgttctcccttctcctgggctctagatcagcatctcaaatctcctagacatcaacaccagagttaccaaaggtccctcaactgcaaaaggctcaaatcaaaatcaagcttaaaaaataaaataaaataaaataaaaaaacttgttcctccacttgtagcatgtaagttaatggtaccagtcatctggttgttgaggtgagaaacctgtaaccctgcctctgcatcacctctgcctttaatcaattaccaagttctttcctttctatcatctatcttatggaccctggacccactgcttccctgaatcaccagctctcacttcagagtccaagaaggacacatctaatcgctgtctaggccaagtgccaagacttgtgcccagtctccaagcggctgggaaagaaaatacttggagatttcacatcccattacaagtgagttcagtttctcactgagcctcagaatatgaggaattctccaaaatgaagacgtccagatgacagcaacaccaaacgtgaaaccatgataaatgtgtgcaccccctggattactgcacaagccttctcacggaccgccctactgtcagtcttgtcttcctctttccctacctctgtcccggatccagactgcaatcagttatctctcaaaaatgtaagtctggtgatgtttctcaaggacttaacactcttccttgcctactgactacccataacataaaatgcaagttctctgcatggctccaggccctctctgacctaactcctgctttctagccttatctctggttattttcccatctccagatagatttctgtttagctgaaatgcttagtagaattacctgagtctgccatgtgctctctgggatccaagtcttaaaatacatatttgccagtatcctcttcacctccccgctcttcctcatccctcacacatcattctttcagctttctctctttcacaaaggtttcctgatcctgaccttgctgttgcttctaggtgctatcacagcactttgtttttctataccactgcaggatgactatagctaacaataacatactctatagtttcaaatggctagaaggaagatgttgaatgttcccaacacaaagaaatcataaatgttagagatgaatatgctagttgccctgatctgatcactataaattgtacgtattgaaacatcactaggtaccccataattatgtataattattatttgtcaatttaaaaaataaaatacaatttaaaaaaagacatactcaattatataagcttattatttagttgtaatttgtattaagttccatgagggcaaaaaccttctctttttcaaggtcatatccccgtccctagcgcactaccaggcatgtggtagatagtccataaatacacttcgagtgggtaattctggtccatgtagtacatctatcccagcttaggcttcacaatttcgtcatgtcaagaatcaaaggttttgttgcaattatttccttggattttcagcttaatctaccacaggtttggttgacacaaaatgtttttcaatctcctttagcactgatttcaacacaaaaactgaatttctttcaggccataataaataaataaataacaaataaaaaacacagtagctttctttcaaagaaaaataaattttacaagaaatgcaataaatgaaaatatagtctgttgtgcctttggtacacaaacctactttcagcccccgagtctccccctctccaccttcatgtctcttctggatccatgttacctaatggctcatctccccacaccttgtaagagttgatcctgatcctggcttcccctaaagttatctaccatgtgtgctgactgaggggccaattgtacttcagagctcattactgagagaaaccaggctgccttggtaggacaaactataaaacgttttgcaatatacaaaatggtactgggtgtccttgcaatagacacccagtaccattgctggattggctctggtggacgttccagggtcatctaattccacaggggtctatgccttttattgtctttacaattttacaactctgtaagttggaaaaatctaaaaacaatgcaaattatactggtgcatagatatacaaatgattttttttctagtagaaatgctatagttttccactcttatgattccaaacattgtattttattgctctatagatattaaccagtttcaaatctattaccaacttcatatcagcatgcctgattgcctacatgtgtctcatcttcagcgtctcctttgaaataattgtaatatattactgattttttcaattgttaaataaaagctcaaatacatgttatttgatttttatatattactatacctttgccttttcaaaatcatactttaactgcctgtttctcatgaagaaaatacattcaagtattaaaaatacactgaatataattgttcctcatatacgagccatatctgaataactggagaccagtcaggatgtttctatcctgcagcacagactggacaaaggaattagagtgatatttgggttagtaaagtcagggagaatgatgacaccctctgaaggattaaggatttacttgaagaagagtgcgaaatatggttcagtagatagagtagggctagcatgtggtgaatctaataattcaggcacaaaaaaagtaactatctttctaagaagacatgtaagacaaaagtacagtattccacttaagaagatggggtatgttaacattgagtttcaggatctctgattaactaccctctgttaaacagcaggtctatgactcactgcatccagtgaagcagtaggctcttgagctggatttctacaaccccctcgactcttgcataatgtattttgaaattagagattttcttagatgggaagatacttctacgcaagcaactcaattcagtcctctgaagacacaccatttctggggaatgtcccaccaagtttactcctgactgacacaaggtagaaagttgaggttcaccacatccaggaagcttccattattcactcctagactcagtcttgtggcagacatcaccgctgatgttttctagatcgtccctctcagtactctatgaacaatatatagcaaaagaatggcacacttagagtaacaaggagtcattgcttcacaatataaagttcaaaatgtcagtggaatttaaagctgtaatagcttacagataatgaaataccttttatttaattctgctgatattcccatgtaagtgttctatgccaggcctctagttatctcatgccctttaagattagattagactctcatagcccccaggtttttctcactttccttaaaagccttatcaaaattttatattattaacatattatttgtttaatatcttctctatctcctccactttactacctcccatgacttttaactccttgaacatgataactgtgctgtaagtctggatgaagggtcagcaaatttcagcccctgagccaaatccatcccaaccctttttgtatgccctgcaaactaagaatgtttttctcattttaaaactattgtttaaaaattaaatatcaaaataataatagttttaacacattaaaatgatataaaattcaaatatgagtgtccataaagttttattggcacacagtcatgctcattcatttccatcatctttggctggtttcatgctcatgcagagttgagtaattataatagaggctgaacagctcacaaagtcaagagtatctaccatctggccctttccagaaaagtttgcccatccctggcatacagcacagctgtacttccagcacctgaaatttaataagtgattattaccatctgttggactgttgagtgaatgaatatgaatgcacataactggagacaataaagtttcaaagatttcactgaaaactataaataaatgaaaattggaatccttaaaatgcattttgtggtttagggttggataatcagagtcagatttactaaaaatatcaatattctattgatctcattacattaatcaattagagtttgagtaaggtgggcggggggctgactgtgagccctatcctactaatagtgcctactgcacacatcatctttttgaatgatttaatactgcctagtgagatatttgatagcactcacagggcatgtattaaaatcataaaatgatcaacacaagtatacttgatatttcttccaacttgtaaaataaagaaaacttatattcattcactttaatgtttctcccaatttgtgacttacaagttttatgattaaaatggggaaaaaatcattgctactaatgacattctatgctgtctttcagaacacagtttcagaaaacagtttccagtgcctctggccttcctactgaaagcagacacagagtgcatgaagaccgttcaaatatgtcagggacctcctcccatgagtccttctatgactccctctcagacatgcaggaagaaagcaagaatactgacttcttcccgggcctttctgctttcctcagccaggaagagataaacaagagtcttgacctggcccggagagccatagccgactccgaaacagaagattttgactcggaaaaggagatctcgcagattttcagtacttctcctgcaagcctctgtgaacatccttcccataaggagaccaaattgggtgaacacgcctcgaggagacctcaggataacaggtcaacacctgtccagcctctggcagagaaacaaactaagagtatctcttcacctgtttcaaagaggaaacctgccatgtcacccctgctcaccaggcccagctacatccggagcctccgaaaggctgaaaagcgtggtgcaaaaactcccagcacaaacgtaaagcccaaaacgccacatcaaagaaagggtggcccccagagccagctgtgtgacaaggcagctaatttaattgaggagctaacatccatatttaaagccgcaaagccaagaaacagaagcccaaatggggagtcctcgtcaccagacagtgggtacctgtctcctaaaaatcagccgtcagccctgctgagtgcctcagccagccagagccctatggaagaccaaggggagatggaaagagaggtcaagtcccctggggccaggcattgctaccaggacaaccaggacttggcagtgccacacaaccgcaagtctcacccacagccccacagcgccctccacttcccagctgcacctcgattcatccaaaagctgaggagccaagaagtagcagaagggagccgagtttatctggagtgtagagtcactggaaaccccactcctcgagtcaggtatgaatttttgtattatgcatagcaaatgatcttgttgactttggtgttactttaatatgggaggaagaaagatttcctgtgtcattagccctctggagactgaggtagagtacttgcaaggagagaagcagcccagaatcgccactatgagttgtcctagttgtccctggcctgatatatctgtggtcatgcaccctctgtgctaaggaaggaaggcaaaggacttgagaaggcaaagagcagtggaaacagtttgttctctaagatggtggaactagtaacaaataggcacacttaagatgtgaaacttatttactcgaagtactgtgaaaagtgtgtgtatatttgaatatgagttgctaaagacggttgaaagcatggctaaaactagctgctatctagaagtgaaaggcacgagtgtgtagaggccaaccttcagattagcccccaataacgcattaaagggaacaataaacaccgaggcctacttgaggggggagagtaggagaagcctgaggatcaaaaaactacctatcaggtactaatctcattacctgggtgacaaaataatctgtatgccaaagccctgcaacatgtaatttacccatgtaacaaacctgcacacgtatccccgaatgtaaaagttggaaagaaaaaaaaaaaagattctcatatacaagaaacaaaaaccaaacaaaaattatcccccaaatggataatctagtctcaggcatggactaaataggcacatattcagtaacataaacacacacacaccccttcaatgtgatgcaaagaaggaaggcagaactttcctaagaaagaaagataaatcaagtcaggagctccgcaggtctgcccgttattcctacacaggctctggccactagagcatggagacagcaagaaataacagtgaagggagtatgcacttagagttaataggcactcataccaccatgttcattagaatttctatacattcttctgacttcattgtagagtttataccttcccctgagcaaaaatgttaaggggaaagagatcctggagtccccctgcagggtttccagtcatgattccattgcccaagttactctacccctctgtgactcagtttcttcatctgtgaaatgggaagtataatgatacctacatcattctgttttatgattaaataatacatggggaaaattaaagcagtaccttgcagctagtaactgctgcagtagtgttacctattatctttattatttctcatttcttaattttatatggcaaaatgaaaataacaagtcaggattatactacacaaataatgaatattcatttatctgggaagttttgcttttattcatgcagaatgctttacctaaattacataaatatttaaaaagttaactcaagggccaggcacagtggctcatgcctgtaattccagcactttgggagattgaggtgggtagatcacctaaggccaggagttcgagacaagcctggccaacatggtgaaaccccctctctactaaaaatacaaaaaattagccaggcatggaggcgagtgcctgtaattccagctactcaagaggctgaggcacaagaatcacttgaacctgggaggcagaggttgcagtgagccaagatcatatcactgtactccactccagcctgggtgacagagcgagactctgtctcaaaaaaagaaaaaaaaaaagttaactgaaaattatttgatttggaaaaaaatggtaaagtagacatcactggctaaagattgaattgaaacactggtactttcttactaatagcatttcacagatcacaaacttccctgtatctctgatcctttgctcactaacacaagctttgctagtgttggtttcttaatctgacctcattgtgcacacacatgaagtaaaaattagcattactggctgaaaagtggtgtgattacaggtgggcgatttttttcccccgaccaatttgttcaactaattcactttgagtcagctttacagtaattttactataattctttaagaaactgacagcagggggcagtaaaaaactttttcatgtgttcatttaattaaatatgtcgttctaaattctgcatttatatgttatttatgtagattatttatacagatttatatacatgaagaatttgtttcttacattttacctttgacagaaatgaatgtttcagattctatttagattttttaacctatcaatcttgcaaataaataattttcattagacattcattctcatgtcactcaaaacagttccacaggttttcaaactacatatggttccacctacatttacttccaaaataacccttgaagtatactacaacctttaaaaaatgacagaaagcagtccatttagcattgaaggattaattcaggtgaacagaccataattactgtattaaaattcacttaaccatttggtgattctaggggtcatcaaattcacacttctgcctctttgggggtagcagaactaaaatttaatttagttagtatctgcagtattattaactagttttctcttattctgcagtctatgaaagtccaaacttgacaaattatgcccttctagaataattaagtctcataaaatgttccattgttgaaagttagctggtcatgtttgtatcctatagagttttttgggtttggaggctgtttttgtttgagagggagagcatagatgctcattggattttttaaatttctgttccaaagatcttgatcctccttgtcatgtatttgtaagtgcaccagacgcctaagaacattgagctcttttgaccacatgagacatatgacagtcataagagaaaatctttgaaggaaattttctatcaggaagaaaacctttattaaagatttcctgcaatggggcattttagaacctgactcagactgtgtcagtccagaggacctaggacctggagcttaggcagacctattgattggcaggccatttcctgaggtcacagaagcagttgacagacgtgtggagaggcaaggagatgtcaggagaatctaaagcaagccataagcagaagcccaagagacactggttggtgagagcagagacgctcctcagtgttgggtagttggcagctgtactgggaggtaagtgaggtatggtgccaagaagcttggcggttggccaatggaaaggtccaggctgacttatagggaatgcgtcacaggaaaacatggcagcagacagtaggatcaagatacaggagctggaacacgggggagaaacctttaccttgcaagagtttaagcaagtgaaagttaggaccatagctccagaaagacaaaagaacagagcagaatcttagtgactcaactgggtccagattagggaaaccaattgctaggttaacatgcctgggctactaagcagctggctggagcttagattaaacaacagagattgtttgcttttgaaagctggcatgatgaaccttacaaatgtggataaagaagcccccactcagggaagaagtaacagaaacaacagggtaaaaccaggccagtcacttcaaggcaaggcatttgtacttcacatgcagtcacttcaccctctcacactgtgtgaacaccacttatgactacaaacaggactgaaaatatgttttcctcctttattattgcatatccaacaaaatctcaacaagagaaagaagagctgatagaagaaaaccctatgcataaaaaaggacgttatatacaattgaggtagtattcacatgatatgcaaattatattaacaatttgaattactacattaaatgaaatcaagtcagaattcattttttctctgcttatgctcaaatgtcccatattctcatatactccttccaaacagcataaagacctgttccctgacatcactcaccttccctgttctctccactcttgactttgtgagttagtaaaaaatttgtgaagaattttagttcaaaattacctccggtattataaaaaggaggccttatatttttaaaggtatttatttatttttaaaggtattatttatttattttaaaggtatttatacctttaaaaatattttatcaactgtatgttttaaaccatttaaatgtaaggagactgggatcaaaaactgtgaaatgatgtgcctagtaatacaaaaatcattcattagtcatggagactggagtataactcagctcttatgattcttgatcccatgctgcagttgttaatgagaagacttagccactgtcactgtggagttagaagttatgcatagcttactgaaagcctccagaaatggagatagtggaattgccacctttaaaaatctacgcttggaattcatattccaaatatcttcaaagaaaatggtagcctggcaatttccagtatctttctctatggaaaaagaaaacaaatcccttcatgggtatccttccctttttttgtattaagttaatcatggtcaatcaacagaaaatattttttaaggtgggtatagttagtgtagaaacattcagtgttgggtagttggcagctgtagtgggaggtgagtgaagtgtggtgccaaggagcttggcaattggccattggaaaagtccaggctgacgcacagggaatgcgccacaggaaaacatggcagcaggaagcaggatcaagacacagggactgggacatgggaagaaactatgttattctcaatcaaattactacaaataaagttattattcagaaaataactacaaataaaacaaagcattcctgttttatctacaagtagtccaaacacatctttatattattaatataaggtaaatgtgtacatatgtcaaaaaaaacttttaaacacccacttattgtagtaaaagtggaatccagtaatgtgctttaatagtctaaatacaattactcatatctaatcataagatacctactaggtcatcattgttagccctgtaaagttttatttactatatataattaaaagtaatacaattatttctttttataatcgaaatacagcatgtccaatgcctccaattagtttacatcagcaagactttgatcatcatcaaaagccaaaacaagaggattagccatatcaaatctatgcaactctgtcagtaaaaatttccatctcctcaaaaacgacaggaagaaaaacaagccatgaatttacttttcttactaagggtaagaaaatatggtatctcccatcttttggctgatttggtttcggaaaatgtagcaacagcaccactagccaatagtttatgaatattcagtgcttgtaaagtgaagatccagatggcttagcccaggagtatcgttgttgttaaagaatatagtcagcaatgagataccagataataccatcagatcatcaaaatgaaaaaatcctgacaatacacgtgttgtgactgcaacatgaaatgtaaataggtacaaccagtttggagaactgttttacgatacacaattaagatgtgcatacactaagcctttatagatacacaactgcctacttgacaccactatatcgatgtctgatactcttatcaaatttgtcgaaaactaaactgattctcctctcctccaaaaaccttctctttccaaatcttctccatgtcaacaaaagacaaccctccttccagctgttcaggaaaaaaaccttgaagccattctcgatccctctttttctcacaccccaagtccaattcatccagcaaatccagctggcaccacctttaatgtctccagatctgaccacttcaccccacctccataaatgaggctgcacgtcaagccaccatcatctgtctctttgttatttgcattaccttccaacccatctccttgctttcgttattgttcatcacagtctacacagcactcagagtaattctttttcatgaaatcactatcacagcactgcccgaacaccgtccaggggcttctcacttagtccgagtaaaatccatagttcttatacatcctaatcaggcttcatctctctgatttcacctcttgccactcccccagtcacagtggggttcttggctgcacctccatcacaccaccaggcttgttcttgtctggggcctgtgtactttctgctccctctgtttgtaaatctctctccccagatatctgcaggattaaatccttgatcccctccatatctctatcacctttacaatatggcctcctataactactctatgtaaaagaaaggtcctgcctaccttactctctattccactctcttgcttttctccatagatctcatgtgatacactgcacattttatctgtttgatttttgtagttgtctttcttccttcactagaatataaaatccttgggtgtaaggactttatctgttttactcacttttgtgtcctcagagcctagaacagtgtctggcatgtaacaggtgctcaataaatatgtgctcaagaaactggaaagaacctaaacattcatcaaagagaaaatggataaattgtgatatagtcacacaacaaatgaactagagctgcatgtatcaggatatatgaaactcataagcataaaatcaaccaaagaaaagcaagttgtaaaaacttacacataaattacatggacagatgtttgcatatgaagttacatttgcaaaatagtactatttcaggcttacggatgtagtagtacagagaaatgtgtgggaatgaggaacagtcaattccagacagcagtaacctttgagatgaagcacgtgatttgtgaggagtcaactgtgttggcagtattttatatcttaaggtgggtagtagagacacagatataaactacatcattttaatatttaatagtgaaaaatactgactttcatgttaatctactatcctcatgatgtatcaataagttcagcagcaatgtctctaatgaatactttgatttaccccataaaaaccatccagaaaatatcttggtgttaagcactgtgaatcggataggttggcttttagccatttgtccatataattttcagggttgttttagttatattttagagctttttaaaatgtttttttttgttttgaatttatggtgtttcagtagaatattatatgtattcagtcttgtgccatggatcttttatggtatagtctactttatttgctgcagtcaattaaaaaatctgtatatgagcttcttgtttttaaggaaaaagtctgcattaggcacaaacacacacacacacactatggacctggttaggactagtgagagggaatttgaaaatgaacaagtgcttcctgtcactatctcaccaacccaattgcctctcctcccatctacatacctagacaataggaacaagcacactagggcagaatccataagaaagcaaaacctaattttatagttgcctattttcttattcttttatttcttaattcattttaaatctttttttttttctgtgtatttgcactgaattgaacaaacaaaagcctttatattttgcggaggacaataaatattccctagaacacccaattactgttgaactagaaagcaaaagaaattcataagagaatggcacctttcgccgggcacggtggctcatgcctgtaatcccagcattttgggaggccgaggcgggcggatcacgaggacaggagatggagaccatcctgactaacttggagaaacccagtctctactgaaaatacaaaaaattagccgggcgtggtggcgggtgcctgtagtcccagctactcggaaggctgagacgggagaatggcttgaatccgggaggcggagcttacagtgagccaagatggcgccactgcactccaggctgggtgacagagcgaagattccgtcaccaaaaaaaaaaaaaaaaaaaaagagagagagagaatggcacctttattttcacttaagtgaaaagatagccttatctctgactcctaccacacaatttctgggagttaactcatgaaaggcatgcgacgcattgagaggttttatcctctttctatcttttccattctttcttaaccgctgttttcatccagtacctacccacttgtaattttcactctgaaaactagctatgcctctgcagtagcttacctgcaaggccatcattaatgagaatattgagtctatttctgcagaccttagcgaaatggaataattcagaatccagcaagcccaggaaatattgcccctgttgcatggaattcttgtttaatgacttgaatattacagagtggcagcagctgccttattacctcttctggtcaacccataacaccatgatgttatgaaaagcccattccagctgtataaatgcataaagctgtgaaaatgttgctctcactgataccttagtgaaccaagaagtaaggctgatattcaaggcaaaagtggaatatcactatacagttagaagtttgaattggttatgacagtcattggtatctagtcatgagtagcagtagctaaattagacagtagcatcagtttatatcttaatggacaagtttctggatttaacaagaaaacaataaacaccaaaataaatgtagctgaagaataaaggtagagattttttaatgtcttttgctttgaatttgtggtgtttcagtagaatattacatgtagtcagtcttgtgccatagatcttttatggtatcatctacccagtttacctgctgcagatggcaaaaaaaacaaaaacaaaaaaaaacaaaacacctgtatataagaagcttcttcagataatccctttagaattaaaagggattcgtgaaacaagcatcagaagcgcttagtggtggacagtagaggttctagaatcagaatgtgactcttggctccatcacgcatcagttaggtcactgtggcaagttatttcaactttctgtgcctcagtttctttgttggtaaaatggaaataatagaagtacccacctctagggtaattatgaatgttaagtcaattaacacagagaaagagtttaaaactgttagcacattgtagtgtcttaataaatattaatgtattattttaaaagttacttattattttaaagtgtttacttttatagtttattgttattgacttagaataaactccccgcactctaccttttcaaaaacctttgactctgtttcctctctttaaaatcttcatactgccattttcttttatactactaagtattcacaatggtatagagcctatggagatggaacacttcaacagcataaaataaacaaatgatttatcagaaatacaatacatcttgaaagttgcttttgactatttgttgagtcctagatttgtatctcagagtcggaatcatcacaaaggctgccaggaagtagtgggatactttcccttggtctctgtataacatactattttttttatacatttttacctcacttggccttctgttccttcactgctgcagggtatgggatcaaagccaaagaaaagtgatttgtttctgtctctactcctccttcatacaactaattatctccccatcctctctttctaaatgtagaagctgtgaaggtcagccgtactgtggattactgtcaatttagaacaccttccaaaaataaaatctctttgactattgttttcttgctgctttaaaaattgtttagcaatttccctcagtttgctttgtgagcatgtgttaactatttgctagagttaattgaaagtggttccccaatactttagccactctttgtttttgtatttcaataatttcagcaggaagaaaaatctaaaataatttaagtaacaaatgcaggcttttcctcagctagataaattgaccttttattttgcattttcttactactaagtattataccatgctgcaaagctctcaaaaggaaaaggatgtgcttttcggaagtttaatttattagtatgcaaactagtatcaaatagttgttttgaaagaatttgaccctgaagtttcagataccttcacagtcaaaactactcaatgtctcaaatcttttctgcagagtctattttaagtacttttcaacatgtttcttcatttgccttggggccatacctcctcatggatcactgaatctgcttaagcataattacagcaattcaaggactccatttagacattgcattcttttgacgttttggagttactttataaatgtaactgtagcaaatacaattttaagtatgaaactttatatagcttactgtgctgaccaagatgcaaaatagttctaccagttggtgtttgaatgatatataacaatagaaatggttctttcctatttaattttaattgatttgagccaagaaatagcatcctattggatatctgctgaaataggactaaactgctggtctcctgaactgtgatagagaaatccaatcaaaagcttttcctggccaaaaataatactaattgcaagtgaaaactagctttgttctctcggttatgagttccaatggtgaagtctagttccatataacagtgcatggtaaattaggccacagaaacaagcttccagtcactgtttatatgatccacatgttgtggtccaaaaaatgtaaataaaaataccctagggaataagaactttttcctaagatgacagcttttagccttggttgttgaaaatggtgagtatttctaatgaaattgaaaacaagtctagggaaatgaatttccaagtaatggaggagaatctttgagaacgagaagaaagaggagaggagaggaggggaggggaggggagggtaaggaaggaggaagggaggaaggaggggggagggaggaaggagggaggcagacaaagaaaactctcatctgaagattaatggttcttttaaagtcagaaagatcttcaaaataattttcaccattatatagacattacagaccaattgctttgacagagaatattctaattgtgttagtgcaaagagaatgcaatagatatacagttgtggacatctagggagatgagaaagaaaatgtttcagttttggactttgaaccactacaaagaccaagaattctccatatcaatatatgaatttgattatgttaatggaccagcatgggcccagcatgctttctagaaggatagtaatgagaaggtattgataaataagaggatttgttcaaggtcagggcttagctaagcctggtcactccagtccaggggccttgttatcccctaatgaggaggtcttgaaagttaacaccagaagcacggtaacattcaaccaccatcatatatgtctgtgcagtcactgtgtagaattacacatagtactaaattgtaggaagtttatgctaaaattgccattttcatgcttgtcaaccctatggtcatcattctaaagtcaccaattaaaatgattcctctttattttcttacagagctattaacactgaaccctcacgaaagttattgtcattctcctagtaatactaatagatataataatattaatagccaacatttcttgagtacttagtgtatgccactcttctaagggcactacctgtataaattcacttattccaataagctagatactgccagatttctgggattctaagacatctattttacaacactttaacatctttgtaatcagaactctttacagaaaaggacatacttaaacaacagctgtcagatgactcattttgtggttgtattgcttgtacacatacaaatttggtcagaattgtttggcagcttaattatttacttggccagtactatatgctgtttctttattagtggttcataaaacaatggtatctagtggtgatttcatgttagattcagtgaactagaaatttgttttctccattttaaaaataacatactaagatatgaatagtttagcaaaacttcccaattgtccagttactggtagggatggaattcacactgagacaaactggctcctgggtctatacttttttgtttctaatttttatgggtacatagtaggcatatgtatatatggggcacatgagatttttttgatacaagtatgcagtgtgtaataatcacgtcatcatagaaaatgaagtatccctcccctagagcattaacgaatctgtacattttaactgctatactctactgccataacccttctcaagatctgtctcaatggagtttgggtgagtcctcctgaccatcagaaacaccaccacagatagtgagcagttctctaaaagcaaacctcatgaatcgcttccttccattgcccccagacaatgttaagaaaccttaaaaaagaaaagagccatgattgattctttagtggtcctcatgagaaaactgtgctgtatacattcccagcccactttgtggtgtcacatgaggaagagccagcgtctttactcttagcaacaaccttccttgttgcaacttgtgagggcctgagctacagtgcctcctctatcaaagccattttgctgggtttctctttcttttataaacagaacactgatcccaagcagaatataacagatatgacttgtaatccgttatagtaccatttaatccttatgtttagctgccagcattctaattaagaatgtgttggcatatgttggccagaatcctgcaacatggaattattccatgggccaagcctgaggacacacactgctgcctaaaatcgaggaagaaagggccccaaccacactttagttcaagtgacttctgatataccttttctacaaaaggccattgcaaaatacaattctgcaagatcattttttacgaaataaataattttaactttgaacagggagctaagagggaagcatgaagattgaagaaatcaaattaactttggaacgagagattgtcgtcatagcctaaaaagtcaatgagcacatcaaaaggagagagattcctctgcccacagtaaaattcatcagggggccacatggtatagtgtatctaggtgttaggtgtgcagacaaggaatggcgtgcctcagtttggggtcagtttcactgactgaacatttgtgctgccccattgtacacactcagctctacaaatatcttgaccaattcatttccaacctagatgctagatatttgggagaaatttttaattggaggggattggcacatatgttgtaagtgccccatttgttttactatttgttaatggaaaatgccaatggtatacctcaaattaaagataccatcacccttagtaatagtttaaacaagatattccacagaagaagaatgagaagaatcactctagtatgagagctattgtgtttggattgtattttcttttctaaatcctaataggccaatgcaggtaaaatgatgaatccattaacaaggtgtttctatcctattacaaatcaaagtaactttactaccactgtgtaacctataataattatataccgtataatatataatgtatactgtaacacttatgttgccaattttaaaattttatactgatctagtccctttcacctgcaaatcttaaaatcttaacatttgttcatccagtgcactatgtaaaatggctttagctctttggaattggaagttgtatcttctaacatggcctaggagcagcccctgccttccagcatagagttcagcttccaacacacgcctcaagaaccatgggtttttttggaacatgaggccagctcttagctacctgcaattcggaacgtactatttggtttcagcagtttcttgacccttcatggggtcatcttcaagttctgtattgttgcatatgtgttttttctctttgcctttggatagttttctggctttcagattttgatctttcagattttgacaaatcagaaaaagaccaaacccagccaaaacgtgtctttcattacagtttgttctggttgaaatgttaaaccttctcacatccgtggtattgaagcaaattatgatccaaaaagaaagaggagttgggttcatcttctctctctcacatccacattgcaaatcagtcctttttcactccccatatttagtgctatctgttgtcctcttgcctcactttcttccaggaggtcttcgtatcctcaggtaggtctacagaaacacaatttagttttcctttcatcatgcaaacacaatgctacacctgcactaatcatctgtgctcaaagccaatggatgatagggggcaagtgttagaaattacccaaggctcttagcacctggagtgttttctcacagcctcacctgtatggataattttatcagccaaatagagtaagtggatcttagttgatcagagcaggaaacaagcttgaagccaggggtaaaaaaaaaaattaagagaagcaaatgaagcctccagaaagggaatctgaaagagacaaggtgaaggattagaagcagatggcatgagaaacagttccaagaagcaatgagaaaaggcagagctggtgatagttcactgctagagaccattaaacatccatatcccaaatggttccagatcagacctcccagggaatgaaattaatatgcaacagtctcctcctttgccagctgcttgtggcatttgtctcagctctctgtgaaaaattgtgtgtactcacaataacaaacatatacgcgacagcaatccttccgaggtgacacgagtcattgttgaagagtcgtgctcccagcacgttgggaggctgaggatggcagatcacctgaggtcgggagttcaagaccagcctgaccaacacggagaaaccctgtctctactaaaaatacaaaattagccaggtgtggtggcacatgcctgtaatcccagctactcgggaggctgaggcaggagaatcgctttaacccgggaggcagagattgtggtgagctgagatcgcgccattgcactccagcctgggcaacaggagtgaaactccatctcaaaaaaaaaaaaaaaaaaaaaagtcatgctcatggcattacttccttaaaacttcgagtaggatacagaaggaaataaagacagtaacctctttggggttctgtacatcttcacaaagcttttcttcatagatcagaaaagaaacttaaatattccttgggtttaagctgccacagaattgtgttaagattattaaaatacaagcatttaaatatgaggatcataagtctgccttactacttttgctccattatcctctgactcatcatctttcatagaccctgacagatcctcctcttcccactcttctccaccccactgtcttgccctgagtggctgatctgtgtagactagaacagactccttcaggtttccggttgggctaagtcctggagggccctggcagatcagaaggaagaaagagaggaactcaaggtacttagtgtcccatcttcctcctatgggcttgccttggccctctaagtcaaatgaaggtctccatcaacacaatgcttccctgtgttcaggaaagtgcatccaccttctgttcctttagggttaagagtggtagcaattctgctttgtagtccccaggtgatcccttatccctgggtttcctcatactctgacgataccttcagatataatcttttcatgaaaccctccttgcattgtttgagttttagtgtgccctctctttctagctaggaccacaactgctacatcctcctcctgattgcccaaacctaaaatgatgatgacccataattattatccagatacggtgacacaagcaattcctgaaatgctttcctctgaaattgctaaggattactcacaggcaagttacacagcttcaaaattacttttccagctctatattccctattatttctcgctgtttgcttttagacttaagtaaacttcaactccaattctataacttagtaaaagaatcacattgatgtgaaagtccaaaaagacatttgatgttgtaagtggaattttctcattcgttcactctctgtcaatgagaaattaaatgactaacactaaatggagtgctacatatgtctggcattttttacaaaggaatttatatactgtctctcatccagttatctcgcaagctctgtagggtaggttctgttattacgtgttttagatgtgagaaaactgagactcagagaggtaggcaaactatccaaagacataacgtgacagtaatgtgtctgggattattaacaccaaaagttggctttttggtggaatttgtaatgatgagtgattcatacatttgaagtggtgcttgacttatttaatggtacataacaaaccactccaaaacttaatggctcaaaacaatttattattttctctcacttactagtctatttgaagactagctaccacaggggaactcttaggcatttttttcacgtctgttatcctggaatgagtaaactctaatgagaacaaagaataccgaatatcatggagtttggatgaggagtgtgatacaacagggttacagtttgaattaggagtcacgccaaaaggaaggtagaaaggaatccagatcagtggaaaggaggaagcacctaacataagaactaggtgtgccattaagaattatgctttgggccgggcacggtggctcacacctgtaattccagcactttgggaggctggggctggtggatcaccggaggccaggagatggccaacctagtgaaacttcatctctactaaaaatacaaaaaatttcgttgggcatggtggcacatccctgtaatcccagctactctggagactaaggcaagagaattgcttgaaaccaggaggtggaggttgcagtgagctgagattgtgccactgcactccagcctgagcaacagagccaaactctgtctcgagaaaaaaaaaaaaaatgtgtttttctcttcaaaatctgactccctccctcagtcatgtaacctgcagcatagtattagcgcaagtgcagggagccaggcgaagggggagagtggtacacaattaagaagggcacagcctccccaggctcttactgaactgcattaccacatgacgatggaaagtcttcagctagttttccccccaaagaaatgaatctggtaaatcactatgtttaacttacatctgttttattaaaacctaagaacaatcgtttaatataaaaaagttttttgagacattttattaccgaaaacaaagatccaattacatggcttctgtagtgggagttctcagcagacagaagacaattacaaaatcaaataaagctgttataattttaaatcaaataattacagacaaaatgactaagtattgatatttttgtttttaaaaataaaaccaggctaaataaatgaaaataaatacttaaagaagtaattgttgcagctaaagcaaagcatataccttcttcacctaaaatattagcttacatgtttattttcattttaatgaaacccagcccccgtacaatatgtgtaaacgtcaaactaattttatgtttctctattaggtttcccaccattctaaatggtgcacatttaacaatattttatatttcattattactatggccctcgggttctgtgttagaacaattacatactgtaaagaattagaagtttttgaggatttactctccagaatagtgactgaatgtactttgatagaaatggagtaacaatagctaactctaatttatccactgcaattggtaataaaggaagatagttaagatctcaaatctggaagtctgatattttagccaacaatctcaaccttctcattaaacaaaatatttctttgcagataaggcctctgcccttattctctcatcttgctattgatgtccattacgtgcatttggactatgttatgcatgtgttggacatttatagaacactccttgagtgtaaagctctgttgggtattgaagggtacaaagactctatccatcccttcaataaacctagaactgcagagagagatagacacctgcaactgaagttcctgcctctcacaatattgatataattggctcctcccctcgccaattttatggtttgtgaaagttcaaagcatgtcttccatatcttttctcacctattggactcctgttgctgcacatgctgcttctgtgatgcattcagtggactcagatgtaaaactgcactgtctctttgagttcacatttagcaattttttattcacacttatgagctgaataaacttcacagaagatggtctgaaaggagacagatgaggaacttacatcacaggcatgcccacaatctgtaagggagccaagaaggcaggtcatctggaaagctaaatatcattttaagacattcatattctcctataaccatcaatgaccactactcacctctctctccaaactgccctttcttctcagctttctcttttatcctggattgcagaagctccagattcttttccctctaataaacagggaatgtccccctcctctgaagtcttggcaccatctgatacctagatattcccaacagagaatccagtctctggaagaagtgtttgtgcaaattacagagcatatttttaaaatattctcccttttgtcaaatacccttaattcaaggcatgaataaaaaggactagaaaataataatgttatgatattgcttatagtagtaagatttcttgattatgtatgtgtgaatatatataattgtgggaccatgtggtgattttttcccctttttctactatttgtcagaatgtttggtaataagactgctttggagtaacaaagaattgcttaagtagactagctataaattttaagctgatgatgatcaatctgaaatggatggttagacccagaaccttatgattattttgcctgaacaaattacagagatgaaaggctgccttcaaatttttggacaggatatcccaggtaaagatggaattcatcctaaaccagaggagtgatgtaataccaattccattaccactcagtgtccggcactccagaccagaacaaagctgaaaaatcggcaggtgtgaatgactcacactggacactgagtgataccattcacgtatcttctgtccccatgacggaagaaaattggcctaagaaactcaggaagtgaagcttatatggtgaaccaaaaaagttaggccatgcatgcttaaggaatactcagtgaaaaatcatgaatgctgatagaaaaatcctccctcacattgatgctactacagtgaagatataatgtaggtaaaaacactgtcttcataaggtattggccaccaggtcaacaaaaacagctgccctacagagggcatgttaaacagagaaccactctatccctgaagtaaatcctttcctgctttggcaattgaggggctggagttttacaggggaaggggaatcttccaaaagccctccttttttttctttttttaaagatttttacttctctcattttatttcttttttaacttttaagttcatgggtacaagggcagatttgttgcacaggtaaacttgtgtcttggggctttgttgtacagattatttcagcacccaggtattaagcctagtacccattagttatttttcctgatcctctgcttcctcccatccttcaccctctggcaggccccagtatctgttgttccctgctatgtgtccatgtgtttttatcatttagcttccacttataagtgagaaggtgcggtatttggttttctgctcctgtgcaagtttgctaacagcctccagctccatgcacatccctgcaagggatatgatctcgttctccaaaagccctactcttattctctacagggaaatcagatcttcactacttcagaggaaacatagcacattacttataccagtcatcctaagtcttcattcataaacataatctaactatcagaatagccaggtattataggaaaacaagaacttggcctctctatctctaccaaaatgaatgaataggaccaatccaagaagaagctgagttatctcaagaaaaaactttaggagagaagatttttaaatcccaattaacaaaatacaccatcaataaaaataatattatattgctttgggaaaaagtaggatataataaaattagaatagaattacgtaagtaaaaatttcagaggattgtctgaaaaatcagaggataaagctaactatcttgtagaagaaaaaatgacatttcttaaaatgtagatcacacaggaaaagacatcataaataggggaaaaggatagagacttgagggagattcatggaggccaaggtgcattcagtagaattccataagaagaaatcacagataatgaaagaaagggaaaccattgaaagaaacattagaagaaaattagcttttgctgaagaaatacaggaaccttctgattgattgaaagacacatcaatcaagcattgggcaggatagatgtttaaaaaataataaagctcttgatgcaatctcaagatgaagagacaattctaaaagcttctaaagaattaaaataggttacccaaaatgaagaatcagactaacacctgatatttcaccagaagcactaaaaccctcgaggacaataatggaaagcatatttgtgtgtatatgttttagaaagacatctggaaaaatatacatcaaacctttgggagttgagggagaagactggctttttactttctaccttgctgttgttttaatttttaagatcatcttttattacttttataactaaattattttaaaaatatctttcccttctaattaattctatccatggacagaattaattagtaggcaaagagactagacgctgttacctaattagaatgttattataacagtcactgacgagaaactgagaggggaagaacctacagtaatagaaattaggggcctgaatcaaggaatgttttgaagatatttttcatgatttggtgagttattgaaattaagaataaaggagaaagaaacaataaaggtgattcctacaagtctgaatgactagatgactagataattatgccattcagatgagaaagaccaaaggaggaatagatttctgttggatgttacggagaagtccatacgatgtttacgttacggacttgagtctgaggtataggaagagcattcatataaagggtctggcctgtggtctgaaatgggggctggagcttgggagagatgttgactggagagatagctgggccatggggtgagcagacaagaaagaaaaggactcatgacagatccatgtggagagcctgcaccaggggaaactgagggaagagaagccagtgctgcgggagaaggagtgttcatacggaaaggaggatctagagagatcaatgtcacagctaaaggaggacattttctccaaaaaggagaaggatttgccacattgacgaagacaagaaggaagagttgaaatgcaagtttttgataactgacaatgtcatttcttcttcaggaatttcaggttaataaatattagaatggccaaataatcttgtataatatattatggttcatcaggttgttctcatacaggcatctcttcattaccaaggggcttttaacatcttaagcaaggcaaaggtagaagaccccttacaaggttgcactttatctagatttctggagaaaacatggagtcaaggagtccaccccttagggatgagtttccagaattccaagctgaggtcaattcctgaaccaggaataccaagttcaaggaaaagatgggctgaagtcaggacacagaggtgagaccaaagccaccaggagcaagaccagagccagagaccagacagggaagacaaaaacaccatcagcgaacgtgttcatctgagagtcagtcagaggacatatcagcagtggcactatgaaactaataccttcttgcctttcaatcatttgtctgtcttattagggaaatgaattgttatctgataatatttcccacagaagaaagtgttaatcatttatattctcaagatctatgacctataaaatatgcatatggagaagattgatacttttctaatatgcattatgatgaaaaagaactattcatttcaaatggtataataggggaagtggttccttcatcatttttggctttttgtatcttccactgaacacattttctcttctgaacttctccagtacatattgtaatagcacatgtctgcttctaatcatttattaccttcatactgacatcttttcaaccacatacattgtatctttgtcatgacagccacaggggcaccaattctgtcttattttcctttgaatcctctatagctactagaacagtttacataataggttatctcatactaattggctgtcttttatcgcattacccaaagataatgactactgaggattattcctaatacaacctaatacaacctccatatctgcatctgtggattcaaccaatctcagattgaaaatatttgaaaaaaaatggtgtctgtactgaacatttacagaccttttttcttgtcattattccttaataatacagtataacaactatttacatagcagtcatcatattaggtattatgagtaatctagaagtgatttaaggtatactggaggatgtgcataggttttatgcaaatactacatcattttatattaggaacttgagcatctctgaattttggtatccaagggaggtcctggaaccactcccccatagatactgaggaatgactatattatttccttatgtaggtttttatattttttaaagtattttaaggtacataagatctcttgattttcacaagaattaagtggcttaaatgggagagagggtggattaccacttaatagatgagtaaactgaggttcaaataattcaatgattttccaaaagattcagtattcaaactacagtctatactttttaattcttaactgggttaccttctactaccagaagtgctgttgattttctgtaattgagattcagataaccgaacccacatatcctaggccagtggttcttatatggtggtggctggggctaggggaagacttcaggggtgtatgcgtataccactttccaagaagagattggaaatgtgcagagttatcacatggtgggtatcacaatggatggaaagtgattgtggcatttagtaggatggggtgtttaacaccttgcaatactgaagccaccacggtgagaattgttccatttgaacacccattgcatccctcttaagaaactcagcaagtttaggcaaataaagggaactatagccacctctacaaatatctgaccaagagtcctcctttatgctgtctataaggggtaagtgagcaaaagcaggaatttagcacacaatccaggctcgtattctttgtacataaaaatacaactattacatcatcgcattaataatcacataagcaacgtggtgtgtaatttacaagaacacttaaagaactctcagtaccttggtgccggttagagacttcactgaatacattttaacttatactcctttatttgttttgataaaaaagagagtcaaacagaattgtctggaatcttttcttaaggttaacagctttctgttcccctttgttcaagtgttcattttaataatctaattattccagatctatgactcctgctactcaggactctcccaaaagacccctgacttctgatgttccacttctgcctgtcctttaacccaaatagattcctgttgcccttccagcaaaacaaaacgaaaggaaatgacatgctacagaaggctttcttctcagtttgcaacaaaccctgtaacaaggttttccctctgtttaggataaaggtctctgggcacctaaggcattaagccacagagcattgccctcctgcattattaccatcctgggattaccttttgaaacattctagcatttgtatttgaccgtgttcacactgctataaagaactgcctgagattaggtaatttataaaggaaagaggtttaactgactcacagttcatggctggagaggtctcaggaaacttacaattatggcggaaggcaaagggaaagcaagacaccttccacacaacgcagcacaaggcaggaagaaatgtcaagcaaagcgaggaagagccccttataaaaccatcagatctcgcgagaactcactcactatcacgagaccagcatgggggaaacgacctccatgattcaattacctccacctggtctctcccttgacacttggggattatgggattacaattcaaggtgagatttaggtggagacacaaagcctaactacatcagcattgaaaaggttctctcttttttttttttttgagacggagtctcactctgtctcccaggctggagtgcagtggcgcgatctcggctcactgcaagctccacctccggggttcaagctattctcctgcctcagcctcccgagtagctgggactataggcgcctgccaccacgcccggctaatttttttgtatttttagtagagacagtttcatcgtgttagccaggatggtctgatctcctgaccttgtgatccgctgcctcggcctcccaaaatgctgggattacaggcgtgagccaccgcgcccagcggaaaagattttctagagtttagtgctttcaaattatctttactacagatacatttctaaaaggatatgcctttccaatttcattaagttgcttagggtgagaacacaggactgaggaaataattgggcacaaaaaacagctcttacctgtaaccctttcaagtgcaaactgtgatgacaaatgctttactcactcaataactaataacatacttttggttacacaaacatactgctaaaaaattgtattttcaatgattgaagcaattattctacataattttcacttagcagttctaagaatgtattgatttgttttctgctcatctggtatactggagcaaattgtttagctgtgatgctttacaaagtgccatgtatcactttgtatctccaattaaatttcaattaagaaatcttataattatcttatatcaaccagccaagagcagaaattcctcatattgaatcatacttacactactaatgagactgtcaaggtttggctttatgtttacctcagataggcgtccaaaaactgtgatgattgtccaaactctccgaacatcttgagtctgcaaaatttcgctggcagtcttgtgggaagaagtttcttttctgcatgagccatagtgtctgcttcaagtcctggctcaaagtcagactacaaaggcagacaaaaatgagagggaaatttttatctaagtagttcaaagcttcaaaatggatgaaaggttcaggaaaagggaaagtttattttctttaaaaccagttcaacatatttggtgcctatggccacattcatgtttaacctgttacagcagtaataaattgaattctatcccccttcaggtgagaataaccagtaaggaaactttctgtgacatattttatattcttggatcttttccctgttttaacacacaagagtggcaataccaaaacaagctgtgtttttatttgaattgtgcttatacataggcatcataagtatatactgaagtatttgcttaagcaagtagggtattaagtaggattttaaaaataagtagaagcaaaacgggaatgataattgaaaatgtatagaattataaaatgtgcctcatgatttgaagtatagatccagggaattattctgagtaagtaaacaatccacttccttttttctatctggaatctaataaaatgttttaaaggctttgcccttaaaatgaaaaggtaagtatacaaagaaaattgaaagatttaaccgaatgagaaattgcttaatataattcctacagtcatgacattccaagttcagaacaatttgttttaaatttaaataaaataaaataaaataaaattttattttaaataaattttaaataaaataataaaattcagtccattttagccatagaccttgtttttcaaatgaccttatgattcagttattatacctgcgctcattctgtgacaggtcattccagaagagacacaattgtacaaagctgaacataaaataaatcttggtttcttattgaattttaaattacattgggaatgcttttggaataattccagaccttaggagaaaaaacgtctcccaactctaaagtcccaggttccatctcaacgtttcacattcaccggcaaaggctccaaaaataaattacaggcaagcttaaaagatcagaaaggctttcccattgtgcaagtgggtgattacccgcgattggtgtctgttacagtcattgtgtctttctctaggattctctctctgtttccgaaacacatatgttccaagttttggatgctacgacttcgtgttcatgtggttcagaatttagccctcccccagcccctaaaaaggctgatcttatgggcgtgaaaaacaggcatttcacagatttagataaatgtatagtgtgtcataaaactagctcatagaattataatttgaaattgttaagaacattgtgagtacctactacctgagggatgaatttcaatggcacaccttattttgtttcatccttactacagctgtgctatcccattttacaaataaggaaaactgaggcttagagaaattaagtaacttttccataatttgtcagctaggaaatgatacaagttgagttcagatctaagttttcagaccccacgtcaaggggtttcagctttaaaaattacgagtcctgcccgggcgcggtggctcacgcctgtaatcccagcactttgggacgccgaggcaggggaataacaaggtcaagagttcgagaccagcctggctaacatggagaaaccccatttctactaaaaatacaaaaattagccacccgtggtggcgcacccctgtaatcccagctactcaggaggctgaggcaggagaatcgcttgaacccgggaggcggaggttgcagtgagccgagatggcgccactgactgtctcaaaaaataaaaataaataaataaataaataaataaataaataaataaataaataaagatgctttggaaaacctaaaggttgtgcaaaggcctctcacaatttcttttcatagttaatttatgaaaatgcaacacacagtctcatcaaagctcaaaattatctttttcatccccgttggtaccctgttgattcttccaaactaaaacacagctgcatataattcagatttattatactttattttatttttttaaataatttcaacttttagattcagggggtacacgtgcaggtttgttacatgggtatattgcgtggtgctgaggcttggggtacgattgatctggtcacccaggtattgagcatagtacccaagagttagtttctcacccccttcccttctccctccctcccccttctagtaatccccaatgtctactgttgccatctttatgtccatgtcatacttttttatgatgtaaaccaactatagtgtagtccaagaccttaaaggcacctgaagctgaaaaagaatgttaattatggcaccgtattatgaccaagtcatcccagtctgtgctgcgacatgagccctaacgattttctcattagcagatgctctagctggtttccatgaaggctttccacagtgacttccatagtcgtcataggcgactactatcagattccatctcaacgtttcacattcacaggcagaggctccaaaaataaattacaggcaagcttaaaagatcagaaaggctttcccagcatgcgagtgggtgattcatttgatttgtgcctgttacagtcattgtgtctttctctaggcttctttctgtttccgaaacacaaaactacagaaaccacctcaccctctttctgtccttagggttcatgctaattatgtttttactctgaaacgggttttaggattgaagggccatgtcgaatggtgataattctatttcagttagacaagagcctggaaaaaaaattattttaaatgagtttcagtttgcgcatttttttaaaaaaagagcaaaaagtatgcatgtatgtttgtttttacattcttctttatttttatcttcttactttgctttttaatgagtcattagcattggaaaatgaaaacaatttttctctagccaagaaatattgcaggtattacacattctcctacatcaaagcaaaggcactccaagccccctttttaatgaaaagagtttttagcaggtgggaagaaaaaaaaaaaaaagcacttgctcctgagatgataaaaagccatttttcactgcaaaattattaaattagctgtaaggagttggagtttgtatttggcattccttctcacctcaccccagccttcatctctcattgcatttttgtggaagggttatagatatactctaaattgttgacctatcatggagacggtagttagtctccaaattccctgtgggcaaagatgattgcagcctccctgctaataagtacacttcagttctatgaaatttatacttaaaagaaaacaatggaaaatgtggcacaaacacattgtcatatttacgcagatatgttgactcactgttacttaagcgtcaatgaattattcagggctcaagatggggataaatattcagggaggtaactgcactcattctttatctgtttgtgttattcgggtttttacttggtttctttatttttgcttttttctcatatgagaagtgttcagatgacagcacatccaacaacaaaattcagcccccatcctataaaaacgtcctctcttagactgtcttgttagttgtgacatattttattgtaaactaaaactaactgggaattgggttgtatttattttacactctcactcattttatttatttatttatttatttatttatttatttatttatttatctgttgagacagtcttactctgtcgcccaggctggagtgcagtggcatgaggcccaggttcaagcgattctcctgcctcagcctcctgagtagctgggattacaggcgctcgccaccacacctggctaatttttttgtatttttagtagagacagggtttcaccatgttggccaggctagtcgcaaactcctgacctccagtgatccgcccaccttagcctcccaaagtgctggaattacaagcatgagtcaccatgcccagcctctcttactcattttataatagatccagtctttaaagaaatataagccatttgattgcccaattatatgttgcaaaaaaataaaaatgttgaaaagtgtcccttccagtcaacagatatttattgagcacctactcagtgaagacactgttcaggatgcccagaatacaggagtgaacaaaagagacaaaaatgcctgccttttgaagctgacatttgagttgcagaggtgaggggaaagtggtggtggatctaccctaacatttgcgttatcactatgtgctcaaattcgtatgtgtatgtttcccaaactggtctcatcatcacaaacacacacatacacacacctttaaggttatactgctgttatccacgttttgcaagtgagaaaactgaggcacagcaaggataagtaatgtgtcagtcacccaggtagtgaatgacatgtccaagactctagcctgagcagtttgtctctgggatctgtggttttatggtaactaaaaccgccactcatggctagacatggtgggttgtgcctgtggtcccagctactcgggaggctgagatgggagggtgacttgaccctaggagttcgaggctgcagtgagctatgatcataccactgcactctagcctgggcaacagagagaaaaaagaaaattttttaaaataaattaaaaaaaaaactgctgcaccctattaacaattattgtggcaggtttttagtggcaaagaattctgaagtactttgttgagtgctcccacctaggaaactagtcttttacctaacttggcactttatatcaaccacaaccacaatccagcagtttccataaacagaaaaattataccatgactacttatgtaaagctatatgtaaggctccctatatatttatgtaaagctctctctctctatatatatatatatatggtttacatgtttctcccagctaacctttccatatatatatatatatatatatatatatatatatatatatatatatggagagaaagagagagagagagcttaggcagataccaaccttgggtgggaatctttcacatccttaaaaaggtttgggcctatctgatggccttgttgcgtcattgccctctacgtggctggacccagagcaagggccatttccagacagtctccaccagcccactggattcacctggctcctcagacctctgcctcttccatttccgtatgacctaatcacctgctgtcttttgatatattaagattttgtgccactctcctactgagatggaccttaaatcctcatgagctgatactgtctcgtctactttatgagaaagtatagcacagtaattaagagcacagcctctgagcatgtcagctaggaccacttcctagctccatcatttgcaagctgtgtgacactgagaacgtcacttgccttgtctgaccctcatcttcttcatttgtaaaatggagacgatactactgttgagaggaatatatgagttaacagatagaaagtaattaggataacacatgacacctagttgatagtatataaattatatttatcttttttttttttggcatcttccctctccacataatctcgtctcaactgcagggactacagttaagtttaactgggcttactaggcaagatgtggtactaaatgggcatctagtttaatgtataaaacacaatctctgtaagttttcctctattctgcctccgccacagttgtaagagagagacatttctacctccataatggtgtagatgattgaatgcaaatggcaggagggcaaaaaaaaaaattaaatgaagtaaatgaaaatgagctaaatgtttgaaaatgagctacatatttaattatattaaatactgtatattataccctgtcccaagagtctgagtcatcatttgaagggtaccttcccacaaccagccaagctgggaaaagataccccaccttatagacactattggctccctccagcctttcgaaaagtcttaacaaatactaaatctgcagactgcatttcattgctaaagtcttacaaaattttagttctcagcagagacattagtatctttggggaaaaaaaacccaaaggaagagatccttctagttttgctcactcattaaaaatgtgttgaataatgaatgaatttggtgtatttgtgtatacatgaagatgtactcacgtatatgcatatatagagaatatttgccaataattgttttatatatattctttctccatttttactgcctgaatactgaaaacaaatttcttgacttaattctacaaggcaaatatcacataatctgctatgccaaatgtcattgataaatcatgtatttatctgtgtgaatgtgttccaacttttaaaattagaaactacatgttctgtttatactttctctcactgatatatactgattattagatgatttgaaatttagttctaagtgcacatttctgcatatcctgcagtgttagcaagataagaacttgacttatttgtccatttcaacaaatattttcagtacctattatatgcctggcataggccctgtggatatcaaaataagtaaatgctgtcttgccttgagtagtataatattgcagcatagctcatggtcctggtaattcttgaggttaatgtgtgtgttaattacctatttataggtgtatccattaatggaaaacttcccaggatctactaggcatttaaagatgggagagtgagcttgttattataaataaattaagccaaccatttacttagaattttttatcctaatttaaaatacagataagattatatgacttttaaaaatcatcttgaattactaaaatacttaagtgaattgcaaaatcaaaaaggataatttcgttttacacttatttctattatcagcatttgtagaaaattttacacttcttatttcctagtttattcagaaaattccaaggctgttcactaaaaaagttaactgattttgcaagtaatctcatgagctagcccaccctaacagaaagggaccatttttacaccaggacaatgtttctcccagctaaccttgtttctggagggttgtccaagtcatccccagggaaacaacgtaaaagctacttcagattttgtgggtctcttgggacacaaacaccatacacgtgcctatatatgaccgtcactcacttgggtagaggctagcattgtcaggacagatgcaggtctgatttctcagatccagcaacttcaatccttggaatattagattaactctctcagcctgtgagaggaaatcaaagtggtggcagaaataatcccggagctcagactgaaatcatttcctcatgagctttttattttcatcctctctggtttccaaaactcaaattccttacttagtatctctctaaagcctgagtccttagtgtaaatgactatttcctttactctcttttaatagaactcaagattggccgggtgtggtggctcacacctgtaatcccagcactttgggagggtgaggcaggcggattacctgaggtcaggagttcaagaccagcctggccaacatggtgaaacctcgtctctactaaaagtataaaaaaattagccgggcgaggtggcaggtgcctgtaatcccagctacttgggaggctgaggcaggagaatcacttgaacccaggaggcggaggttgcagtgagccgagattgcaccactgcactccagcctgggcaacaagagagaaactctgtctcaaaaaaaaaaagaactcagtttctttttctctattgcttcctacagctaatctatagcaaattacataccttgtttgattttttacctattcactcttttaatctgagccttctgtctatcctccttttcccacatctgtcctagatccattccagttgtgtgactattgcactgctctttcctatttcaaacacaatatcattaggaataccagtatttatttacaatgacaaaacaactgagttttgtaattacataatgtcagtttatcaatatataatatccacttcctacagtcagaaagaggaacagttctatcatgtacaattatgatgggaaaggtggaatgatcccttatgcagcaattttaagtgagttcatgattttaaattacttaaaataagtgctaggaagctcccattttcaaaccctttattttcctggcttaacagaggaataaaatgctatttaaatgcacaattccattctaaaagaatggattctgttaggaaagaaatttaggggtagctctttcatttaaccaagcagcttgatagcttctgtatatgcacaggttggcctggagctgagtttgagagtaaggaacagagaaagacgaattactgtgtgtattcatctgagaaacatatggagttcctgcaggaaatatgagaggaagagaataaagaacaataatgagagtgagagcagtcagcaagatcagagtgctcagaacatatcggaagccagtaaaaaattccaacgccccccaccccccacccaccaaaagaaagtttaagaacagagatgcctgcttttcaaattaaaatgtttatcattccagctccttaagctttccttgcctcccccaaattaccagtaaaatctcttagcacagaaaatctttgtgtgagtgaaattctgtgaaaatcagaacaagaagctgagctattggggtccacaaagcaaagaacaggtatagcccaggcaagatgctgggatttgaacttgaagatggatcttagagccaggagttaccatgagaatttaagcccctgaaaattcatagacatcctgcaggtctttaaactttccataggtgccgaaatgaaaaaagttggtccagtataacccagtttttgaggatacccgctgatacgtgtactataatcaaacatcggtttgtcactgtcccacttaaaatgtgagggctaaaactaagcgcaaattccaaatgatttatttccagcacagagaagaagttgggacctctcttatttcctgaacctgattatacttctatggatactataaagcagcctaggtttacattatgtatttcaatccatcacatgctgatctcatagccacagatttttttattcacatgaacaactgtcttctctccctgttccccaaagctgtatttcataatttttttaaagtaatctgaacttaacaccttatatttttccctattaaattttaccttttgggtttttgtggccagcattccaacctgttcatacattttagagttctgattctgttaccccttgtctcagctgcagatttgatccatctgcctttacctgacaaggggttataaggagccgtggacaaagagaaagaatacaaatctcaagccctggaccgtcgccccacacgcctactaactgggtgtgtggcaagcacccggccagtgatttaacctttcagaaactaagtttccctgtttgtaaagtagaaaagccaatttctggcaaacttgcctcaggttattaggaaaaccaagtggggagtgtgtgggagtgtgtgtgttgtgtgtgtgtgtggccagcataacaccgccaataacaccacaatgaacgtggagccctctggggtaactgtgaagatctccttccaggccaggcatggtggctcatgtctgtaatcctagcactttgggaggccaaggcaggcagattgcctgagctcaggagttttgagaccaccctggccaacctggtgaaacattatctctaataaaatacaaaaaaaaaaaaaaaaaaaaagccaggtgtggtggcaggtgcctgtagactgagctactcaggaggttgaggcgcaagaattgcttaaacctgggaggcgtggccaggcacagtggctcatgcctgcaatcccaggactttgggaggccgaggcgggcagatcacgaggtcgagatagagaccatcctggccaacatggtgaaaccccatctctattaaaaatacaaaaattagctgggcgtggtggcgtgcgcctgtagtcccagctacccaggaggctgaggcaggaaaattactggaacccgggaggcggagcttgcagtgagccgtgatcgtgccactgcactccagcctgggcgacagagcaagactccgtctcaaaaaaaaaaaaaaaaaaaaacctgggaggcggaggtggcagtgagccgagaatgtgccactgcattccagcctgggcaacaaagagcaaacaaacaaacaaacaaacaaacaaaaaagtctccttcaggctcagcacaattaattatccagcatgtgcttcttgaacaccaactacacgtcagacccaaagtgttcaacataaaaaaattaatgagacaaaaggatcttatctaaagccattaataagaaattctaaaagattgaaggggagagttcagtcaccaatgaggtaatatttactgttaaattttattgctctgacttaaaaatggaagaggctcttccttactttttttcagatgaaaaaaggaaaagagatcatttccttctaactcaggaaaaaaaaaaaaacagggaaacactaatactctcagcagatcatattactcctaaattatctttacacttctttgttttctggtgtacacaaagaaaagaagcaatgatttgagatgattttgaagacaaagttcttcccaatgactagttaaatctaaagagattccccaaggctgaatctcagaagaggctaataaaatactgatatgagagatgagagagtctggcgaaatggtctggtgtggggcctgggcattatcagggaaatctaatgcaagtcctaggtgagaaccattgtaggagagacaaagtaaggagagttgaagttcaaagctctggggaagagcatcctatgatataataaaggataataaggatatacaagtcttatttttaaaactatcttacatgtttcctttgaaaggttgctttaaaattattaccgtaaatgattttattcttgaaattaacgatttaaatacaaatttgaggagcgtggtaaataatatgaaagttgcagactgggtacagtggctcatacttgtaatcacaatattttgggaggccaaggcaggaggtttgcttgggcccaggaggttgttgtagtgagattatagtgagccatgactgtgccactgcaatccagcctgggtgacagagcaagaccctatctctaaaaaagaaagaaagaaaaaaaaattaaaaaagaaagttgctattaaatcttgaggaaaatataattatctcagaaaaacaccatctgatgatttaagccaccatctgacaatttaaatcacttactctctataaatatttaaatttccatgtggtctgctttttgagtgatgaattttctttttttacaaagatatcattgaaataattaaaattgtcaattgattgcaatgtcacacttctcaaaaaaaaaaaaaattagtattgcagcgtctaaaccaaaagcataagggcagtgaatgcaaaacagatgttcatctcggtgggtgttcaaaacaattttttaaagtcagatgtctctgtatatgtgtttgtacagcctcaagacacggtcttaacagtttatatatttaaatgctcactcatttgatataatgtcaagtaaacaagatagcattaaaatcaactactcaattaatttattttttccatcctttatttctacggatttttcaaacatctagtactgaaggatcttgacatttttaacccagtacattccctccctcttattaatacttcacccaattatcttttttaaagtatcctatttagagggaagctagagcctataatttattttaatattctggtgagagatgagaaacaaagatatccatcaaagggctatttaattttagaaaagttaaccagccattagacattcatgggcaatagttcaaggaacaagaaccacaaaaaaaaaatgagagttagaattgaagaaacaaatctttaaccctcagaaaaccaagaggttttttaataccttattttctatagtagcatttagcaaaaggcaatgaaattctatccccaaaatgaagaagtttatgatggttctgacaataattcatttatgtagaattatattatttacactttcatccatgttgtctcatttattcctcccaacatctttgagtaatcattttacaaatagaaaataaatctgagtaatttctccattagccatagtgaatacaacacattaggaaattaatgccaggttcatctctctcaatgctcagtgccatttcccctgtatcagcaaatacttaggataactgtgggcctgggattgtggagggattggaactaaagcacacttaataaaaaggagagaagagttcctcagggctaatcctaagttaaaagggatgactttactttgtctgagtcagtgcaaaactacatttttttttatcaaaacagaaaacgaaaacaaagaaaaatggtaagtgcttcaatcataccatccaaagcagagaattaccatattcaagtcatggagctcccccaggcctacaagtatttgagttattctagttctctgttcctctgggataaaatagaataaaaccctgcaagactcacagggaaagccaaatgtggaaccgaagcaaaaggggcatttttggcaaaatgacaaaacacagtaagcctctataactaatctggacttcaagctagagatatttatgagcttctaaagagccactgggagagtctccccgtgcccagtgcccacctaaacttctgtagttacattcctcactcactatgggggcgccctctttgggaactttgctaatcaagctgggcactcaagatcaaatttttgctatacaagcaaattagtctcacttatagggggtcagtatttcgttttgtctctttagagacatatgttatgaatccctcaattactaatttagttttgcttttcagtttgatactctgcccccaatccatgttctttcattgaactgtaatgttttactacttgtcattatttttggaaaaacagtttctaactctcttgttactagtgctaatttgcataatttgaattaatggagaatttgccaacacttacgtagcttctacaaagtttgcagttgcttcaagaattttcacattttataaatccagtgacaaagtttagagttatctatgcactgtagtgtatacccttgttacattataatttttatacccctgaaagacttattacaaatcacagaaagccaaaatcattgtattcttgcctgaattgggtagtctgtttttttcaatttctcttaatttgatgaataaaaaataaatctatttttatgtgcatttttgaatatgaattatattttcaaatgtttttattttctctttcgtgaattgtttgctcaggtcttttgcctattatttcagcaatctgaggaaactctagggcaaaataaggaagctgctagccacattttataacttgcttaagaactggcaatgacagtttatcaggattttatacataaggattccaggagtatacttcataaccacaaacttgggagtcacaattcttttattgtgtaaatggtagaattcctgagtgcttggtgcattagttattaaaggaaataaaacaaaatttcaaaatatagtaaccatgaggactaatttgttacctactctttgtaaaggagatatcaatgtggataaaaacaaacctgggggtacatatattaagactttcaaaggcccttgacaatagtttagaataaaaatgatgtttcatttttttttaacattttataacttgtttttttaaattaaaaaaaaaacaaaacaggcaatgtgaatcatgtatttagagcagcttgtccatggctagtgaactggcttggaggtagcaaaccaaggacaactctccactaaatgaagtaaaattaaacactcgtgttggcttatgatcagtgctggaaacatctgactctgatattatagtgtgatttggaagagaaaattcacgatgacatttccaattttcagatgacaccaagtttttccaagtcatgacataccaagtcaaattgggaaggaagatagaggaagctcccgtgagtctttggttttgaggtactactccacaagggtaaacctttgagatgtatacattaaatacattaggtaaaatctttgagatttaccctataaggtaaatctctagtgtcattggcccaatttaaagatgtgaaaactgagtctcagagatgttagtttaagtcacccaagttgactcagccagtaagtgaggagtttgtatttgacatcaatctaaataagagcctatcctttactgcccccaatgtgagagaggaaggaatcacactcatgaagggacccaaagccaacgtggggtgaggggagggcaggaacctgggaagttggattcatttggttttttgagttggtgagaaacaagcaggtatatttaaatgtggggaagtatgaagtgatatttttaaggaagtccagtgctgcaggaaaatgaatccctggaatccatgagctttcttataccacttactggcaacacaggctctaaacactaacctgccagcaacatcaacccagttcattagctaacttttcctgtttggaaacacaatggcaaatattatcctacccagtacaaagccataaccccctatacaggaagaaagctgtggaaatctgaagtgaaattttaaaattgttatatattcctatgtatttaatatgtgggttttttggggggttttcttgtttgtttttgttttgttttgttttgtttttgagacagagtctcactctgtcggccaggctggagtgcagtggcatgatctcagctcactgcaacctctgcctcccgggctcatgcgattgtcctgcctcagcctcctgagtagctgagactacaggcgcgtgccaccatgaccggctaattttttaatttttaatagagacagggtttcaccatattggacaggctgatctcgaactcctgacctcaggtaatctgcttgccttggcctcccaaactgctgggagtacaggcgggtgccaccacgcccagacaatatgtgttaagcattgtgctaatacttcatatgctgggcaacatccaacaacctataaccctacaaacctataacccaacaaccctataagataaatctctagtgtcattggcccattttaaagatgtgaaaactgagtctcagagatattaggtaagtcacccaagcttacttagccagtaagtgaggagtttggatttgaaacccatctaattgaaaacctattctttactgtccccatatgtaagagaaggaaccacagccatgaagggactcaaaacgactgtgaggagggcaagtctggggaaaaaaagccttataatgttgtaatggctctggtaaaagtctgcaaaaggtagagatgggtgaagttaaagcaaacagagtctaagtccaagataaggtaattcatttataagagtcattaatgcaagtgctacaattgaaaattttttaacgtaaaatgtttaaactagtaagtgacatatttgcaatcagtggattcagaaaaattaagttactggagagaatattcctgtgcttgggttggcactaaagaaagataactctgtctgcctacaaaggaacctgtggtattgctgtcagaaaaagaaggctggggtgaattagactgaacgtttgtgtataatgattcttaatctgtacttcaaaaatgtatcattagacatgcagatatgtttacccatttttgttgttgttgttgttgttgttggccttgctttgtttttttggactgtttttccttatgtctaacttagattctgataagcaccaagctgcttccctacctgagtgccttggaatatgcatttttcctcttactggaatgttctttctcctctccctcctactaccattcaatggagagggcttctgggtagggtaggggcatcatgttatttttatttgctgaatcagggaattctacattctggaaggaaacttctgatatttgtgacaacggcgattttaaaaactgttcatttaccacatctttccctgagtccaaggtccgtggcagcagagaccatgtctgtccagcccccactgaggccagcgcagtgcctggcacacagggaactatcactaagccctggttcaatgccggacatccttcggcttgtacatgaagcccggtagctctgttttatgagggtaggaaacatctggtcaccattgtttatgaaatatttgccacctgaaaaaccattattattaggtcattccttgttccttgctttatttttctgagtttttttctctccattaagaacatatttcctggaactccttattggcaaggaaagctaactcactttttactttctccaatacccttattgagtttctctcttactcttcagaccgccaatgattagtggggaaatctaccaatgctggagcaaagacactatcccatctttaacggggagaaatttgtagaaccataaaactacagcaaaagtgttgaacacctctatgtcagccaatccgtggtcaccacagatgttcatagtctcacagcaatgcatgttacctgtatttttagaattgtttaaaacaaaagcgactattattatttaacaagttgtaatgctgacatggtaaacattaaaatatttgaggctaagtacgctcttaatttttttaaaagatttttgttatggagcaatttgaaagtctttaatgctccatatataaagaaacctttttatattttgctttatatatctttcgtttaataatcttgatttcagaatctaccagaatttaattctagagccctccaaaataaataatcagctttcaggttatctcaacaacttcactgatattttaaagaaaaacctatcatatttatactatttacttttatactatcatgtttatactatttatatttatactattcatatttataccaagatacaaattaaaaacactggaacaaaatacattaaaatggaaacaatgtttgccttcgtagggcataattttgagtgattttttgtttctatttttgtatttttatttgtatacgatgagatttatatgcaaggagaaaaaacaaacaaaatattcaattttattggagtccagtcttctaatgaagtatgaaagaaagaaacatgtagatctactattattaaagatttatacgaatattaaggatgttccctggggtgttttccccagtgaattgaacttgtgaataagtcctaagtgccagcaatgaaagcgaagcaggtatctgtcaaggctgattaggaacggagcatagagaatagaaccacagaaaccaaagaagactaaaactggttctaagggttgaggcctgagaaaaatccataccaggttccagcctttccctaactaaaaaggaggaagatggctgaatctgcctggtggggagaggggtaatttgctgcaggtggaaccactttattcagacctgagcaccgcagcgagccctctgtggacccgctttgctgagaaaacttgctgctccctgggttctatccagagcagcctggcgattgtgttctaattttccttttagatagctgaatatgagtattagaatgaaagatctgatattagcagatcaatcatctctttctccactttctgttacacaattaaaccagcaggtgaggcagagtgccgcaaaagtaagtagaccagctgttccatttcagaatagacttgccaagcataacacatttagaaacaaaatgcagttcattccaaagcagttgatttaatccctcattatccatttatgtattcagcatcatggcccatcttgacaccttattaataaattattcaaaagcttacctctggatagcatagttgttaagacctagggatccagtcaaaaagagggatcgattgcaggctcagatgcaaattaactctataacctaagacaccctatttaaccttcttaaatcttcatttcctcatttgtaaaatgtgtatagaaccaccccgaagttccgggatcatggattagagagagaaaaggtttaagacctcttagcacagcttctaacacatagtatagtcagtgttcgtaaatggagttcatattaataccctttttttttttgagacagagtctcactctgtcgcccaggctggagtgcagtggcgcaatctcggctcactgcaggctccgccccccgggttcacgccattctcctgcctcggcctccagagtagctgggactacaggtgcccaccaccacgcccggctaattttttgtatttttagtagaaacggggcttcaccgtgttagccaggatgctctcgatctcctgacctcgtgatccgcccgcctctgcctcccaaagtgctgggattacaggtgtaagccacggcgcccggccatattaataccttttaaaatagggaccagaagttgaagaagaagaagtgaagaaaaaggtaaagtgttttccctcttccattcacatatatttttcattttttaaaaatgggctttccggaagtgaaactcctgtaccagcgaagcaggatgctttcaatgtgtgcaaatcaacctcttggtagcctgccttttaaaagctcaaactatccatccccacacaagtctgggactcttaccctgtgttattttttaagtcatttaagtcatgcttgagaggaacatcattgttactatcagtcttaacatcttaattcaaaccagcctaacaaaaaagactgagaaaatatgaaagtacagaaatttgtgctagagaaaaagatgggaggaaaagtgtcacaccttggggctgccccgatgtctctttgcctcttaggtgcagggtactccatactctcgtgactaaggcatgaagcctagaagaagtggctacttctgcctgtggtttatagccctactttattctagacagctccctgcacagattagaaggcaggaagcagagcaagtgttcctgtaatcagcctcccccgggaactgtcagtattcaatgggctctcaactcacatttccacttgtttttgttttgttttgttttgttttgttttgagacagagtctcgctctgttgcccaggctggagtgcagtgacgggatcttggctcactgcaacctccacctcccggcttcaagcaattctccttcctcagcctcccgagtagctgggattacaggtgtgtgccacctcatctcagtaatttttgtatttttagtagagatggggtttcaccatgttggccagtctggtctcaaactcgtgacctcaggtgatctgcccatctcagcctcccaaagtgctgggattacaggcgtgagccaccactcccggcctccacttgttcgttcaatatacgtttgccctatagagttccatgcatctgagaatattccaacaaatcttagaccatttccaagcaacggatccctattgtactatttcttctatttctctctgtaagcattaactttgaaactacagccattaaatcatattcattagttcattccaggcataatcaatatgttggactaggacaactcaagaagtaaacaaatcataatcaattcctcttgtcccctacccctttaaacttattccattggactgcagtaatcttcctgtgtcccaatgtggaaacacatagacactatccactgttacgtaaggtgccctacatgtgcattaaatctcaagcacggtctccttcagtagtaagaaggcctaatcccatgtaattctcaaacctctgagcttgttgtggtatgagattttctcccctaccccagttaggacctacttcaggcttgagtcagctgtgagcagggggattccctcctgctgttaatctctccctgctcacccctgtctgtgcacttcctaccagcagggatgtgggaaagggagggaaggtggggagataggacaatccttacttggctgggtagctttgctctctctggtcctggtgatggctaaaaccagctctttttctcattgagtgctttgtaggctctacagagcctatgcagagcccttcgtctcctcattaccaatggccatttgggactccttcctcagctcctgcaaatcagttcctcatcttcagcctttttctgatgaggtcacctctcacccctacgggctactgtgttgtaccaacagcagctccatccttcatgtcccatgtttactcatcccccagctctggcccccaaactgcaagtgaaaaccagtgctggcagatcagcgcttccctggctcctccacacaaaggcactcagatctcctttcctgtgaaactttccaggacaggttagaccccagtccatggtacactttacctttctcaggcaggagtcaggcgccagccctctgggtatcccacatgcaaggaaggcatttcaaagcggtagaggtggcccttcctccatcaccaggcttatggtttggagataacacccctccctcagctctttcacaaacagaaacgtgcctggcagcagctctctccaagtgagtctcttcaccagcccttcttccctctccgaactctgaccactttttatatccttgatgcgctgaagggcccaagagtcttggaactggtttttaattcctttctttgaaaatccaaatatatggatctgtctcagatacacgtgggtacccattatccaccaccatgcttgtgcttccattgaagcagagaccagaggagccccattctaacatcctgttacataagtgaaaatggaatttctttggaatgccatttattgtcatggtgccaggagttcatcataatcaacattacaaaggaaataccaaaggaagcaataatgatttgccatttattgtaaaacatgacctaggtgtgtcttttttctctgtttataaaatgacaaggttcaaattataatgtaactttccacatagcaattgaaatcacagactgagaggttattacaggactaggttggaatgaatagattatccatatgatttgatttaccctaatatagtttcttttagttccaacatgaaatctcccccttttaactcaccctgaattacaaatgacttaacagaagcagaaatattttctctggaaaaacatagtaaagtgtaaatggaactctggatttttagccataacaagatttttacactgtatttcccccgatgtatctgccttaagattcttcagtcacttcatgttgactgtttagcctctgaaaactctaattagtttaacaagttagccagccaacgccacagcaagactatacacaaatagagaagatcaggtcagttttgctgaaaagaaggatcattaaaggtacagagcatgagatattgacccaacccttctgataaatgatacagaaactatttgctcatgaacgagtaaactatgcccccaccttgacactgaattttaatcactagaaatggaattatatcaaaattcaaacatagctgaaaaattttaagataacatgtttaaatatgcacatttcaagtaaaagaacattattatagtgataatatcagagccatttgcagagaacttttgagtcttatcaagaaagcaatacataggctgggtgtggtggctcacacctataatctcagcactttgagaggccgaggtgggtggattgcttgagcccaggaggtcgagacaggcctgggcaacatggcgaaaccccatctctacaaaaaatacaaaaattagccagatatggtagtgtgcctagctactacaggcacctgcctgtagtaccggctacccagggaagttgagcttgcagtgagctgtgatcacaccactgcactctagcctgggcaacagagtgaaaccgggtctcaaaaagaaagaaagagagagagaaaaaaaaagagaaagagagagagagagagcatgcaagcaagcagtatataaaccagtgaattttacctggcgcttttaaaaataatatttgagttcatatgaaattcaaatagcatcttacaaatttcaatgtatatttcctagaagtaattcaaggtaccctcaatatatgctgtcaggtagagtataaaggggtgtaatgatcaatgcagcaacttcatgacagacatgagctgaaatgggttgtagaatgttctttctgaagacccataattagatttctagcttgttgttcaataaaatagttcaggtaccctaagtgaagtacatgacctctcaaacaagaaaactgtctcattctgcaaggccagttgcttgcttttcacagtgacacccatcaccttactgaatcctttaagaatgaagttcttcttgtccagtaacactgcagctggaaacaaggcagacgctggaaagcactagaactgtgcacaatgttgacagtgtaatctgaaactactcagcagttcctagtatcaggttcacacataatttgaaccagacagatttcttttgaaactttctcttaaaagtttcatttaaattggaagacgaagagtatgagtatcaagaaattactcttagtaatccaaatgaattaaatgatcctaaaatgatttaagtgattcatagcactttcccaagcagtctctgtccccatagtaccggtttctgtatcaagctgtcaggagatcagagaagaagctcattaacccagtcagacatgtattcaaccaacatttgagttcctagtaagtgccaggtactgtcataagcaccaaacctattagttttgtggaaggcaggtctaaccctgtctttaggaagctttaacccttatatccatattcacagaaagctgacctaccagttgaatgcccactctggatatgggcaaatattttattctatttttaaagtgcatacatacacacaagtactctagcataactaagctgttggttatgatttatttgctttgaaaagcagagttgcctgcaataatagaggaagcactgtcagtggaaaagtaggaaaacacatctgcagtcaagagggaggcatttcagtgcctgttattatgccctggagccaagatgatgacagtgagacatgagcagccctatatcaacccagttctgttgggttctgtgctctgaggcctccctggatgcagtcaaggataagtcagtgaagcccaaatcaccaccaagaccccttcctttcccaaagttgctatagacagatacactacctaataagggctaataagcagacgaccaattttctttttttttctctctctctttttgaaacagggcctcactctatcgcccaggctagagtgcagtgccacaatcacagctcactgtagcctccacgttctagggttaaacgatcctcttacctcagcctcccaagtagctgggactacaggctactacagagaatggaccattgtgctcagctaatttttaaatttttttttggaaataggggtcttgctatattgacttggctgatcgtgaactcctggcctaaagtgatccacctgccttggcctcccaaagctctgggactacaggtctgcacctctgtgcccagccccagatgaccaactttcaaaaatccttttcaagttagaaaaaatatattcaaaacatattcatacgcttttttcttaacttatttttcttaatcttcattcatgcatataactcacagattattcaaacttctcttattatttttctaaccctttaaagaggatttccaaagcttagctttacttgaagtagagtggttcccatccattgatattcgggggaagtagttcatctgaaatgaggccagtattgagacttcaacatatataaacttaattatttcaggaggaatgtccgtgggaaaaaaaagagctaccgtgacttttccctccactaatcaacagatatttccatatgataataatatttaaattacatgtatttgctcagcactttacactttacaaggcacttttacagacattgcctaaatatttattctcataacagctggattattatctacaggtgatgaacttaaaactcagagaagtggaaagattggctcaaaggtcacaaggataaaaaaaaaaaaggaatgcagacaccgtacttctaattctaagcctcttttcactctatcaaattaccttccagtatgtgccatgagtcataggaagaacatcatttctacagtcaccgaatatctgttctgtgccttttatatttctggcactgtactaggtgatttacatatattatttctaaacctaccagtgtttaaagtagcaaacaaaggcacagaggaggtaagtacagcctgagattcattcattcatccatcattaaagaagttcaggagtaagtctgtgttctaagcactggagatatcgctatgaacaagacagattaggtttctgccttcaagtttatgtgctggcaagaggaaaaagatagcaaatacataaacaaataagtaagtaatgtaattttaaatggtgttaagttcttgaaaaagataaagatgcaggctggaaagtaaccaggactacaggattactttaggtggtgtggtcaggggagatctccctgagaaagaaatagttcagctgagaggaaagtgttgctggaaaagaaaaccagtagagaaaggcactgaaatgggaatgagacaggcatgtttgaagagagggaaggaggccagtgtggctgaacatggagggtccaggaggtgaccctgaaaagaatggagccgtgtggggactctaggccgtggaaaggaggttggccctcattctaattgcaatgggaagccattagatgattctaagagagaagagtgatctaagttttgttttcagaagatgcctgcagctccatcgtttgtgtagagaatggactatatagaagggtatgtgaaaggcaagagatgagtgaatccaaacggaaaatagaagtggagatggtgaaaagaagttggatttgcggtatatttttagagagagagctggaagaacttcctggaagattgtttgtggggagtggcggacagaagaataaataatgatttggggcctgagcaagtgagtggatagtggatctgttagctgaaatgggaacaactggtgggtgggcaggtttcacaggcaggtggttgagaagacagttggtgtcaagcttctgttttagacatgttaagttggagatacctattaggcatctgactagtgatctcagagcagttgtacgtaagaatctggagctcgggggaaagggatcagaagtggcttacataaggcagttaaaggcatgtcttttctgctaggaaatgagacttaggcagagccttgaggttctctatcatttaaagacacatagaccataaccagaaacatcatgctgtcagtcagatatctttctattacatcactccatctccatgattaaagtcaaatctcagtaaaactgagcacatcaagaaaccccaaaaatattacatataaaactatttgccaattttcctcttcagccttttcttttgttagtaattttaatttgtcttttaaatgaatgtagattttcaagtgtgacattttagcaaggtcaaactgttcattatcagttaaagtcatatgaaaaagtggtaatgttccctatttatatatataatgcattataaaaaacttttgcttgatgtgatgtgagttacaagctaagattttccaagaacaggtagttctccattatataaatctctttctcaaggcattgattgtctgtctgtgttctactaatgaccaagaattgtgaagcaactctagttctgtggaagaaaaacatttttaataaaaacttattcatatgaatttatggggtacaagtgtaattttgtgacatgcatagattttgtagtgtttaagtcagagcttttagggtatccatcactcagataatacacctcgtacccattaagtagtctgccttcatcacccttctcccagccttcacccttcccagtctccattgtctgtccacatggaagaaaatctctctgggcttcattaggatgagaagatgagagttttattctgagcctagctgtcctttactatgacattatcatagttcatagtatccaaatgtgactcacagggaattcactcaacagttactgagatacctgaattaacatttctaggtcttttgttcaaatgttaataaagccagtgcttcttagaggcgaggtgaggttagataaggtcacgtagactccaacataaccagtgtctcaagtgaggtgacctattctccttcaacctaccatgacgttagcatttcatctcttcacaattttttctataaacatataactgcatattacatttatttctttgtctacttagcaaggatctgttcagtgtctatgacataacactgttaggcacagatagaaatacaaatgaaatgcattgctcttcaaggtcttactagaaaagatgaaataatctaaaattgtggatagactaaacaagatgttttctatatatggtcgaggagggattatataatgcctattaaaattcttgactgagactaatgacagaaatccatggaggatttaaacatttgggggctaaacctatggtaataaaataacagcctatataaattacatgtactattatatatgcacaaaatgaatttctctgggatctcaaggacattaatgtaattattcatttcaagtttatatatttatgtttttagagaaaatcactatagattaagtcataggtctctacattgatcaaaagcagatccaccctcatatttgctcccataaggggaccacatactttcttaaatttaacattatattacccttaagaaaacttggctgggtgcagtggctcatgcccgtaatcccagcactttgggaggccaaggcaggcaggttgcttgagcctaggagaccagcctgagcaacatggtgaaaccccatctctaccaaaaaaaaaaaaaaaaaaaattcgctgggcatggtggcacatgcctgtagtcccagctactcaggaggctgaggcagcagatggattgaacccaggaggtcaaggcagcagtgatcctgggaggaaaatgagaccctatctcaaacaatagaaggaaaagaagctttagtctttcacttttttttttctgaccaatgccaccaacaaaagcaactattcctgttcaaacttacattcattaaacaaatattcattgaatgtttattataggctagatgtttcagtagcctctggggatacaaggggatatttagagaccattccatgctctcggcacaagtaattacacatgtgatgagtgcagcacagagctgggggagatgcaacacctctgcaggaggcttagagataagtcaggaaggaaggtgttccagaccaagaaaaccaaacctggaggtaagaaagaacacggtgcattcattcagctaaaacctatccagcttgacttaagccagaggagctccagagagaggcacatgaggagactggggaggtcaggtggccaggtctaatgtcatctggaggtcaagggaaagccaggaggtcctccagcaggaaaacacaggtgcagatttacactccgagaagaccactcctagaagctcaattctgcttcatggtattactagtttattagtgaataatatactttacattgtcaccatcaccccacttcatgaaaaagaagagctcataaaaaagaatctgtattgaattgaaaggtaaagctgtcataattgaaaagctgattccttgtcatatttttttaatgctccatgaaattttatagccttgagaaaattttgacttctaaatctagccaaataatgctagtggctgttgcagaattagtgtgttttgtgttatataatggtgtggatttttttttcttccttaaaatactcttagaacttttgacctgtcctgtgactgaattctggatactattggttataatagtgcaaaacaggtcagagataacataggataaataatatagtctcttagcacttagccaatctctttggccatcatcccacagaaaatattcttcaggagtgctaaggtatcagttattagaaagtaatctatttttagaaacaccaaactcagcttaccttcttttctagatttagaccttgttttaaagaatacaattctttcagtttttcacagggagacatttatctatactaatcaattccactaatttatttatttatttttaattttgagacagagtctcacagtatcacccaggctggaatgcaatggtcgatcacagctcactacaaccttgatctcccagggtcaatcaatcctcctacctcagcctcctaagtagctggagctacaggcatgagccaccaagcccggctaattttttatatttttgtcgagacggggtctccctatgctgcccaggctggtctcaaactcctagtcctatgagttcctcctaccccagcctctgaaaatgctgggattacagggataagccaccatgctcagctatctccacatatttatgtcatggaaattgtactgattcttgagtccatgaagagtccatgaagatacaaacatgttctgttcaataaacatattgttgttagcatgcttctttctacagtggcgtgaggattaccatctcattattttcctatactcttagttttaaccagctattaaaataaagtgctaagcagaagaaatctgcatattaatataaacattgggctcatttatttgtgtgtttttcatgaacacatgatgaggtgtttctggatagtgtggattggtcaggcccaacagagatcagcaaatgcagtgaagccagagatacaccagattgttctttcaaaacttcctcaggaaacatgttgtcttaattgaggaggcaacacagaaaaacaactggaaccacattctgcagcactttttctagctatgagcatttattaccttacttgaacagtgagttgtctctgtagctccattttgtaagtagccaaattttagtagcatcatgtggttctcacatgtttgagttaaaaaattatttttataaaaacaaaaatagacaaataagatttagtttaactaaaaagcttctgcacagcaaaagaagcagtcaacagagtaaacagacaacctacagaatgggagaaaatattagcagactaggcatctgacaaacgactaataattggaatctacaagaaactcaaacaactcaataagaaataaacaactctatgaagaagtagacaaaggaatcaacagacatttttcaacagaagacacacaaatggccaaaaaacatatgaaaaaatgctcaacattactaatcatcagagaaatataaattaaaaccacaaagcaaatggaaagcaaaattgtggaatcaacctaagtgtccaatgtccatcaatggttgattggataaagaaaatgtggtgtgtgtgtgtgtgtgtgtgtgtgtatgtagatatatatattatacattatatataatatatataatatacacacatgtacaccatggaatactactcagccataaaaaagaatgaaactggaggccattatcctaagtgaaatgactcagaaacacaaagtcaaatgctacatgttctcacttataagtgggagctaaacaatctgtacacatggacatagtgaatggaataatatacaatggagactccaaaaggtgggaggatgggaggggggatgaaaaattacctatcgggtacaatgtacgctatttgggtgatgggtatactaaaagccaagactgtaccactacataatatgtccatataataaaactacatttgtatcccctaaatctataaagttttttaaaaaagaagtgattttaaaaaatcaaacttttccattggattatctattgagattcttttcaattatctacaaatatttttcattttagtttttaaaaatactctaaataaaagctgaaatttcttactattctaggccagagtttaaagcaacatgggcccttttggttttatgaatatattagtttattagtttttatttctattagtaaccaataaatatatagcaaaaaaatcattaggctttatcgacctagtgataaagagaaaattagaggtacatagataatttccatcataattgatcatttttagaaattctatagcagaacactgaaaagcatcctacttgttaagcaatttattccatttttctcatggtattgggtacactaaaaattggtcattaaaggcatattgaatattcttgttttcatgtacctctgttcattatatgaagttcaattcaggatttgaagtctttccttcacacaatcccacaaaaatgcatatggtgagtataaattgaaaaaaatagggtatttctctaaatgcaaaaagaaaaacatctgtctttaaatttttttaaaccctgcctaaattgacatgtgctttacattagtcctgtattattcaaactttcatacttatgtgtgcattatgtatgctcacacacactttagtgatggggtttgtgtatgtataaggtacctgcaaatccaaactacttcatttgaaatttgggaaatttttcctaaaataacttccacaaatatatgtgtgtatgtaggtatatatgtatattttatatgtaaatatttatatatgcatattatatataatatatgtattctacaaatgtattatatatctataaaatagtaccatggaatgctttaaatatattgtaattggttttcagagttggggtgtgtgagttgttctatattttaaggatagtgtcctttttaggaaaacatttaagtgtgatcttttagatagatgtgccttcctgaagaaggaaagactaatttaaaaaaaagaaagaaaggaaagaaattatctcctggtctggtttactttttgcaacagctgttaaaattcggacagtgacagagaaatatctgtagcagctctacagatgtttacaaaagaaaaatatctcctttacctgccttggtgagcatcttatcagcaagcacattaactcaaacaatagctactcttatctgcagaggacaggttcaggctcattagtgaagtgaactggcagccactcccctctacatagcaactggagcaaatattgttccagcccgccaagtgaccaatgagaactgagatagtgccgtggaatcttttcaatacgagtagtgttagtgtgaacaacctctctttgactctcattcgccttctcatttaatcctaccatttcaagagaatgatctcatctacagactgtaaatacttggggacttttatgaagggaaaatattacaaagggctgaagtttgcttcaagaacaacttaggtaggcacttcagtttaattactagcaacttgcatatgttgtggtatttcaaaagggctgtagtgttagtacactcattatggaaatttctaaatgtcagtgtatgaatcagtaacggtgatgatttttattattctaaaaagatctctaagataactaaaattaagcaggctgcacgttctctaatcatgtaatgaatgaatcaggattcttgtctgagatgcaggccaaatgtgctctggaactggttagtgcggcatatggtgaatctacatcagacttgacccccgcaggtttgtaactgaaactttgtataaattgaccacacccttcattaactcttctgctgcctagaaaataataaaaattgtgaagtgggactgatggcttttgaaaaatacaatcaggggcttgtgtctctttgcaattctagaagaaacgtcacaggattttaattcctgccaagcaatattgaccacgtttcctgtctcttcccttcttgtgctttttgccttgctttatgatgctggcaagtatggaagcctttatctaccgtgtaaatgtatatcgttgtaattcaacagggaaccgggcttcaaattacagcctccgaatgcaataaccttggttatttaccgagtacaaagtaaacaacttactttactgtcaaaagttttactgcaatatgttgcggggcttactactagaacaaccattcaataattgtctgtctatttaacgggcggattttatttcaaaccaaatagatactgtctttgtaaatgctgaaatgtttggtttttgtttttagcccagaagaaaattcccataaatacaaacccattctggccacctaagaattttgtcctagaagtggcatgctttctttcccttacgggttttaaaacttggccacatggtatttttaagttggcaaagtaataccttttagacacgccttcaggattttgcttaattgagtacagcaggttaacaaaagtgccaatgttcctttaaaacaaaaaccaaaatgctctgtggacttaaagctaatgctaaatattagattaaattgccaattgcacttttccatgtttatcttctgagataggaataaaattaaaatgtgttaccatagaagcatctgtaacattttatgagacaaaagatccttttttccacacaaagatccaagccaaaagcattatccattaaggaaagcaataaggctagagggacatttttttatagtcatattatggaaatactaaagatccaatgtcctgaagtcaaattgggaaacacagctgttcacattcatttttgtcctggattgacactcttggttaattcctgaatattgatcagttcttatcctccaacatccctaaaactggaaaagttttctcctatccacatttattctcaaatcacattttagggaataacaaagaggtgaatataaatctatgccttgtgaagcatttatttaggctctatgcctgacttggttttgtaatcttgatttttattctctggagcttatttctttggctctcttctttgaaaataatggcagggttctcatctaaagaaaaaacatagagagcttttaaaaccttgcagtccatgaattttctttgcatttcatcctaaccaccgttgccttctttaccattcagttctcctttctcccagaagctttccagagtttcttccctcttttccttctgcttcatttattctgcaccacatgctctaaaacttaccagttcattcatctatttactctatgtgtgattctgtgaactgtaagtagaagattctagctggatccattttaaaactaagataacttttttcccctaaacgtaagcactatgtccaagttatcaatcaaatttatctgctttgatagttgactcattacatacctgaaactggaaaagttttcttccattcacaattcttaggttagcttaatatttacgtaacttatcaaccattcaattagaagtttttaagtatatctaaggaaaaaattttaattgcaatccctgacttcatttaaattccagttgactcccaaaatgtgttacttttcacagatcgagaatttgtaaaactatagaagtcaagccactcagttctctgtattctccttgtctgttgacaatttttagcattctttagaaatctggttttatcggcagaatgcaagattcttgaaggtaaatttcatgctatgaacatcagccttccacaactgcttattgagtagactactaagccaaagaatcttaaagctttctctgtagattttaaacctgaagagaagttaatgttctgaataattctattgcctcgagactactgtagatgactgagttacagcatttttgtttataagaattatcagtgccaggcctgactgagttacagcattttttatcagtgccaggccgggcatggtggttcacacctgtaatcccagcactttgggaggccgaggcggatgaatctattgtagtatggtggctggtcaataggcttggcccttgtaatacctgaagcactagaagcttaaagcctgagaagaaaggccttgcttagtaagaaatcgacttcctgtccctcctgatacagtactcagtgcagtggacacagctttttcttcttggcagtgaaacctccctctgcacttgtcaccttaagcactgcctcatcaccaccattatagccgtcagtttgtggtatcatttttcagcactcagtgtggtccaggtactctataaatataccacatccatgatctgatttaatcttcacaataatcccatgatatagatatatttgccagatacggaaactaaggctcaaacagaacagttatccaaaatggttatgtaggaaaactggggtacaaactcaggtcattctccctccaagggccaagattctaactgctttttcacagcggtagaaaaatattaaggggaacctccaccttttgatttgctctgggttagtaaaccctttcactaggtgtggacgtttaataggcctctcaaactcaacgtgtccaaaccgaacacttgatttgatatcccccttcccaatctgttcctcatatagtctcagaaaatggcaccaccatctagccacttgcttaaagccaaagcctgagagtcatactctgttccttcacagcttacttcatcagcaggtcccattggcaaaacctccaaatctgaacacgcttcttgccacccacactgctcagccctggtccaagccatccttccacggacatcagcagctacctcctaaatagtataccttcttttgtgctccatataatggtcagagtgttctttttaaattgtaaatctgatccagacatcagcctgccaacaacccaccagcacaggtggttgtcagcaggctgatgtctggagcagatttttttttttattaatttagaacaaaatcttctgttcttaatataatctacaagtaaggcccagccagcatgttctagagtctgtccacctctccaccctcatctaccactcttctccccaactcacgcctacagctgtgttctgagtaagctttctttccatttctcaagatttccaagcacaggaagtctcagggcctgtgcatttccagttccttctgcctggagtgctctttttcctagatcttctcatgatgacaggtctcagctcaaaagtcaccatctcaggaagccctgctctgaacactcccgccaaaggatccctcccctaccccatttctttctaccccattgcctttttttttgttaattgtgtagcatttaccactctctgcagtcatttgtttatttacctgcttatgtgttgaactatctctctcctttcactaggtctttagttccttatcagctgagtttgtctgtctttcccaattctatacccccagtgtccaaaacaccttgacatatggtttgaatgaatgagtgaatgaatggctaagaagattgatggtcatgtaaggaaacatatcccaaatacccttctggtttttattggtgggggacaataaatcagtaactacaatttagagagatgattgctatgactgaaaggtatgaagagttctaaaagaacgtgggaagttgggaaggaaccatctcaggctgagagggttagaaaaggatccctggagaaaatcatgcttctaggaggccctctttcctatggtctgttcataaagcataaaggtacccttcccaattatacgaagctgcataccattattggtgtggaaaaacagtaaccctggtattgtatttctaaatgcttgagactactaacataatcttgatcactatgttcatttatccttggaatacaaccttttacgtttgaatcttaattaaagagaaaacaacttctgggaagcagcttttttttttttgcaaggtttatcctcagcttgccaggatagctacatttttggatgatctgtgccacgtcttgctttcagactcttattggtattgtcgtggtgcttaattaagcataatactagcataaacagtatagtcatggaatgctggagataataaaaagggcatgttgagaagcatcagacacttattgcatagttaaaaacatgactttcagaaacctcccaaagtcagagaatgtttagaaacttattttggatatcctgagtcacttcttactttcagtgggtacaatgggatcaatcactgattataaattattgtgctttacaagatgcttaccacaaaaaacccccaaagaaacaaaaaattaagaaagaaagaaagaaaatgctcacacagatgtcccttctagcttttgccactatttagcctcttggttaaaatgttccagtagcttcttacttgtcttcttttcttgttattctcatcttcaaaccactgtcaggccagttataataaatgatcattttatgcctccattatgcaaggcagcatattgcagtgaaattatttatttgttatgtctgtctccctaatagactgtatgttccttgaggaaaataactgctattctatctttgaatttttagtatccaatatcgtctaacctgtggtagatgctcaataacaagtttggggaatgaatcattccccaaagccttcattttattgtctctcccatttataagagtggagaaaagaaatatcaagtaccaactcttttgccctgaatgagttggaagttggcagcacttcaaagtagaacttattagctactatagagaactcataatatgatggctttgtcacagaggctctaaagagtcagaaaaacaaaacaaaagctagagtaagagattaaagctagaagagattcctgaggcttagaatgtatttatcactctctgactcacttaaaaatgagagatcaacattcaccagcatattatgtcctgtcttttcccaattgttctatctgctattattttaatatccgggattaaaagcttagttagcctttgagatgctagttaatgcttcttaatcaccatgactgcaaatcaggtgtctgccaccagctgaatccctttgccttgcatgaatctgattcgctacagcaatagttctctcactttagtatgcatcagaatcacctggagggcttataaaaccgtagataacttgagctccaccccacttggattagtccgttttcacactgctataaagaaatacctgagacttggtaatttataaaggaaagaggtttaattgactcacagttctgcatggctgggaggactcaggaaacttacaatcatggtggaggggaagcaggcacatcttacatggcagcaggtgagagagtgtatgtaggaggatctgtcaaacacttataaaaccatcagatctcatgagaactcagtatcacgagaacagcatgggggaaaccgcccccatgatccaatcatctccctccctcaacatgtggggattataatttgagatgagatttgggtggggacacagagccaaaccatatcaccactctaaccccagattttttattggtgaggtctgacttggggatgaagaattggcatttctaacaagtctctcggagctgccgttgctggtcttgaaaccacaactttcagaactcctggtctacaatgcttctctcagtttcatgcacctatgaatcacctggaaatcttgtgaaaatgcaaattctactttagtacatctgagctggggcttgagattctgcattctaagaagtttccaagttatgccactgctattggcctggggaccactgttgaaaagttctctcctctggctgcatgttagaatcatccaaaatcttaaaatatcttgctgcccagaccctgccacaaaattccgtttcaattaaccttcagggaagtaggggcagaaatctatatttttaatgaggagctccaggtatttctattacaggtaatccatagtccacaattggaggaaaactggtctagaaaggataaaatcatctatggaattttcatataaatataattgtctaaaacatatgtgagttattaaagaatatattttttaaagtatcattgcatttaattgttcctaagatgcactttttaatatttcaatatctctaaaattggaacacttcataatctgtggtgcttacaattatttaatataattggcagcattttctttttttttctttttttattattatactttgagttttagggaacatgtgcacaacgtgcagtttagttacatatgtacatgtgccatgttggtgtgctgcacccagtaactcgtcatttaacattaggtatatctccaaatgctatccgtcccccctcccccaaccccacaacaggccctggtgtgtgatgttcccctccctgtgtccatgtgttctcattgttcaattcctacctatgagtgagaacatgcggtgttgtggttttttgtccttgcgatagtttgctgagaatgatggtttccagcttcatccatgtccctacaaaggacatgaactcatcatttttatggctgcatagtattccatggtgtatatgtgccacattttcttaatccagtctatcattgttggacatttgggttggttccaagtctttgctattgtgaatagtgccgcaataaacatacgtgtgcatgtgtctttatagagcatgatttataatcctttgggtatatacccagtaatgggattgctgggtcaaatggtatttctagttctagatccctgaggaattgccacactgacttccacaatggttgaactagtttacagtcctaccaacagtgtaaaagcaaaaccacaatgagataccatctcacaccagttagaatggcgatcattaaaaagtcaggaaaaaacaggtgctggagaggatgtggagaaattggcagcattttctttctctgtgatacataaaatgattagtagtgataaatgaaaaacttcaaccgaattaaatttaaaagagtttaattgagcaatgaacaattcatgaatccggcaggctcgaagactccagcacagccataaggtggaagaagatttatgaacagaaaaaggaaaatgatgtacagaaaatggaagtgaggtacagaaacagctgaattggtaacacgttgatgtttgccttatttgaacacagtttgaatgctcagcagtgtatgagtggttgaagtatgactacaggaattggccaagactcagctattgttatagacacatacacctaagttaggcttttcagtcttttctaccgactaagttaggttatggtttgcccacaaggactcaaatatggaaatatagagtccttctcaggccatatttagtttgctttaacagtagataaactatgagtattcttatttctattaaatacagtatatcaatttttaaagatctgaaaaaaatgcatgacattcacaggattgtaacatttgttagcacccatttaattcaggtttttcttacataggaaggatttaaaatatatcaaaagtatttgcaatttttattctctaagagattgtttgttatgctggggcaggagtcaagagtagagaggcaatttggaaactgaaagaaaggctaaattgaccattactcaaaagaggccaccagttccagggactcttggaggacccaagagtagagaggcaatttggaaactgaaagaaaggctaaattgaccattacgcaaaagaggccaccagttccagggacttttggaggaccttggccaaagaaagaagaaggggaatgaaaggacaaacccagcatgcagcaatgggcagcagaagaggaaaagaaaacagctgaacagctgcctggaaagtggaacttcgataagagaggacacatgaatgggggcggggcggggggaacgttgtgaatctctcatcacttcctggagaaaatgttacaaagacccatactacttttcaatgttctttcaatttaatgtgtgcttcctttggatgcaggatatactgaggcaaagtagcctagaatattcacaaacaacttgttaatttgaaatctgataataaataacattggtttgttctacattatcttctagggtcagcaatttccctggacatacaccttccattaagttaggatttaaaaaacatctaattgtgaatcaaatagcccttacaaaagcatttccaaaatttgtgtttgatatggttcagctgggtccccacctaacgctcatcttgaattgtagtttccataatcttcacgtgtcataggagggacccagtgggaggtaatttaatcatgggggtggttaacctcatgctgtccttgtgatagtgagtgagttcttacaagatctgatggttttataaggggcttttccccccttttgcgcggtactgctccttgctgctgccatgtgaagaaggacatgtttgcttccccttctgccataattgtaagtttcctgaggcttccccagctgtgctgaatgtgagtcaactaaacctctttcctttataaattactcagtcttgggtatgtctttattagcagcatgagaacagactgatacagtgttctaaacaataagactgtggaaaatgttttacatgtgaagaaaaaaacacagaggagttagataatagattgatagaatagacagatgatagatgattgatagatatcataggtagataaatatgttggtaggtaatatgatagatcaatggatagatagatagtcccagtgcttaaaaaaaaacctatagtaaagaaagttatttgtgtttttaaacctattacttcccaaactcatttaaaaagagaacactgtttgaggctcacccattaacatttggtaaacactattctgtaaaattccagtttgtgtgctctgtatgtgtcaatttctagttttaaccaactcctagtagatttctattttcaagtagggaaagagttttcacaggaaaagaagagcatttggagatcaaagaaagggataaaggagactatctgaaaataagcttcagctctgtaattttgactaaggcagtccttgctttcaatccctagaaagtcctagtaaatctcccacagtggggaggtcaaggtagttcaccacaatggctaatagtgccatgtaaagtgcagctatttgaaagttggttaatctccctaaacgtcatttcgtaccttcatgtaattcgggtaagaatgatgtctcctccagagggacattggggatattaaatggaatgtcatattgaagcatgccataactaatcaatgactgtcagttgtcattattaacaaatgcatccaattgctaaattttaatctctaaatgtttgagaaattgatttggaaaaacataggaatactcaaacattgcagcaattttttttagctatgcaatacagcgcacaaatatgtataaatcaacatatatctagttaggtaaacaagcatataatatcgggtagttaaagacggaaaaggtctaggtcaatgttcttaaaataaatatttaaaggaaaattaacaaattaaaaaatatgagaatcatgtttatgcccctattgtgaagatgactcttcggtagcttaacggggcattgttttttattacataaaaattattttaaaataagttcttatctgacatgtaagacataatttttttctggaattttattttattttgacagataaaaattatatataaagtatacaatgtgatgttttgatatacatatatgttgtaaaatgattactgcaatcaagctaattaacatattctcagctcacatagttacagcttgtgtgtgtggtgagaatacttcaggtctactctcagtaaactttaaatatagaacacagtgttattaattataatcaccatattgtccattaaacctccaaaatttattcgtcctgaaactttgtaccgtttgaccaatagctcctcatttcctccaccatccaaaccctggcaaccaccattctaccttctgttttatgagtttgacttttttggattccacgtgtgtcagatcgtgccatgtttgtctttctgtgcctggcttatttcacttaagatgatgtcctccagcctcatcaatgttgtcacaaattgcaggatttccttctttttaaagactgaatattatttcactgtggtgtgtgtgtgtgtgtgtgtgtgtgtgtgtatcacattttctttatccatgcatccatcaacagatgggcaaaggacatgaacagacaactttcaaaagaagacatacatgtggccaccaagcatatgaaaaaaatgctcaatatcactaaccattagagtaatgcaaatcaaaaccacagtgagataccgtctcacaccagtcagaatggctactataacagacaaaaaataacaggtgctggtgaagttgtggagaaaaggaaatgcttatacactgctggtgagagtataaattacttcaaccattgtggaaagcagtatggaaattcctcaaagaactaactacagaactatcatttgacccaacaatcacattaccgggtatatagccaaaggaatataaatcattctactataaagacatatgtatgcatatgtttactgcagcactattcacaacagcaaaaacatggaatcaacctaaatgcccatcagtggtagactggataaagaaaatgtggcacatatacatcatggaatactatgcagccaaaaaaaacgagatcaagtcctttgcaggaacatggatggtgctagaggccattatccttagctaactaacacaggaacagaaagccaaatactgcatgttctcacttataattagcagccaaaaaatgagaacatgtggacaggaggaggaaaacaatggaaactggggcctactggagggaagaaggttggaggtgggagaggttcaggaaaaaaaaaaaactgtcagatactatgatttgtacccatgtgacaaaataatctgtataccaaaccactgagtcacaagtttacctatattacaaacctgaacatgtacccctgcacctaaaataaaagttacaatattaaaaaaaaatacccagatccttaggttgtttccaaatcttggctgttgtagataacactaccatgaacgtgggagtgcagatgtctcttcaggatactgatttcatttcctttgtgtatatacctggaagcaggattgtgctggattttatgctagttctatttttttttttgagcaaccttcatactgttttccataatggctgcaccagtttccattcccaccaacagtgtacaagggtttgcttttcttcacgcccttgccaacgcttaatcttttgtctttttgatagtagccattctaacaggtgtgaggtcatatttcattgctgttttgatttgcatttctctgattagtgatatcaagtgctttttcatgtatttgttggccatttgttttctttgaagaaatgtctgttcaagtcctttgcccatttctaagtagggttatttggggatattgttactgagttactcagtaaactcaactgaattaagtttcttatatatacggatattaactccttaccagatttatggtttgctaatattttatcccatttcttaggttgtctctttactctgttgactatttcctttgctttgcagaaggttttagtctgatgcaatcccatttaactatttttacttttgttgcctatgttttttaggtcatatcaaaaaatcattgcctaaccaatgtcaaggtttttttttatgttgtcttctagtagttttacagtttcatgtcttacatttaaatcttgaattcacttttagttgaccttgtatgtggagtgaggtaagggtctactttccttcttctgcatataaatatccagtttttctagtgccatttattgaagaaactgtcctttccccattatgtaatttgggcacccttgttgaagaccaactgtccatatatgtatgggtttatttctgggttctctactatgtttcattggtctatatgtctgtttttatgcaagtatcttactgctctcattactgttttatagttctcagtgtgtccagatttttcacctccttgattaaatgtcttcttaggtattttattgattttatgctattgtaaatgggattgttttcttaatttctttttcatatagttcattgttagtgtacagaaacacaactgacttttgtatgttgactttgtatcctgctactttactgaatttgtttatcagattttttgtggagtcgttagggctttctatataaaagatcagatcatctgtgaacagagactatttgacttctcccttttgtgatctgaatcccttttattcctttttcttgcctaattgctctggctaggacctcctgtactatgttgaatttctgatcttagaggaaaagctttcatttcttcgctgtttatgatgttagctatgggcttgtcatatatgcctttagtatattgaggaacatttctttgatacctatctcgttgagaattcttatgaaaggagttaattttgtcaaatgttctttctgcatctatggagatgatcagataatatttatccctcatcctgttaatgtggtatgtcacatttattgatttgcatatgttgaattattcttgcatcacagggagaaatctcacttgatcctgatgtatgatccttttaatatgctatgaatttggtttgctggtattttgttgtgggaaaatataatgttatatgcatagttgcctccaacctaagccagtgcctgataaatgaaaggctttgcactcttaattgaacaaattccttggttccagtactttactgttcattgaaagccaggaagtactgggacaaagaaattattagagttgataataaaagagtaaacagcatactcattattagcagcgtactttctcattttccctccctgataggactttaactctcttctatatatttcagccctaatgtacttatcatatagtctttaggaacaagagaaaagaccaagtagaatatgtacaaaactaaaataaatacagagacatttctttttgttttattaggaaaagttaggaggatgagaaacagtgaaatctaagatattgttcctacaatattttgctatgtgtatggtatggatgaataaagtgaaatatcctttataattatctaaaaagtatgtgaaagtgaatagatgatgctgaaactaaaaaattttattctagatcagtgcttctcaaacattaatgtgcatacgaatcacctgaggagttttccaagcacatttcgattcagcaggtctgggctggagactgagattccacaatcacaaagagctcccagggagtactgatactgctggtctgcatatcacacttggagtagaaaggttctagattacatagaccgtcatcttcatgcaccagacttatttcctagtctgggttcctctggaaatatttccagtgcaccaatcagtttgatggagttggataaagagggagactcaagatttacttcacttgaaaagaatatttattttccatttaaggctaatggactaatggactaaatattacacatctcagcccttgggatatctgtgataatatttttcttttcctaccaatgtgcttttactctatacttctgctctgctgggtggccaatgggaccttgtctgtttaccaagcctagttctcaggtctactttccttcgatatcttttctttcttccaaccttccaatccaaactgaggtggtggtattccccaccaccaagaaaggcatagtttccattttttctctaccagttctagtacatgcaattaaattttctgagcccaaaatttctcatctctgaaataaggagcatgaaactctgtgcgtgggtgcatatgaagctaatgaaatggcacataaagtgtctaacacaaagaaggaaccaaataaatatcagattctatccctatcccacttttattttgtcccattccaatgtggctttgcataattggaaatcattatgtatagacatcaggtaaaatctagcaccagcttatatagtactctaagaccatcaggttttttttttttttacctcgtcttcagttttaatttaaagcaattaaaattaatatattcagatttcaacaaagtgtaagcatccctctgctgaaccactgtatcattacagtgtgcgttaagaatgccaataggcatggaacagatgccagataaccaagatggtacttttactgggtctggcattaaacaaagaaatgtgttcataagtcatctttcttggatctcaaccaaaaattgttattttggattttgtcatctttccatttaaatttctacttaatccttcattagagtatgtgttaacaatcttaatttgtgtgattgccttcatgaaaagttggatatataaaataaatgtcacttttaaggcatctaaggaattgttttctatcttagtcaccaagtatgtcagacacattgcttacaatgtcttctatttcaatctgtggtttgtttctgccatccaaaaatgagtaaactttagtttcacccagccgtgtttctgaatatgaacattcaaatgtggaccatgtgtgatggaaaatcctgccatggctgagaatatggataaacttgagggggactgtttgatggaaagtcattatataatgtatattttctttcattcatttaacaaacatttattctaggccaatggtgagcaaaatattccctcaacaaagtacccatgcacacacacatgaagaaactacacatttatttggaatgtctagtagagttcccccctttcttggctattttacaccagttcccatataactggtttatataataatagttatttatgataaaaatttgactaattctaactgacaagaagatagatatgtttgttttggaaactatttctatttggtaatagattccaaatgtattgaatggtctctaaaagatgtaggaacacaggacatactgctcatgatgtacaacaaaaacaatagtttcaaaattttatgacatattgcagtttatcaagtggttttataaccattatcttgtttaattctcacaacatccttatgagtagtgtgtgtgtgtgaccatgagaatatatgagtgtgagtgtgtgtgtgtgtgtgtgtgtgtccgtgtaggagaggaaatgattaacccatttcatagatgaggtgtaacccatttcatagatgaggtgtaactaacaatgtagcttcaattatactggcaggtcacagaaaagagatttgcaaccagccttatgcctctcctcccacctctctctactgacccacatctttttatgaagtagggattgcagccatcccacagctcatcaatgctgtcatgtctatgcacgaaggcactcttagatagaagagaaaacagaggggggcctgggatccagtccccagcgcaggcactgagtgtgcccctggccccatcagtttaattctgagcgctcaggacagtatgaggagcagcctgtcgttttcggagacaccagctgagggagcctgtggacacaataccagttgaaaagctccccagcccagggtggaaccaagcagcccacgcctgctcttaggagccaagtttcccaaacaatgtcagagttagcttggggaatcttcttagtactcttaagaggccagagctgagatttccacacaatgacatattaaagtattggatccagggtcctttgcattggtagaatgtcaggaaaatagcattagctagataaacttctttccctcaaaccaaatacagtcgtattgtttactattataggtctattaaggttgctgtttaaatgttaccaatgtcctcatattttggtaattttgttcgagttggaaagaaatgtcttgagaaatttttatttagccagagtgtttgagcactttaagatatctttagtatactacatcgcttctccaggtcctcaagagacctaaaaaaaaaaaaaaaaaaaaaaaaaggctttctaagcagtgcctatcaagctactacttccggccccacaaaaaagaaaagctgagactcttcaccccttgattccagtattcccaaactcctggtaaaccattaggaattagatatgccccaaatttatgtagcaactcccttcttaagaatatagagaacgtttttttttacacaccttgttacacctcacaattgagcctcaacttgagattcccttgcccagcaaagtccagaattcaccactgtctacatgctggacccaattcgttttgctgtcgttgatcactaatttgggaattgtgggagggagaggaggagcgaatccctctctttactttagaactggtaaaactgagatagccagagatttctagaactgccaagctaaaacgtaagctgaatcattgtgcaagtatggattagaacccagtactgggtttgaactgtaaacccagtttctgatcatatggctgcccagtgctcctggtggcagagctgattgcttcctgggttcaaatgggtcatgctttccagggcactctggacatccatggaacaagcctaatttaaacattagaggtctttcaaacccttatataccaaatcatcatcagttcagtctctcaattctgcattaattcttttgtggaattaaaaaatattttctcctgaatttccttaaaaaaaaatcgaacgttccctcagggcaaggagacatagctaggggtaccatgcgataagagagtgagtaaaaaggaaaagtctagtatcctagacagtctctttgcagagctgcgcttctgctcagaagacatttgtcaatgcctagagacatttcggttgtcaccactgggagaggggtgtactagagagtagaagccagagaagctgctaaacatcccacagtgccctggacaccccccgacgacaaagaattctccagcccaaaatgcctgcagtgctgatgttgaagaatgcgggtgtgtagatataaacaacaatctgctaagctttcaaatgatagcagctagaaagatcttcaagagtctagggatttggaaaattctggcatcatgatagtcaatccccagtggagacattctttgaagaccacataggcaatcacttgaccaaatgccacctaaaaattgaaatatttttcacgttttgcttggtttgctagaacacaccaatatactttcacccttgaagaaagggaactgtttatgtcattcagtagcaggactccttggctaaagcagcagacagctcaccagatttcactggaaagactgcccaaaccagtctctgccagggactccaaagcgcagggaggcttcagtgctagggagagcggatgtgaaggcggttatgaaggacagctgtgccagcatctcccaacttttccgttttttctcaaacctcagcttgccttgtgcatggctaaggttatccctggccagctgcttttttccctattctacctctcccctgctgtagcaattccctaaccagtgctactaagactaaggatttcaccacctcctcccattttccaccatacagaaatccacaaaactgagttaagagaactctcctgccatccccaatagccaaaaaactgagtcaccacttggcctaacagcactcagatgattcattaaaatacagtggagcgctcttcaggggggtgcaggggagattcaagtgggaaggtaaggctgcaagcaggaggggaagtggacaggagatgagactgcgaggcgtgtcacaagaagggagtctcctggtgcctttctccagggctaaaccccttgaggcagaaactccgttgagtcattctgaagtcaaatctggtgctaactggcgctcttggatctgggtcagtctcgatggggcctgggaatgtctgcggagtgcccattcctctcagcagtttgtgagattgagagccactgctctgcttttcttctcccttgaccccattcccagtttcctaccaggatcactgtgagccctgggaggatggatttgtaaaaaattcctggagccaaacaccctgagctatgaaactggcccattattgtgagaattttcaaatgttgaagaaatgtggggttgggaaagagaggagcaccttaaagaagatttattcacctagtcaccctcagatggttgtctgcagattttgagagagaaatggaaatagtttcagatactttttattttttttttgagacagagtctcactctgtcacccaggctggagtgcagtggcgtgctcacctcacttcatcctccgcctcctgggttcaagcgattctcatgcctcagcctcctgagtacctgggattacaggtgcctgcagccacacccggctaacttttgtatttttatttttagtagagacgagattttgccatgttggccaggctggtctcaaactcctgacctcaagtgatctgcccgcctcagcctcccaaagtgctgggattacaggtgtgacctaccgtgcctggctgagtgtcagatactttttaagcatactctggttatcattcttctcagattacttcactaaattaaaatgttctaaatgtacaaagagcaaaatggtttgtttaaaaaaatagccgtgttcaatctctatcagaaacagcttcaagtaaaattattttcctccagccaatttcttctttcaagtattctcctctatgaaatactcaatttgcaactctagatgaaattactgagtcaatttgtggaaatttcatctgttccttgacagtgagtttttatgtttgggtcaaaatgaacttaaggccaggggtatctgtaaaacactaggtaataggacaacagtccctaaagtcaagcgggctattgtcaagcacaactgtactggttcgtcagagctggctcccttagcagggaaagtttgtgtcgtttctaaagtgctttaccatactgtaatttgtcattcttgattgtaatgtatggtaaattatgcttctagaaagttatcactctgatccacgtctgatctaatgagaacagctgcatccactgcaggccgggtgcttgtcagcttattccctcagggccagacaggtgtggtctaagctccaatttaggtaggagaccttcagggaaagtccaggtgcttcaagaagctccaagatgagatcagaaattggccccaatccctctgagtcagaattctgagtcatctttttttaaggccattttttgtccgtttcctcctgcgactatcagtgcctatactttaaagtgttctataaccgtgaaatctttcctgggataacccagtccactgtacccactcccaccaacccccaccaccaaaaactatagatctactgctgagtcaatttcttcacatttgaaagctcaagaagggggagaacaagttgaaatttctattcagagctgacactccatattaaagataggaaagaaaagtttggggagttgctaagcatgagaggcattgttgataaattatcttgagatccagatattagttgagcctcactcgcaactgaaagaatcaagcctaatggacttttctgcccagtgccagactggaaagatttaaactcttgaaggtctctaaggattcccaactgcttttcctctcatgatcctctctgctcctgttctgtatacctgcgtgctgcctcatttggccccatgtccacctaagtgtaaaacccagctcttcaccagtttttacaaggatgtccatttgcaccaaatgtcacatggtggaagaatttactgaagcctccaggattggcacacttaaaagttcttttctcaggttgactagaagtcttaaccactcaggctgggctcagtggctcacgcctgtaatcccagtactttgggaggccaaggcggggggatcacctgaggtcaggagtttgagaccagcctggccaacatggcgaaaccccgtctctactaagcatacaaagaaaaattagcttgccgtggtggcagtcgcctataatcccagctactcaggaggctgaggcaggagaatcacttgaacccaggaaatggaggttgcagttagccaagattgcgccattgcactccagcctgggcaacaagagcaaaactccgtctcaaaaaacagtcttaacaactacacaaaagtctcaatatccgcttatccccagtgcatatctaagtattttttccaacaaatagcattattcctcagaaaaattctgagaccagttagaaccaccctgttaaaatatcatcagaaattcacaaggaaaatgttggctttctgtataataatggcacaacaagaattcacttctacttgtatcatctattaaataatgaaatatttagtggcttttaagtagcagggcatatggttttgaattttgtttttccagttggagtaagaaacaattcttcatgattatcctaaagaaccaggaagaaaatgagcaagggactggctgggcttctaggagatgtccgtggcacacagtaggatcttggtaataactgacctactctataactaagcaaacctgctcttcagcacagggtagaacaccatggagtgaagaatgggataaaataggtgaagaagagtatgccgtctttactcagaaggggacctagaaagttttttttttttttttttttttttttttttttgagagggagtttcactcttgttgcccaggctagagtgcaatggtgcgatctcggctcactgcaacctcctccccccaggttcaagcaattctcctgcctcatcctcctgagtagctgggattacgggcctgtgccaccatacccagctaattttgcacttttagtagagacagagtttcgccatgttggccaagctggtcttgaactcctgacctcaggtgatccacctgcctcagcctcccaaagtgctgggattacaggcgtgagccaccacacctggctgaaagtatgtattttctatcatatcattctgtaagaccctcttagcttctctccaaaagatttactggaacggttcctcccactcaatggtgttagagagatgtcagtaatactatgagtctgcctgctgaggtgcacaacataggactctatagtcaggcgatgggttcaaatcccagtgggccagataccatttagctctaagtgggtccttatcctccctgagtctgtatttcctgtatttcccagtttacgaagaggagatcataatacatccctatgaaactgatgtgggcattaaagacgtaagtgcatagtataactcacacttagtaaaaagtagtcacaattttactaccatagatgctttctcatcaccggtaaaaacgacctttcatgaaagtctcacctccaaccctgcgtataatctcagaaactcactcaataacatcaactcaaagtttatgtatgactattctatttctatataatattgatgtatctttttaaactgtactttgagaaattccaaaatatgttatgatttttagtgtaaaattcctggcctgagatgtcattatatcttctttcctaaaagaataatttaattacatttccttttatgttaatgactgaatttattattattaatttggcccccaggaaatgttcaatgttatctgtggagaatgaaaaggaaataaaagacgaggctttggagcaataaaaatattatcctaaaaagtcacttgggtatttgagaaataacttccaaaatatggatgagtgaaataaaccagggaaatgctactcttcggctactcttagtactattatggattttttttttttttttgagatggagtcgcgctctgtcacccaggctgcagtgcaatggcacgatctcagctcactgcaccctccacctccgaggttcaagcgattctcctgcctcagcctcctgagtagctgggattacaggtgcgcaccaccacgcacctgtaagatttgatagatatggggttttagcagatagggggtttcaccatgttggtcaggctcgtgtcgaactccagacctcatgatccgcctgcctcagcctcccaaagtgctgggattccaggtgtgagccaccacgcccagcctattatggatttttatgagcttgaaggggtcatgaggaagagtcccaactatatcatagaacatgtctatgagaactcagttaacaggagaaaaacaacagtattgtcataaaaagatgagaaactttacttagaacctaaagtaccttggagtgtttttactttgagacctcaaaaactagttaagtcatgctaaaatgtgcctcaaaatacaattgttagaagatgcatgcaaaatagaataaaatgatctgttcctaaaattcaggaactccactgcatggagatcaccaagttgcagcaaaagatcaagttagatcttatttgacttgaccctaactcttcttctgttatggttatgccttacatatcatatctctcctatagatgtagtcatttgaaatattaaaaaaaaaaaagctcatcttcatctacaatgtgtatcttttctaacttagcctgcttgtctgtctagaagccaaggtagaaagactactgctattatactgtgtggggcaacaagccctacaggaccaaacttgaagaggaatctaggtcattgtcctgacagatctgagctttaaaattttgaagagacctacgtgtctagaaccatcccaaatagtcacatgaattaaggctttgctcctgagatttatagtggaataaaatgcaatgtcatttgcctcttcctttaaaaaaaaaaaagtcaactatgcaaaaattactataagagacttcataaagtataacacacagtgaaattactggttccctaataatcttctatataaattttattttataggctctgctggattgttaaaaatcatgatgatattcttttaaatgtttatggttaatttcatctctttcatcagattttccctctccattcttctaaactctcatctctcctactaagcttttttccaacacagctaaagtttcttggattctttcgaatatcatgggctccagcttctctctgctggatctgttctgattaaggggaggaagagagacctctcagctctaccttttctgctcagcatatatcttgttagccaagaaaagtactttgtttagtaaagacactaccagtcaccaggcaaaaaaaaaagaaaaaaaggaagacgagtccaatcaaaagttcagctttgaaattcagaccaaaagcacatgctctcttctacgtgcaacctcaggctttcccacccacctgtcttggcaagttatcatctagcccagaaactggaggaagatgccaaaaagcaagaggattccagtcaaattggtcatccacagataatcaaaatgcaaatatacatctccactccaacaaatacaggaagtccccaattttaaaacgtagtgaattacagtgtacttgacggtcagatgtttagaaccaatttggaacacttagtgttacaaagcaggcccaccaaaaatcccatgtaagtcccaacaacttggttatgttgggtgttctatgtacatctgtgtttaaaatgaaaaaatagaaaaaataccattgcaattctaatgattaaaaatttttaaagacataaagtgattttgtattgtttttccaaagtgctctgctatggaaagatgtttagctagatgagtttattggaggcttatagaaaaaggaccatctgggtagtttcacagccttggatgttaatggcctcttggttttcggtgtagcattattaactcttgtatttgtcagtcaccattaggaaaattcttgaaataacaaataagaagtagaggttatatataaaggagtggcttgtttatttttaaagaactggacaaactttttaaaagaggaaaaaaatcaaaatgaaatagagagggaaggtaaggagatggttaacgatagtgtaagtagaagtgaaaaggactttgactaagatggaatttgatgatcagttattagtcaaaggctgaataaatagacgtggatacaagcaaggcatgtgaaagcttagaataagctttaccttagtcgcaaggtgataccatcattcctgacagtttagttcctagacagagacagcaggatgatgtttatgaagtagccttaaaaaaaacagacgcgtgaggggaggtagtatcccactaatacttaacaaatcaaatgtttgtaacacagagaatgaatgtcttttcagaaccttgtatagagcttaatgaaaccggtatagtgaaagagcatcatttgtagtcagaccaaagaggacttgaattcttgttcatgtgatattgggtcaaatgatctaacctctctggtgcccaattgggatatattacaaatgagcattcagtaagtcatctcaaagatattatatacagatggtgtcaactacacattcaataactgacagttattaggctcctgaagtctgccagtaatgccttacaggttgtgtcagtgatatccttgtagtgtttgatcctgtaacaaattcagtagctattttacacccatagtatattaaagataataatagatcaagaacaaggttaacataactaactctatgtggaattgtcagagttgctatggaaactttgctaggcttatgactttcaaaaaacagtctcaattaacagaatcttcttacagagtaatctatttcatgtaaatgaattatctgttttgcagctcaaggtcaaatgcatttgaaccagtcattttgggatttgttttcccaaaggaatgataaatgactaatccaaaagactatggattagagaaattgactagatgtcattaaagaccccaaataaatgtttgctgtccttgacctccatgaggataagttgtggtggggcctgtggttatccgctgtcttttattgaatcaataacttggtttctttaacaatacctgtttatgtgcatgcctagaaccaattaaatactgggctattttaagtttcccaatgcagctatattttggcaagtgtgaaagaataaattagacacttttccaaagcacagtgatctactgagatctgtactatgtaataaacatgggatgatgcctaagcctgtggtatggtggggcccaggggtcttctttcttgtactagttcacatcgtttatgataaatgcttaaaagactttgaagtctttgtccaaaacacttattatgtataattatacagatgagcatttattaaagtaagtgtattggccttttagtgccaaaaccatccctctctatagatgttagcagttttcacttaaagtgtgattgtatgagtaaatgtgttaacccatttatagtgaagcaagacagtgtctacaaattgctgtgacaatgtccttggctcttcaaagtgaatatggttatgaattcagtcgtgagagtgcaggacctaagaaacctaaaaataaaaatctggcctacagtgtattatttttgtctgctcaacagaatgccagggtgagggtagaaaaactacctatcaggtactgtcctcactacttgagtgacaaaattatttgtacactaaaccccagcaacatgcaatttacccttgtaaccaacctgcacatgtaatgtaccttgtgaacctgaaataaaaattgaaaaggaaaaaaaaaaaaaaacagaatacccaactttcaattatgaccaaagcaacccataccatgcttgtgttgttataaatgtactactaatagtaattagattttttggtagtttaagtatactatttatactccatttaaatcatgtttatagactttttgtacattccacaaaaatgaaaatgtcttgagtacctattattgccaaaccctttgctgggttctgtggatttcaagatgaatgagacacactcctacctgcaagaagcccatggtctaatagaggagaaagatgcagactatatattatattatacatatcttaagtgctataaagatactgtaaaactactgctatggaaacttcagtaagggtgtgattatttattccttggaatccagaaacatcttaatgaagcagcatttaaagtgggccttaaaggacagaagtagcttgccaggcaggtgagcaggtctgttgtcctggggaggctactgaaagaaccaaatgtgtttctatgtagggaactcttgtcttctgtatgaggttggcatggttcactcatcaaaatgtataatgagctaagagcctggagaaatgacttttggacatttcatcccagagagaataaacagaggcccttcccatggaggcagcagcataggtagcttaggtttgtacttcagggtcacttcttgacaaggaaaatgcaagtcttatagattgggtcctatagatttcctcaccaattccaagtatagactaacttggccttgttaaaaaaaaaaaaaaaaaggaaacaggaagaaatatctagaatccttggtttctaaaaaaaattataatttaccatctctctgacttggagaaagtaagccaaaatatctaggtttttatgtttcttaaactgtgcttatctcatttaaccttaaaggtatttgattgagtcaatccatacttaagccccaataaattcaatatagcacttttacccttttcaaagtgttgtcatcaattggtaaatctaataaaaattgaatattttttaatgggaaaaaaaattacgccataagcaaagtcaaagaatcaacaaataattgagaaaaggatttgaagcatgattgacagacagagagataattgtgttacagtcagaattgtcacagatgaatttttttaaagacaactctggcaaagataatgaaagggatttctatataagataataaaatgctcagcttaatttataattaaatataaatgaaaaccataaaaatataccatatactatttatcagattggcaagtatacaaaattttaacactacctagaattagcaagagtgtggggaaacaggcactctcataaattcagggatggatccacatttgtgcctgaaactcatacagttttggagacttctttaagaaaaagaatacaatattaagcatgctcttgaatttttatttagaatgagaatgattctaataaattataaatttttaaaacatgacatataccacaaacattgcaaaatctagaataataacataatatttattgatgtactgcctggcatagctctctactaacttttccctatatttttgatacattctttctgagtatcatttcatgcaacaatgttataatacattatgtagagagaatagaaatataagtcatttttcctccagcatggttggtcaaaagaaaattttttatttttgatatttgaaaaagtttcttttagtttcacaacttattggaaatatcttataaatttttaggatagctgataaatttgaaaaaaactctaaaacatttatttcatatatgatctgtaatatttcagggaatttcaagttggttgctatgtaaccatatcaatgttaaagaccatttcaattgatggcacttctttgtagttgatgtgcttgtcacagtggtgtgttatgagctttacattattgtccatgccaatatttctgtcaaatcaataagaacttcatcattttcatgtatttatatgatttgctcttctttataaacatgattatcaaataatccaagagcctatttactacccctataagaaaaaatgtatatccttttaataaattactgcttttcagagtgaatttttttaacaatgcacttcttttttaaaaatatgtataatatttatattattgaatagcaataggcaatacaccctgtatctgtaaaactttggaaccactggcttatttgttaaatctagtccatgccagcctccaaacaccagaaaaaaatttagttagcttcattctttgatgcctcaccaaaatattctacaagatctgaaacatcctcctcctcatcattgtcttctgggtttggtgctttgctattcaagacttgccatgggaactgtttggctaacttcctgagacttgttaagctgtcagcaccaagctgacttaatattccaggaaacatttctgtgattggtttggcttctgcatgactggtaactgcaaaggtgttagcagagagagaagaactagagagaggagcagagagaggtaattgcaaagatgttaacagagagggggcagacagaggttagactttgggatcgttgaaatgaaaaactgtcccatcttcaatcatgttcacctctttaataccagctatattattcacagccagtttagttacggaactctgaagctttctgtcatctgctgtaactctctaggttccacctttgttttgcaagctgtacccttgcctcctatctggacctgagcctgaagtttggctaactttcttgattcacactgttggtaaatccaaagcagggagggtcctccaacaccagcatacagcaacagcaaaatcacaattcacttctgtatatcaaaataattccatagatcccaccacacatttttattgccttggtttcatatttcactgacttttaatctgaattttatttctttaataaataattttaaagatgaccaaaaacatattcttcctatatgtcaacatcaagggtctgtaattccttattatattgaaactttctaaaaggtctttataaaattctgttaaaataacatatcccaactcaacttctccaagcctgatccccaaaatagcgaatagccactccaactccatgtggcaagtaaggggtgtaacagtgaagaattcagagttaagagatggtagtcataaccaattgtggttgaaatgtcttacttttgctaattttacaaaaacattagaaatgtctacatattttaagggctcatgcagggccttggaagaagaccatacaagtaagatttgaggttcacaataaattggcttactataaatattcctcagtacacccttaaggtgaaagtcaaaattctaatcatctatttgaaggacaagttggcagcatgtaccaaaatttagaattaaacatccttggatccaacacttccacttctactaattcactgttacagatagactgtcacagacaaacaaaacattttgtacaaaaatattcaatgaagcattgtttgtaacagatgaaaaaatggaaatgccgtaagtgggagaatagtgcaagtaataatggatatcaacaatataatatgctatgtagttattaaaaagagcaagttagccaggcatggtgacacacacctgtagtcctagctactggaggctgaggcaggaggatcatttgaggccatgagttcaaggttgtagtacactgtgactgcatcagtgaatagccattgcactcctgactgggcaacatagccagaacctgtgtctatagaaatttttaaaataaaataaaaagaataagttaaatctttctatgtatgtaaccatgaaatttatccaagttgtatttcaatttgaaaaagtagtttaaaacagtgcatgtgtgtgtatatcacacacacacacatatatatacacatgcactgttttagactttttcaaatatgtgtgtattgtatacacacacatatatacatacatgtgtatacacacacgtatatacatacatgtgtgtacacacacatacatacatgtgtatacacacatatatacatacatgtgtatacacacacatatatacatgcatgtgtatgcacacatatatatacatacatgtgtatacacacatatatacatatacactatataaactgtgtttgtgtgtgtatacatatataaacggtgtgcgtgtgtgtgtattaatagtttggccacaatttagtttacatattatatttatacagatttttcaacagttacatgttctaccattcctagtggctatttttggggattagactaaaaggacagaggacttctacttataaaaatttgtctatttttactctattcctctcccccttttaagcaaaatgttttactttcataataaaaaattatagctgctgctcaaatcaatttctatgacttctcatgcttaaattactttccctctttaaactcatctttttaaagcaataaataaatgaaaatatttgagaacccctgcttgcaaatcatatataccatttttagcttttaggtgaggtcttgttttttattcctctattttaatcacaatctgtgaccagaactttaggaaaaacatgaacccagaatttctcaggatttcttaaataatgccttaacataattaaatataatgatgattgagtaatcagaaccattttagtatattttgttcaaaaatcagaatagttttatattggggggcagcatcatgattaaagagaggatgcaaagaaagtctagactgcaagcagttaccaacagggcacaagagactaaaagacttctagtcatctcaggagagaatgatgggagtactctagaatacttgcaagagtgtcttccttaaaaagaaaaaggtaactcctaaagacggctgtgatatctatggtgcaatgtcaactttgcctggggagagaggggaacgtccaggcttgccagtgagctgtctttagcataatattctaaatgatgcaaggatattaagaaatcaatgatttattgctatttccttgtgtctcagtgttttttcttctgcaagtttggatttgccttaggctcttctttaaaaaaaaaaatcttagctagttgtaacataggtccaaaattcctagctttttaagaaatttgttaattcagtaaaaaaatctatctataggcacattagattgcacatagagggaaagaggcatctctcacatcccgggagactgaatgccttgttttagagaacagcttgtgcacaaatggcccccaggtgaataagactcattatggtcattttggtcacctttggtccagaagacctcaaggcattagctcaatttgtatgtcatcagaaagcaatgattcataaacttcaatgcgtagaatgccatgaatagcctgttagagagaaccaccctccaccactaccaccgtcaccaccagccacacacaatcctgattcaggaccacattgacaaacctgccttaggactttgggcttactctagagaaaattcacatgcacaaagccaaatcaaactccattcctctctctgaatagatccaaccctccgcttcctgatctgtattaaaaaaaagaataaaaataagttgtctgataatctaacatgcccaggttagcttaaataacagaagttgaatgcaaggacacaggagatatcaaagaaagcaaaatctcagcaattgcacagcttgatttggagaaatgggaattcattccttgctggaaaagaatatttcaggggctccaggggccaagggtagctcttcgagatccaaaagcacgagtttattaatgagctcatgacccctcatctctacttttctatcccttcagtatttcctcctacctcttatctaccttccctctatttggtgtttcatggcataacttctgccttctaagggccaacttccagagcctctctactttctaaccactcaatctaaccaagacaggaggggataatggggccgggcaaccaccatccagcatagagcactcttgtgactccggtgagtctgcagatattaatgtttgagtcagacagttggtctggccagtcagggcaagagtgcagggtcacaaggtccaaagcatggcaactaagcgtcaaaaacccttcagggtgagatttggaaatggacagatatctgtcaaaagagagttatgtactcgccaggcaggcactttggagaccacttattcacccagccattccaccatttgttgaatgcctactaagggttaaacactagaaacaaacactgattgagacatagactctgaattccaggacttcgagtacagggatatggttaacaggtaaatcaacaaatatcacccagtgtgacaactgccaaaagagaaatgtgttcagatctagggaacccagagaagcagggaatacaaaagactccatacgtgaactctgagcaaagttccattaattagatgaagccatgcagaaatattgccaggtatgaaggcacagtgggatttgcccgtgttcagcaggctgaactctagctctgttgctcagcgtatgataagtttggctttgctctactcatttccagactccattttagccatttcagatgttataaggaaaactaaaatataaattaccttaaaagtaagggactgttagtatccacagaactgcagaaaaacatggttcctggagggcggctttggaaagaaacataccaacttgaatatatacagagagaaaaagacaaggtctcactctgtcactcaggctggagtgcagtggcatgatcatggctcactgcagcctcgacctcccaggctcaagcaatcctcccacctcagcctcctgagtaggtgggactgcagcaggcaccaccatgcccagctaattaaaaaaaaaaaaattgcagagaaaaggtcttgctttgttgcccagtatggtcttaaacccctgagctcaagcgagcctcccaccttggcctcccaaagtgctgggattataatgtgagccatcatacctggccctgaatgtattaaaactatgcagtgataccccagtcatggattaaccactctaaatataaattgtttctatcaaatacatatttatctctaatttaaggactggcaatggagaattttttaaagatcctaagcaacccattgccatcaaaacttccagtgtttatcaacattttaatagaccacttaaatattcttgatctaagttataattaaaagtatctcaggatttatttttctgagaaaacatacagcagttttttgttcatctaaaaatctttatattgtaaactttatatcataaagtactttaagactgttgatatgctccttagtagacttgcagaagagtaatcaaatgttatacagatgaaaatgtgtccagttaattatgaatgtataattttatcaatgacattttattaccatttaataacttcaggaaagacctatttttcaaaattcagaaaagtacagcttgttctatgttaggcacagctgcttaaatgtgttcattatgttttgttggggatgtttcttgttattttcatagtagccctcaggctacaatgcatttttgcaaggtggtagggataggtgtcattctcttcgttaaaaatgaggcaagtaaggttcaaaaaaattaagcgttgtgcccaatgttacacagctggtaaaatttgaactcgtgtattctttccatatttcccaaaaggttcacaggatgcaaaaaggttccatagtaaaagtggtttggaaaattttggatgaaacaaaaattaaacagttctttttaaaaaattgcagacatctcagtgaatggatatacacaaatgtgcttcatcaatctccaagtagaaagatagtctgcagcatttcccaaacatacttgagtataaatcccttttatatccagaaatatctcatggtattaatcgtgaaacataatctggaaaaaactattctacattattaggcttcttctcgtgtagtaattgaaaataactctgaaaactctcccttaggaaagtaattcatgagagctgcagtgagaaacaagaagggaaagaaaataaacaggcctgacaaattctgtagaagctgagaggttagacagtaacatcagtagtgttatacaaaccaagaaggacaaaaagacacttgaaattcattacaagccaaattttcctctggatcaaggacagctataggggccaagagtaaaccagatatccattatctttatgtttctcagttctgctttaagaaagaaatgtacctaaccaaaggaaatgtctcaatttatctatgaaacacacaacacccagaaaaatctcataaaatctcatacatggaacacgtaacatggccagtttaacaatcggccaaacaatctgcaaaaatgatataacagtgcctgaatttgaacatctctagacataacaaatagagcatagttacattaccagactaacaacgcttgattaaggcatacagagaatttggaagacacaaagagcatatgtctataaagcttaagtttgttatgttgcaatatgaatattaatagtgcatgggatttaatagcaagaaagttacataaagtgcatgtctctgagaattcctgctgtcagtgactggaaaggatcccactggggaaatgctcgctacctaacaatgccactggtggtgactcatccaaaattccgacacagacctaatgagcttctgagagaatgcctggcagactcagtcctattcagtgtgttaaatagagggtaagaaacaaagttctcaactgatagagttttctgtaaagctctattgtttctgcgagttaagatatactattacattggtcaaaggatatttgatcttccagctaccactttggttaactggagaaaggaaaaacgccacaaagcaagtttgcttttttgttttgtgtttgtcgaagtctttgtactctgataccttctttggaatatcaaatataaactgcccctctggtgcagagtgtgatcaagggggtaattaactgagctccaaatgtgatgtttctggtggtcacttcaagtcattctaaccaattaatcaatctcctggtgctctgacttggatcctatgttttcagcccctggagcagtggttctcaagcctggctgcccattaaattcatttgggggattaaaaaaaaaaataccgatgcctagaccccaccctggaccaactagatagaatctctagggatagaacttctgtatttgtgaaaagttttctaggtgattctaaataaagtcaaaagcctccaaaaactgctgttatgttcatgtccagctactgagtatctagtctccaatgagtgatccaaaaatctcaaagaattaagcatgaaaaaaatgcccccaccaatgactgccatacagctggctgtttgggaccagcacataagacattagaagacaggcccatgttgaagcaaggaaatgtgaggactgtgatcaatgttggtcagcaggatccagggaatgactcacagactgggcaggggagcctggactgaacgtgggctctgcagagctgtctggacacactgggcttggtgcatctgcggaccagcggctagcatgtttgttctacccagtctctgtagctgctaccacccatgctatcacctctaccagtagtccccaaaaataaatagacataaaatggttttcttctcacaaaaatttgtaagtagtgtaaaagatattatatattgaaggaattcttgccaccagaagaattcactgcttgtattttggtttgcagacttgggctacgccaatgtcaatatagatttttatccttttttttaagagtttgcccaatttttttttagggcaaatttctagaaatctctttttttcattaaagggcatctatattttaaatttctacaatcattgctaaagtaccttctgtaaggcttgtattaacttatattcctataagtagtcctctttctctgtgtccttgcctgtaaagtgaattagaagttgttttaatctttactagtatgggaggcaaaaacagaaacttatggttgttttagtttgtgtctctttgattatcagggaagttgagcatccttacgtgtgatttttggacactttattgttgttgttgttgttactttcctctttgtgcctgtaatttattttagtgccagtggtggctgctgctttcagaccctcgccacccaggacaacagctcagctatgccctacttgccccgcgtcagctggagttgaagcagtgcccttcacttaagattaagcttcctggccaggcgtggtggctcaggcctgtaatcccagcactttgggaggccgaggagggtggatcacgaggtcaggagatcgagaccatcctggctaacacggtgaaaccccgtctctactaaaaatacaaaaaattagctgggcatggtaacggtcacctgtaatcccagctactcgggaggctgaggcaggagaatggcttgaacctgggaggcggagcttgcagtgagcccactgcactccagcctgggggacagagcgagactccgtctcaaaaaaaaaaaaaaaaaaaaagatcaagctttctcagagtcagtttcctcatataaactacatgttctcgaaaaagacaagagcttggtggctgaacaccccagcagtctagtgtcccctttgaatccctactgccatcatcttcagagcctggggtgggaacacccatgaatacactgagggccagcaaaacccacatggcccctaggccttcctgagatcagaggagccatcttgaggcacaagctgagattttctcttgctcataacattgagttccaaaatttaagatgtaaacaagatgcaagataggccggccatttttctttaagatgagggagaaaggtaaaatcatattttgtatgtgtttcactaacctatgctaagaacctaagatacaaaaggcacgggggctgggagatggggatgggagttgacaggggaacattatatataggtgcttgcaaggaagttgagaaaaggtatgatatgaatggtacaaaggagggagtgaaaggaagaagagacagtgcagatgataagtcatatctgcggaaataaatttagaatgataatgaaagcagattccctccctcatattctttggagcatctgcctgtctcccctttcattcccaccacacttaatgtagtttattaaaaaacaaacaatgacagagggaactgggaagtacaaaacacacagtgaccggaggtgtaactgattgattactgttctgactcatgtaattttgtcgactcatgtaattttggcactcggtgtgagctttttttctgtaagaattgaataatcaactacagcggacccttgtattccaggctttgatagttatatatccataatacttataacagataatatttattgagagccagacactgttctgagtgctttacctgtgttattggcacttttgattatttcaacaaacttgatctccatttaacaattgaggaaagagaaagttgaagtaatttgttggagaccacagaactaaggtaatttgatagccaagtagttgaggctgtcatgctgttattctgttcctctataatgctaattatttgtgagtgttttctggaaaaaaaaaaattggctgcaaggaaaagaaaatccacctgagctagcataagcaaaaataaaagagtattattagggtaagagaaatgaaagacagggttcagaaaccaggcctcagaaacaaatggtaacaaggcactctacactgttgggattctgccctctgcctccctgtctttgctgccaatcttactctgttcctgcagtccaaggggctggaaatatggctaccagctgctcacaagtttgcattttataggtcccaccacttaaagagctggctcttgttcagtaggtcccgtttttacaattccaaagaagagaccttggttggtccacctgtttagttaaacaatcgctgtggctgtagagcagggtcgcattgggagcagcgctggcaacctataaatatgtggtgcagaaagagagatgcttgagcagataaataggagcccattcctgtgagtaactccatgctttataactaaagtggtctgccgtttctcagaggcatgaatctgaagcctgctcatagcaagccctgccaatgagctcatccaatgagccccccatttgcatctcaagacggttttagtctccttttaaatgataaaattttcaggacatattatagtgttggtcttcatgagactgagacttcatgacctacatcagtatgacatcacttcccaaagaaacatgaatccatatccaaaattcttgcaatacataatgtaagcgttcattgaagtttcttgaagcggctagaagaggaattactacatcatgtaacatgtatcaagacctctttagaaagcctcattagatatttctcttcttcctccccacaaactgtcttttctcttaatccatctctgatatccagggctgtttgttgttattgctgctgctgttgttgttgctgctgctattttggtttttcatttgtttggatttttctataccctaacttctatgaatcactctggcattttttagtatctgtcattttttttctactaccactcagatcagtgaaacaggcataggataatagaagatgaggaaggcggaaagctataactattttttttttttttttgccttaccaagttttgtctcactggaatcattgcagttttccacaaagaaggggacatccccctgaggcacccagagtttcttccagttcatgtttcaacacacacacaccccgcttccttcctgtatcctgctgagctgagtagaattatctccaaggccttaagagcattacctctccataaaattgggtgatctggagttgtcctgaatttcagcagcaggactcaaacttcctttattcagacgctgtggctcgggtcaagatacatattagccagaattatgtttacctgtgaataattggcagcccaatttgcagtggcttacattaataggggtctattttttactataacaagaagtctggccttagagagttgctgatgttggtttagcagttccacttgtcaagcactgatcccaggagacaggaatggaggacgaggagataagaaagcaggagtgaaagctgttaccaaaaaaaaaaaaaaaaaaaaaaaagttctccaggtggatgactaggcctgttcctgttgtgatccctccaggacatctgtacattgtccttcagaaatgtccaaccaacagatgaaagaaaggtgcattgatccctcagtccctgaccccacattgggcaagggctgccctgtgggatgtcaccagcacttccagctgtgcatgcttgtttgctgagtagggttctggatgccttcatgcgggggtatcagagtggcctaggggcagagcacaagaggtgctgagggcagcttagtggatgtgggctgtcaagatgtccttgcagggagttgcgatggctggagtaaaaggtgggctcctgtgtggatacgatgtgggacccaagacgcatctcatacagctcagaaccttctgaatctgaggtttctatgtgcttccttaattctgggaagttctctgttactgttccttcaaaaatgtcatcccaagtattctcttcttttcttttgggattccttctatatcaatgcagatattgtcctccacaatgcttagtttccttttacaaataccctctccttatatcccctccagaatcctttagagctagctctgcatcccaatcttcctacttgctaattcattttttgtctatgttcaatctgtcattcgatccatttatgatatttgttccaatgcatatatttttctacttagtatctccaattggttcttcataacttcttattgctgtttcatgtctatcttccctcaactcttttataatatttgatatgcttattttaatcttcctggcccatcaactatgttgcatctcggatagctttccaccaggagtctttctctttattctccttggcagtctcagtgtttttccctcagagctcctgttctcctgagggcattcatctccttgattgattaagtatctctggagtgagggctagaagccagggcctccatcggtccccttcctagagggccatttcaaggctgagatgctcaggtgctactctctgggcttaatcacttcatgtagggcattgccccattccccaaatgggtgaccctgtccctagggacttcgtcgaaggttgtgtgtggaggggtgctggggaaggcaatgcatgcagctggccagacagcttgagcatttccttatcagtctctcatggagcagaagtttctgcctcaccacgtgctctttagcagccattcagtggcaatctggcaatgcacaagaccaaaggggtagaaataaactcgtgctcccaacccagaccctcctctagaggccaacttccattcggggccagcacttttacacaaacatcatgatccaaccaccttctggctctccaagtgttcctcttagtttttccagtaactctggcttcaacatcctccctctcacctccatgcatcttcagaattgacttcaggagtggcagccagcagcctggtcatttctattctgtcagattccctatctgtagagatagggagttcttttctccatgggtacagggtgacctctttgccacaactaataaaagctgcatgtggctccatcttcccaaatcttgtgcagtcacaggtatattatcaaatctgtctcccacctactaatatctagagtctactcctggctggaacagttgaccagtgtgatgaatcctggaagcagatcctggaagctgtccatgattacataccaggaggctctgactggacccttggtcactggggaccaggcccttcctggtttggacctaatatcagcaaacggagttgttttctggttctggggtctactccaagagcctgcgccatactctgccatttgctcaggtttcctgacagctgccacaactgctccttcctctttcttccctctaatgagctccaccaacaatgaaaattcagaccatcccaccagtttgcggtgaagtctaagcttgtttaaaaactccttgctataaatcactctctgctgaactgaatcgattgtctctgatcctgtgagctatgttccatcacatcctgccgggggccagctgccagagctcctaaagcacaaacacaaaggtagcaccttcctctcttcttcttgttaacatacaaggaaacagcaaaacaaaaacacctaaacctacagatcgtatcaactcttcaatttgacatatgtatctgaagactatcagattaatctataagcaaaactgaggtccttgaagacttattctatgaccaaatagtaatgaaaaattctgcaggctacatttcacttctggcatttgtctgttttgaagttttgcctttctggtaccattttaatgctcaactacctggaatctgggctgatactgctcacggatttttcttctttctggtagtacatgtttctcaccagcagtcttaaagcctgcttgattctctgtcctactgaaagagctcagaggatgcagttccattaatgagtcagattcatcagtgtaaagatgtccaacaggccaggcgccatggctcatgcctgtaatcccaacattttgggaggctgaggtgggtggattgcttgagctcaggagttcaagaccagcctgggcaacatggcaaaaccccatctcaacaaaaagtacaaatattagccaggtgtggtggtacatgcctatagtcccagctacttgggaagctgaagtgggaggaccacttgagcccgagaggttgaggctgcagtgagccaggatcgtgccactgcactccagcctgggtgacgaagtgagaccctgtctcaaaaataaaaataaaaatgtccaccacagacctcttctaagtttcctaaaatgcctacttttaagaaattcagtgtccttgaaatctaggtttacaaaaaaaaaaaaaaaaatgctcatcttataatttccaaaatcatctcttcaacccccttgaaatagggaactgatatatcacatccccatgtggttccacccccaacccaggatttctcccatagtgataattctgatcccagagacgtctccacagttttctgattcgtggatgatcactacaagaaccatgaatgcttgtgtcaagttgagccccaactcccttgctccaatctgtccagcagctgaacaatggtgaaagttttccttggctgcattctggggtaataattttatctaaggtacagctgtgcattgttctttaggtcgaaaatctgggacatttgcccccaaacgtaaggtgaattaaaccagactgccttgcaactgcctcaaagtctgtctcaacacagtgactcatccaagagaaacagagatgtgtcaccaaaaatatctataaatttttttcctgttttactagaaactccttagggatagagtcgagggactcatgctgtgcttagagctaaacttcctgaaaatcttctcccagggtcctggaggcaaaaagggcagtgcagaatgctccttagaagggagtgtggaggaaaatgcatgcttatattagagaacccatgtctctgaaaccctggaattcaaagagctttctggactatgccctcactggattcggaactaccaggctttcatcatcaagaatccatcttgccagcatggggctgaagtttctgcttcctgaataccttttcccccatcaacttccttcagtaactagtggagaaaaatgaaaatattctgggaggtggcatgacagaaaaactgagtttctaatgtcaccctttgcaatgcatcacacacatttagatatctcaaatgcctgtgtctaggtgccttgtagagtgaccaaccatcctgatttgcctcggactgaggggtttactgggatgcaggacattcagtgctgaaaccaagaaagtccaggacaaacccaaatgaattgttcaccctagtttcatgctcaagatgaatagagacaccaaaatacaacaaagataaacatcttgactgaggtgtatgtatttctgacagccataccgcatcaaagagcatgcaccgtaattcttttcagaattcccctcacctacagaccatcctcagcctcaatctttacctgtccacatcatcttctcctcatcttttggatatgtgtcagcactctctgcaattaattgtgttgcatcctgtattccagataacaatgccagaaatggatgcagattttggttttggctataagggcttggttgtgaaacatacatatttatattgagaggaaagtagtggggagaagaatcctacctcctttggctggtttgtgcaatgagctcaggactacacatttagatatgaagtaattagaaataatgaacctctgggattaccccaagacttccaggagacagagtgtgccccaagtcatgctggctacaaagactagaactcgttatggataaaaatgggagaattcgattaaactaattcacgggtgtatatccaaagagtatttaaaaacatggtagtggtgccacataaataatacatagatcctacaaagtcatgccaacatcgtgaaaagaaatctgagtcgtagagctccacatcctgctgccctccagacctaatagtgttattcttctggtttgtagctgggaattcatttaaaggctggagaattcggtttcgactgttctttctctgcttaagtcatgtcataagtaatgtccatcagatgtaactctgtggatggcgccttcactttagcagagaatctccagtctcaggaagaaaatgaaaagtgtattttcctcttggctggattcctgcctcctgtcttttttctctatcatattgagcactctactggtcttaatcattttttctaaaaagtcctggattgtattattttttaaaaagacactgtggactctgtcactcatatttttaaaataataatagtaataaattaaaggaaggcctatgtcagtgaccatgctgcgctagggagacccttgtgcccaaaacaacagctcccagctcaagagagggagagagcagccacactggctggcctagtcaatgtttttttgccaaagatttctttgtatctggaaattgctcttatgtgtatcatacatgtttgaaatagctttctccaatttgaaaaaccataaagcagcaataaacaaatgggactctgattaaaaaaaaatactttgtaagtatcatgcatacttttacaagtgtttattagatggtatcattttgcctttgcttttgcatagtggactctcagtgctcatgtaaacttccagatgtagttaggtccctagaccatccactaacttgggtatatttttctctattaactatttaaaaaaaaatcacaggaaaagaacctaatgctgaaaaggcagccaaaagtacaatgaaatgaaatcaatcctaataacaaagacttctcttctttccaaaagcatgcgttcctccccagtcctgcacggtaaaccacatcagtgtgggatggtaacatttcagtaagttatttgaatatcccaagactaagaccatgaataaaaagcaacagcagcaagattgccaataggctgtgggtatttaaaacacaatggcagaagattcctcgaatacaagggatagctagagccaataagccccagtgcatggatattaggaggttcattgattagggttacatgattaaagaaataggctaagggaataaactgctgtatacagggtttagctcatatttcttgcaatgcattttttgagtacttttgccctcgttcctgggaaagatggtaagttaaaaaaaaaaaaaactttataaagcattacattaaaaaattcatacaaaaggtactaagaatagaaatcacattcatgcttcagtttcacacactttctgtcccaaacagcatataaataaatatgatttttgtaacagctacattgtggcatataccacaaagggctcgggtatcaggcaagggaaaaacaatttatcttcattaccatctatccacacatactttggtaatcatgaagacatttctccttacaatttcacaaggaaaataacagaacttgggctctgggtgtcagtatctggcccgagtccatttagtggcaaaaggaattcttaagtactgacattacatttcaacggggcacaaagagacaggatttacattccttcttggattaggttttgttttcatactcattctctttagataatcaaaagcatgtgtccccacaccttgccagttccaccaagggatcctcagcacccatctcagaggggtctgatgtgacatctgaaaggcgatgttgctgcctccccagccaaggggggtgcttgtaatttctcctgcattatctttgaggtatcactcaccaaagcaatgaagggtaaccattccgaatcccaccagtgactccttctgaaaaacctatcagtaggagccttcagttttaaataatccctgccttgtagtcacacaggggaagaataccccagtcaatttatgaggtctttgccttcaagttgtagatgaaaggagtttgttgctagctgggaaagcttatttatgacatgattgttaaggaaggaatggtagtgttcccatttttttctttttccttttttaagccatccttgggttttgatgattgtgacagtattttttgcctatgttttacatactccttttggccttgagtttaaactgggttgtattcaaggagtcaactttaattttgtgaccaaaaaaaaatctgtcatcagagctatcctgccttcattttgagtactccccacgctatcttctctttaactctaacttgttttattttgaatcgcacagagaaggaatttgaatggctgcatgcatctttggagatgcttaaaccttttctcattttgggtcttaaggataagtagatctacatcagaaaaatattaaaggagggatcctatattctaaaaatataaaaaagtaattcagagtagagtagttcatcaaattaaaagactatttgttgacttcatcctctttagtgacaaaggagaatttagttgcacttctttcagtcagggaactccactgtggatactacagaagcaggccagatcatgtatataatttcactaggggagaaacagatggaatttattttcttacctgagttcaccaggttttctcatacctcggcctctctactcctggtttctgattggaatcccatatggtatttctcaagtgggaggcaaatccctaagcatttgcttcaaaatcaatgaaatgagcaggtagggtgcttgagaaaaataaggattcccaagccccatcccaagtctgctaaatcagcatctctaacagtggctccaggaatctgaatttttaacaagcttcccaggcaattcctaagaccctaaagtttggggaatgactactgtgatgtcataagagattctagaatggagactggcaggattgctgttgtttaccccaagaccagctttgccctcatgcctcaagtaatagagcccctaagtcttggccaggcacaactctcttactgctaggtatgtccgttttatggttccaggccaccatggagatgcaagcataagtgctgtgagcagcttaaaagacagttaattgacacacgcacttgcttcctgcttcttctttcttgctggctggaatcggggcatcatggctggcactcaagcatccattttagaaaggaggcaacatactaaaaagcaaaagggaaagaatttgacaacaatgagcctgccataacaggcccaaatagcccaactctccatttcttctatacgatagagaaataaatgtctgcctggtttaattcgtaagtctctcattttggtgttttgttttcagttgtggaatggagtagggtagacggtatgtgcagctaagcctaaactaaatgatatagactccaagaaaaaaaatgtctgctttttcttccataatcctagaacctgcctggtactgataagctgatttcttataagcaagcagtccattgtgggggatgagatatggagatgggtttccatgcttgcagattcacagcctttgcagctcctgggtcaccagaacaagactaggggccggccagtcaagcagtaggaagattatctgcaaccttatgcaatcattagaattaaagagagtataatgaggggatgaagagcaaagactataggcagagtcagactccctgggtctgaatactgggccctcactttttcgtgtgcatttcagtaaattgcccaactccttcgaacttcagtgtccaacattataaaacgaggagacttagaaaaccaaccatacaagacttactatgaggcttaaatgctatacgtaaagtctggcatctcaataacaaattttctcaataaatggcaaatattatgatggttatttttgaaaactgtaagaggaaagaaaatgaaacatcaggaagtgtagttatgaagctccctccaccagctaccccagaacctgattttcttccaccttgagaaataaatactgtaagcagttgagttttggagagagaaagagagatgtttaaataggattttgaagtccctgctcttgctttgcaaagaaatcatcagtaaagttctatatttttcttaggaaagaaaataaagtaacaccaatgagaacagggaagtggaataagaggccactacgaagtgagaggtagcttccagtcctaccacctctgattagtttattggctggatgatctcaaccaagtcgcttatactctaagcctcagtttccttttctgtagaaaggaactcatctgcctcagatgataactgagataagtgaatgaaataacaatgtagttatatgtaataatcatataatttggaatttataaagaactataactttctatggttttattacatattcagactccatgctacattcctggggatagcagaaactctctcatgtaaatcttctctgtgccaattaatctcaacttcagggaggatctgggtagagaagctttgggcacgatcatctccagttgctgactttctagggttgtaagggccatactcgtacaggtaagccaccagaataatatatcgaagcatctaaaaaaattttgttacacacccatcttagtctctatttaacccctttcattgtacaaaaggcaagtgctttgaaaggccagttataatcaagtattaggaggaaatgcagaaatcactttcaagtaggttggctgtgcatagcatggaggctgtacttagtccatcatagtctgaagctcttagatgacatcaggcatcaaaaatgccacctgtcactgctgcccagccacaagaatgagtccttccctccaaggaaaatactgactgctatcaaatatgtatttacttattcacaagcttccctcccgctcagctcctcactggcgtcaccgattaggtccttataaatcccagtacagtacattttttcttccacatggatcctctctgtaacactttcaggcttctagaaggcagtgataatttctatcacactcaacatccatcagatctagatgtttaacatgtaatgtgcagttttaaaggatgtggatgccgagccatgacgaggcctgctggctccatcttttctgagtgtccacactgggccaggtctgtatcaggcactgagctgtgaataggaacatgctcacggaggtcacctttcagcaggagatccactttgtacaaagacacacatatctttgataagccgtaggaaagcagagtctaaggctgaaggaagagtttctgaagcgagataacttggcaacttggaggatggataggaactggtgcaaaggccatgtaagtgtgaaggggctgatatggattaggagctgaatgaaacccagtgggctggaatgtggaagggagctggcaggagctggagaaggaagcagcagccaggtcatttggttggcatttaaatgacttttgcttttaatctaactgaaataggcagccacttagctgttttaaacagggaactgagctaatccaacctgcacatgaagatgatgtcactgctgttgtagggatagccagttaggaggctcttcaggtgcctggtctggaaagagttgtgtgattcaggttgggctgataactgtagttagagaagtttggagatcaactgtttcttatactgtggtgggaaatctttcagtagaaccaactcagatctatggatccttaacagctggaggaagacagtgatgggggagtctgtacttatgacgagctccagggttatcttacatacacaatgttcgaggcttggactgacacttctgtatcttcttattgctagtgaattccttaaaaggactaaattcatgagtctggatccaccccaaacctagtctcctgaaggtttcctaaaacatcagatttaactgtcactagaatggttgtccccagtgaaaagcatagttctcctggccaatggtcagtaaagtctgcactttaagctcttccaatagtagtgatgagtttgtgcaaattggtccacacattttcctgactcacaatgtaaatgtttaagactagtgggcaaacgcacaacctgctgacatggaacagagcaaaatcagctgactccaagccacaaaccaccccagccccatgctaaaaatgtcattaatgggcttgattaatgatacttaattttgtgtttgctttaatggtatttcaataaaaaattatctggctgggcccagtggctcacgcctgtaatcccagcactttgggaggccaaggcaggtggatcacgaggtcaggagttcgagaccagcctgaccaacatggtgaaaccctgtctctactaaaaatacaaaaattacccaggcgtggtggcacgctcctgtaatcgcagctactcaggaggctgaggcaggagaatcgcttgaactcgggaggcagaggttgcagtgagctgagatcgcaccaccgcactgcaacctgggcgacagagtgagatgctgtctaaaaaaacaaaaaaaattacccttcattgggcaaaaaaccagggaactcaaccaaaaagatgtccaaattatagtgctcagtgaaaaaaatacatcacagggtaataaagtataatattatgccacagtcagatttgcatttgatagataactttgtgcactatgtagaggctggcttaaggaacaagccaggggacaaaacacatggcaccctagtctgtgcggccagcctcacacaccctgactttctgtccttttgggaaaagacagcagcatgcttgttaatggaagatcctagacttcagatgcagaccctcaccaaatttctggctaaaccatgggtctatacctcaaaattaagccacacagtatatgcaaaaagtatgagtagtaaaagcaacaaatgttactttcccccacttcttttaaaataaagtaatataatattctaagctagtgattctcaaagtaggctttgaagttcattttcatcaaatagctgagaacacttgtttaaaatacagagagcctgtgctggccctctgaatccaagtggtggggcctggcaatccacacgttgacaagacccatttgatctgatgcacacaacttgaaaactgcaattccagactagcagatgcatatttaattattttccaattgtttcaaatgactataagtttgctttgtgttatttttctcttccctagccattgataaacctctgaaagttcagcctaggcttccaccagacaacctagcagagggaaggctcaataaacaatgaatcaatacttgattgatctatggcatgcaaattatattacgcaaaacttctctcatcactactaaaacttttccagatgtacagtttattcactgttgccattgtcttacaaatccttatctagagtttatttctggagagagggtaaaaatccctagcccgcaaatgaggatctatggaactcccgctggggccgctacgtgacacaaaccagagtgagaaaaaaggtgccctgctcctattttcagctccttactccttccaccaccccagtcttgatagttaatcctagaaatttttctcatttgcttactttaagctttgctgtttatggaaatatgcctttctatctggaatttgtaaagaccatattaccatatttccatatttccttgttttggtatgtaagtccctctctcaaatgtatataaatcccgtaagtgatgaaaggaattttactaaatggcccttttgccatttgccaacctctctcttggcaggtgtgacccaaggggtccatcactttgttaggcggcagataagcaagctgtgaattccagtggcctatgacccacctttgcttctcagaagcttcctcctgaatttatgtagggatatgatgctgtgtaaatctaccgtaaaagtcctttgcacacaaaagacctgattcttcaggtctgcgaacacatgcttcttctgtttgacttatatgggcaccctagggtttgtatttgcgccaaaaagtggaagccaagctttcattgtaaacagatggtgctgctaacaaggaaagtaaaaaattcttccagtcactcctcgcaccagagacctgaagaagattctgctttaaaaacaaatgaacaaaactatcaaatactccctctcccctattccataggctctgggtcaaaacacacatacacacagcccctcacatgcagacaaaatctggtctccattcctcactttccccatcctcctccctatgccaaattctacattcctccagtgtagatactataaatataaaaagaacaaactcaatcccgaatcacgagggtgcttttctttgcatgaccacaacataagcactggtccatcattttgggatttttatgaagccttgaagaatgttcagaattccagtcttgctcaaacaatgtctctcaccagtcggcatgattcagatgttgagtttcaggacaacctggggatttctggttagaagaaaacattctcctgaagtgtctcaatgtgaaagatttccatgtatttcccccttttttctttcagcccagaagaaaagaaatgtggaaacgcgtatgttttctttaacatgagggaatttgaagttgattgcaatctccctgtccctaagcccaaaagagaagtagcattattatgctgtaatcaggtcctttcttaaattcctccattaggtagcatcttattacataaccactttatgcttttaaatctgaatatcgataacaatctcctgacagatcatacttccggtgcctaagttagaaagcgaatgacccagacactctgagatgtcctttgaagcattccagaggaaggggacactggaggttatccagtcacccgtgccttggggcaagaccacactcaagctgttccaaagaaatgaggatcccttttatttttgaagtttccccagagacgcagattccacagcctccctaagtaaaccctcagtgcttcaacagcattaacattttcataggagagttaagcccactatcaaggtacttattattgaattgacactctgtcctttgagccttagaaaatatctacatcaaggcctttctattgtatacatgaaagctaaattgtctatctacttgtataagataccatgagaaaatacacatttttggaaaccttacctcagtctctgccatctgtttattggggatacctgctctgccaaactcacagtactacctgaaggatccaaagagatcacatgtcaggctgcccaaggtactatttgtatcaccacctaaataactattctaaacctgaatctggaagtagttgtttaagctactttattatagaaataacagggattcctgaaataatactttaattataagcctaagttacaaatacaaacatgtggttcatgaaatatcactttaatgctcacataagcaaactatgtgttggcatctcacaaagcaccagggaaaaattattcccctgaagatgcaggacttgctctgaagagcaatggtagaaagctatctccatggtttagcaatcacagatgcagggactgggtaggtgaggatggaggcggcgaactgcctaacagaaggaagccctgtacaagagagacacacatagatcacagtggttcagaaagcctaagtgtgaacgcataaggaaaggcataccgggcaaacggaactgaaaaagcaaggttatgaccttactctcaggtgaagtgtaattcaggccagaaattaatatagtaagaaaaggggcactttgtaatgctaaatagtgaaactcaaaatgaggctacagcaattatgaatacacattcatcaaacaacacagtagccactgtgtaaagcaggaattacagaagaggaaagaagaaatagacagaaatgaaaattcagtccatgataaataagtcaacatatcttaagttcggaaaagacataacataataagatacatgttattcaactctgtatcctgaaaatatctccatattatctaacatcattttttcaagtggtcaggaaacatatatgaaaattaaccataggcaaggcccacaaagtcaacaaattccaaaagatagaaacattacaaataatatttttggtcacaatgcaataaaacaaaaaattgttatcaaaatctcagttatcaatatcgatacagaaaattctaaatgaatactggcaaacagcattcactagcacattaaaaaaagtaattaccatgacgaaatggagcttgttgtaggaatgcaagaataattcatggccaagaaatttattatatcccattaaattaatagctctatggagaaaaaaatatatgatcatttccaaagataccaaaaagagcatttggacaaaagtcaatactcacacctgatccaccccccgcaaaaaagcttctaagaacaaattaatattctcttagcataataaaatagatcattctcatcccaaagcccacatcatgccctgaatcactgggcataggtaatcactgaagccatttccattaaaataaaaaataagacaagaatgcccactcttactactgttatttaacatcatactagacctaatagataatgaaatttgaacagagaaactaaaagtataaaaattggagagcagatggttaatctttatttttagattacattatatagttagaaatacaagagaattgggaaatatttataaacaatatgagtaagatagaatggcacacaaggaatacactgtaattagttgcttatatccagctagaagatgtaatgagagaaaagaccccatttacaatagtaataacaaagataaaatacctatgaataaacttaatacatgtccaagacacatatgaaaaatctgtaaaacattcccaaaggacacaaaataagatttgaacagatagaaagatctacctttttcttagctagaaagacttgataacatgaagaagtcaactttctctatgttaattatttaaatttaattctgatgatacaaacaggaataagagtttctattattgtttactctgaagtttatatggaaaaacaataaggaaaactgggaaactgagaagagcaatgagaaacgatattaaatgtataatagaagtgattagatattagatattaagaaaatattaaaaattaaaagcattgataattaactggtgtggcggtagcacccaaactaaaaaaaaatcaaccaaggaaatataatgtccagaaatagactcagctatacacaggaatttaatagatgatgataatagcatctcaaaacagggtaaaagattattatcatgaagtggtggtgaagcaaagcacaggcaacagaagcaaaaataggcaaatggggctatatcaaacttaaaaacttctgtgtatcaaaggacaaaatcaacagagtgaaaggtcagcctatgttacagaagaaaataattgcaaatcacatatccaataagggattaatatccaggagatatatatatatatatcctataaggggttaatattcaggatatatatatatatctcctacaactcaacaacaaaaataacctgatttttaaatgggcaaaggacttgaacagacattcctccaaagatgaaatttacatggccaacaagcatatggaaagatgctaaacatcattaattactagagaacagaaaatcaaaaccccaatgagatatcacctaacacccattaagatggctgctatgaagaacacaaaaagtaacaagtgttggcaagggtgtggagaaattggaactcatgcgccctgttggtggaaatgtaaaatggtgcagccactatcgaaatcagtctcacttctgggtacatagccaaaagaaatgaaagcaggatctcaaaaagatatttgctcatccatgttcatagcagcattattcacaatagcaaagaggtgtgggcaacccaaacatctactgttgggctaatagataaagaaaaagtggcctgtaatcccagcactttgggaggctgaggcaggcggatcacgaggtcaggagatcgagaccatcctggctaacatggtaaaacctcgtctctactaaaaatacaaaaaaaaattagccgggcgtagtggcgggcacctgtaatcccagcactttgggaggccgaagcaggcggatcacgaggtcaggagatcgagaccatcctggctaacacagtgaaacctcgtctctactaaaaatacaaaagaaattaggcgggcgtggtggtgggctcctgtagtcccagctactcgggaggctgaggcaggagaatggcgtgaaccgggaggtggagcttgcagtgagccgagatcgcaccactgcactccagcctgggcgacagagcgagactccatctcaaaaaaaaaaaaaaaaaaaaaggtggtgactgggcactgtggctcatgcctgtaatcccagcactgtgggaggcagaggcgggtggattgcttcagcccaggagatagagaccatcctgggaaacgtggcgaaacccatgcctctattaaaactacaaaacttagccgggtatggtggcacacgactgtcgtccctgctacttgggaggctgaggtgggaggatcactggagccctggagattgaagctgtggtgagccaagattatgccactgcattccagcctgggtaacagagtgagaacctgcctccaggaaaaaaaaaaaaaaaaaagtaaatgtggtatagacatacaatggaatattattcagccttaaaaagaagaaaatcctgccacatgccacaatatggatgagcccttgaggatattatgccaaatgaaataagtcagtcacaaaaagacaaatactgtatgatttgcggtgattaaagcagtcaaagtcatataaacatggaaaagaacagtggttgccaggggcttggaggaaggagaaatagaaagtcattcaataggtacagcatttccattttgaaagataaaatgttctggagatcttttgtacaacagcatgaacatactcaacactacagaactgtacacttaaaaatgattgagatggtatattttatgtgttttttaacaacaactaacatttaaaaaattattctttttgaaagtggtagtggggcaactggatcattaataataaagcaagatccataccttaataccttatacactaaaccaggataaaatataaatgaacaggccaggcacggtggctcatgcctctaatcctagcactttggaaggctgaggcaggtggatcacctgaggtcaggagttcgagaccagcctggccaacatggcgaaaacccatttctactaaaaatacaaaaattagcctggcatggtggcgtgcacctgtagtcccagatactcgggaggctgatgcaggagaatcacttggacctaggaagaagtggttgcagtgagccaagattgtacaattgcactccagcctgggtgacagagtgagactctgtctccaacatatagatagatagataaatagatagatagaccaaatacctaaatatcaaaaataaaatcagagtatataggataagacaggcctatctatgactcttttaaaaactgataaattcaattaaataaaattagaaacttttttaatgtcatgagatatcaagagccaagtcgaaagacaaacggcaaaatgagaaaacaatctgaaactcctaacgcaaagggataatctccttaacatacgtggagtttcaagaactgaagaacaagaccaagaacccaataaaatatgggaacactatataaacaataaggccacaacaaaggaaatagaattggctcttaaatatataaaaaacttgctcagcctcactcaaaatcagagaaatgcgagtcaaaactatcttgagacatcacttttcacctatcagactggcaaacatccagaagtttgattgcacattttgctggcaaggccgtggggaaacaagcaccatttaacattgctagtggaagtgtaaattggttcagccctttgaaaggcagcttggctgtatttatcaaaattcaaaatgtaaaatccagtaatcccacttgtgggaattaatactatagataaacttgcacaagtgtaaaatgtcatgtgtggacgtttgtaacattgtttaatagcaaaagattggaaacaagtcaaatgtctatcagtgggattctgattgaataaatcgtggtgcatttatccaagggaatgctatgccacattaaacacaggcatggttactctgcactgatatgcatgtaagtctcatcgtgtccgtcctcttctcaagaccctccaatggctgtctgttgctctgagggtaagtcctgaaatacttacactggtttagcgggtcctacaccatctggctgtcctgtctctctgacttcatatgacattctacatctcactttctctgtttcagccacattgtcccctttgctgttcctcaaacgtgctaggcatggtccctccttaaggcctttgcactagcttcttctgcctggatcaccatactctccaaataatcccaaagctcactgactcccttaccatgatcaagtctttgctcacacgtcactgtctcaagaaagctgcccctggccgctccgttttaaattaaaattccccactgacatccccaacccccattatcttgctcagtgtgttcaactgctcttattatgtcctaactcaacacagaattaacttgtttagtatgtttgttttctgcctaatgtgccccttgcccaagatataaatgccaagggacagaaagttttgtcagcttgtcccctgctgtgttaccaacatacacaatagtctgtggcatgaagtaggtcttcaacaggtgtttgtttccaaacaaatgaattaatgaacatacaatgtggaaaggactataaagtgtatatgtatttaagtgaagatgtaagacgaagcccagttattgttctgcctatagtattttttttttttttttgagatggagtttcactcttgtcgcccaggctggagtataatgacgcgatctcagctcactgcaatctctgcctcttgggttcaagcaattctcctgcctcagcctcccaagtagctgggattacaggtgcccgttgccatgcccaactaatttttgttttagtagagatggggtttcaccatgttggccaggctggtctccaactcctgacctcaggtgatccgcccacctcagcctcccaaagtgctgggattacagacgtgagccaccgtgcccggccctgcctatagtatttttaagaaataaagaaaaagtgtaagaatgtatttaggccaaaagaaacctggaagtctacagagaaaactattatcagtggttacctggagggagatgtatggactgggcatatggggaagagtggtagaaaggagactgtggtgcatgtacttttatataaattatgtaaatgtattacttattcaaaacattaaattaacaaaagaaaaataaaagctgatgtcagctcccaaagattgtaattcagtagttctgagcagggctcaggggaatctgcattttcaacaagctcccccaccctcccatcccttcctgggtggggtagatcaccctcaaaaatcactgtcaccactacctctcctgaccccaaaacgccacaaaccgcgtaacgttgggatagttctcatttggagcacaagcaaatgggcaggcacatcacagaaactaatggcagagttttcagtaacatttgacaccactaacagctgccacccaaaaggcagcctccttgtgtggaagaacagcagaaatttcatctacccttcagtttcatccccacaagcaagcaggaccagtaaaaggagtgtcctctctgtctaagacatttatatatgttgggtgtttagactaaatttcagacttctaaacattcacaggtttagcgaaagtagttggaggggcttcttcagatttctgcgctcatggtgatcatatactgaaaccctccaaatttttccttcctctttcgcccaggcattttaattaatacaatgtccttcctaattcacagaggaaagatctttctaagaacccttgctggagatgagaaaggtggtaaggatctgaaatgtgtcttagcaagactcacccaacagggccaccctgcttcattgtgatgcctttcagataaacgaagtattcggctcttgttattcaatgaccctaataaaactttacaactgaagtgtagaggaaaaaaataaataaaaagatctaatgacatacaagaagggactgaacctgtcaaccccagaatattttcagtctgaaaagcaacctcatccttattaactttacattgattcccaaagagcggaaaatttaataaggaagaaaaaattcaatatttcatgactcaccacttcctcgggataataaatacgaactaaagatatatacactgaacgcttttaacattttattttcacttcaaaaaatactgtttgcactatctctactattgacctctcaagatgattctatttccggaacgcattttttgatatggtttctaattcaaaaatctgtcacatctttgatatttcataggctccattaaaattaatagcttcatgggtccctcatgagtttcttccttaaattttcaaacggtttgtggtctgtttctcagactggccaatgacaagcagttctgggactggaagatggaagtagtgaaataatctttaaaaatgtgtaaaaattaagcactgtctgccaggggctttagagttggcaaatagctaggtctttattaaacggttggttttgtttctcctgttgtttcttcctgatatccgtctgtgtggtaactgagtcactatgacataataccgcagagaaagactgcaggacaaccagacgtacacatgttcatccctcaatgagtcgcaaccttgggtctgttccctagacattggtggaaagacttgattaatggcagacttgttcaacataaaaaagaacaaagaccagatttattcttggcattccctttcctaggggcttacttgtaatggggtaattaatttatggctttgcagtaaggcggcatcagaggagcaatttaactcacaagaggtaacgcagatggagagtacaactgaaagataccttgtgtggaagggtacagaaggaacctcaagctggacgttgatttcttttatcagtaatacaaattcactactagctgcttcttggatttccccccttgagagctgcaacgtttcctaaatgaacagaggtctttagggaatgcctcaaaccacagctgaatggggagtggctttagaaatcgccggtggaacttgcctgttaccttcttacaattccccccgcccctgggcaacgcaaaagccgtcctaagtgcgataagagcatggagtgaagggagttatttctggagtttagcagcattcctccccaggacacaccctctccccctccccagcagcccggcactccgacacactccgcgcacacgcgcccctcggcgagacgcggcgcattcgcgcgctggagaccggcggcctctcaccgagcctgagtcgtggccgctgcgccgccaggaggcttcccgggagccggcggggcccaggacctctcgagcgcagcaggcaaggggccggccttttggcagcgcggctgccagttaattttctccgttgcattctgcaaacgagatcgcattcagagcccagaagttgcaagctgggaataagcgagatctgaaagacccccaagaggagcttgtttgggagtgggggcagacggcgttttgcgcccaactggtaagtggcagcattaaatctatgcagacatggaggaaataaagctttgcagcctttccaggcagtggcatgcaagtactcgtgcgaagagtactgtttggggtgtttagttgtagtggactcagaataccgtgttccgccacggttttcctaatcccttcttcggactcctctttgggggttggcgggggcgggtcctgcttcgcgggacttttctgttgttggagttagggtgggggaggggagaaaggcgtgaggttgaataatctctcctacccacctcacccttttttttttccattaaaaaaaatgatacttttagagaagcttctctttcatgtgtttaacttgcctgctgcgatttgagcccaatgagtttgtattttctctaattactttgtaatcggctccatcctcggttgaaatagaaggaaactttcacaaagcaatcaatttctgacagcctaagagctgctcagttgctgaatgaggtctagctggaaacactttgtttctcacaaggttttggtgatttttcccatgagaaatctgggcgttttcacacctgttgcttttcagttgcctcaaaattgtttgcttgtttgtttgttttcttgggtttcacttgattgcagttctttgtctaaccaaatccaatgctactttcccggttctcctctccctttggacggggtccctgttgttagcattcagttggcggtggttcttagggaacaagtggcaggcagaatacaatagggaagaatgcattcctgatgactcctctaccatggaaagactgaaaaactgacattctccattagtttttatggaaagcattgctgacgcttataaatattcaattttggtgagttcctgaaattatttaatccagaagtaaccagcatgacttttacagagagagttcccctaatctatttgcattacaagcatagagaccctggcacctgaacacccccagaatgctgaagtcacctttcacttcactggcaggtaggctactgacaaggaaaggggtgatggaatgttaggagaggggcagcggggaagaccccctgagaagggggctgtcctccaagggaccagcatgatttcagctttctgatgattaagaaaatcatcaggatattggagtgtaatttaacatcctagtaggttaagttgaattcctgtccacatgatgaaaaagactttctatcagcccttctcacacttccaagtggagctcaatggaatgcttgtttatttctgttgccgataaatccatgggaaatctctgctgaacccagcaattttaaaaaagcaagttccagcttataattgcccgtataatggcaaacaggttattttcagtaacctaagactcttacatttccccccgcggttgttataggggttacatgaagatgttatgagcatgcatttgagcttacccacccccaactgaaatggaaagttatccttgggtgtctgatggaaaagattgttgccagataccttaggaggctataaaataacatgtttctgaaaagatcataactagtagacatgagtgtctatagctactatataatttttcattgttcctttaggaaagagacctactttgatcactacagtgtttacatttgttgtttatttgttgtatggtttttctgagtcttttttcttttctttttgctattgaaaatctcccttcatttaaatgaaatcacagactagaaatagcaatgattgctctctagggctaaaattagaaactacaagagactttttagacacatccctcttgtctcatggaaggttctgccgagttttctttaaaactcccacttaagcaattattgtaagatgatgtttactctgtaaaatagcatttttatttggacaatttttttccatcaagctttaatcatactttgccaatgcatattgaactttgtttctctgaggtgcctaaagggacatccaatacatttaccatcccttcaaagtctgtatacttagctctttgaacagtttcttaaaaaaataataataataaataaacaaaagctccaatggcacttgcaagagacaagactgggtcctgtgatgtgatggcagatggcagttgcatgagctttgtttatgctcagaacaagctcggtgtctcttaaattaatcatgaattgaataattgatttctcacaccttgggctgcatttaatcttcagctgtacatttaaagataggttatgattgaggtcttgttcacttggacgtcctttcaaagcctatcaagtgattttacagttgggtcatttctaatcgtaacacatattataaaatgtaatgacataaacttcgagctttcctggcttttcaatttccaagatgggcttcagtgaccttcccatttgttggtcagccccaaagatggtggggctaatggatacagtggtttttctgtaaatgtaattaaacgtgcctctgccagctgcctgtggtatttgtgaatgttttcgtaagaaaagctgttcttcgactttatctgcccactgtggtttgtggcatgttgtgctattctgcagccttgcagtttttttcctgaatgattgggctatgatgtcatgtgctatctcagcgcagaaccttttcaaagctttgctggggtctgtgtgcctgagcgaggggagtggaggctccctcagagcgcacttggtagcgactccccgtctactccagcacattccatcgcctggagaccaaagccaccaaatgatttgcggtcagagtgatttggggctggttagagatgatttaaaaggaaggttatgggcatatgaagtgtagcgtaaagaaaatatattttactactttattgagaccacatggctccaacttgaactttttttttaaacatggaaattgttggctgaactggctcacagtgttttttccctttttttcatttttattgctctgagcgaagagctgtactccctatttattatatgcttgacctctccattatttctgaaagtttgaaaagctttttatgtttaaagaaaacaggaaaacgtaggatttatctgttgtgctcttcaagggccaaataccattgccagagaagagacccaactctctccaataactgaaagaaggtttctttctcatgtcaagcttgggaagccatcagttatgaaagagacaagggccagtctgtcccagggtacccgagggccacagcatatcagtactgacagtgtatccatgtctcttgttgactgggagagatggttttgctcaacctcctaagggttcaatataccctacgattaataatggggccaaataaagcatggtcgatcttttccaatgccagaatggtgatgctagggctcagagaccaggggctccttctcattagcggtccatgggaacacataacacttgggtgcaacacttcgtttgtgagactaagcagccatctcctgcctctcctatgtgggctaccacaaactggcacagtaaaccacctattacctctgaacaggttcccaaatctctgtccagcatgaacttaaagtatctattatcacttcactctgtggctcaggttcatcctatttcaatcctcaaggcatatgccatagtctaatagtccattacaagctatcagatagccagctccaacttgcaattcggtgttatgacactagctagagaagtgccatggaaagcatgtttgtgagcatgcccagtcccttggcagccatcaacccagggtctgagggccatgactgtgatgtaatggaaggcctgagatcttcccaccaacccttcatggttgctggtctgtgatccatctgagccagcctggattcccgcagtttgagtctgtgtgtgtgtccagggatttaaaggaaaacatgtggagaccaaattagtgtggcacctgatgagaaaatcttatagaattggaaaaatgtcaagaaggcaacattgtatgatggaaatcaaactacattggaattgaggatcctggttttgccactatgtgaccttgaaccagctatttagtaatgtaacattgataaagcactgtattacatttgatcatttccttcccaaatatgacatgtgatcatcagaaccacatttggaagcaggtagggcaggtggcgttatttccattctgcaagtatggaaactggagctctagaggttaatgacttgctcaaggtcacaaagcatgtgagtggtagaatttgacctcaaactcagaacttctgccagacacggtggctcataagcatgagcctgtaatcccaacactttgagaggccaaggcaggaagatcacttgaggccaggagttctgacaccagcctgggcaacatagtgagaccccatccctgcaaaaaataaaattagcccagtgtggtggtgggtacctgtagtcctagctgcctaggaggcagaggcgagaagatcgcttgagctcagaaattcgaggctgcagtgaactactattgtgccactgccctctagcctgactgacagaatgagactctgtcccagaaagtaaacaaaaaaacccagaacttctaacttcaaatctcatgatctgtccaccatagcaagcagccctcacaattctcaacctctatagaactcactctcctcatttgcaaaaatgagacatttggcccagaaaattacaggccattccagcttaaaattctgtgtctgatgaatcactggctggaagggactttaagaaatcacttagtcatattccttgcttccagaaggactctatctaaactattttgaaaagaaaatatcagcccttttcttacagtcccagtgcagaaaagggccccagagagtgtccaagtgcatttgggagtgagaaagaaacgaggagctacagagccagtgctcagcagggtgatccatttcttgggctcagaagcagtgagtcttgcctccctggatgtgaatgttcagccctgagatcaatatctgaagtaggagaggagagtcacaagcatgctttgctggttagaaaggaagtctgtaagagagatcagaaaactggtaactctgtgaagaggaaaagaagagctaagtgactcagtaatgatcttaaagtttattaaggactcctggagagtgcgatgactacaaatcagtggtaatgtttctacttaaagatagaaacggcagaatcctgctcattcagcaggtgtgacaagcagaaagctatgctaatctagccttactttgcttgtatcggaggggttggtggcagaatgggagtgaaaggggcttctccctgaagacggtgcctaggagccccactccagtcttcccttctctctcagcacagttctcagccggctggtgtaccagttagtgtctagtaacctttctaggacaagggactaccagtagacaactaccagcaagcacagcaagttgcaagttcagtctcacattgctcagctaacccggttataattttaaaaactgatttggctccatgttcttcctatgtcactcccatgaaatagatgttactttttatttaaaaaaaaaaaaaagtagtgactgagatcagaagacaagtaattatcacaactctacaacttacagagcttagacaaggcatttcctactctgggtcttgatttctcatctgtgaaatgggctaacaatagccacttcaaagttaaatatttctgaggattagccaggcgcagtggctcacacctgtaatcctagcactttgggaggctaaggcaggtggatcacttgaggtcaggagtttgagaccagcctggccagcatggcgaaaccccatctgtactaaaaatacaaaaattagttgggcatggtggtgagtaccggtaatcccagctacccggttggctgagacaggagaattgcttgaaactgggaggcagaggttgcagtgagccaagattatgcctctgcactccagcctgagcaacagagggagaatacatctcaaaaaaaaaaaaaaaaaaaaaaaaattctgaggatcaaatggggaaacatagatgagcatgctgtgtaacagtttacatcattattaaaaggagtccaatttcaggcttttctgtaaaccacaaggtcacagatgtttctttttattctgccttaattccattcccaagccaaaatcagaatcacagcagtttatcctcacttactatgtgtcaagcacataaccacctttaatcctcacaaaaatattatgaagtagatatattacccctattttattatctggaaactatattctcacaaagataagcatcttgcccaagatcacatggctactaagtaacagagacaaagcggaaaccaaggctgtctcaaggcaaagctgtgctctcagaccttcagggctctgaagaactggggccctgtcctacctgagtacagccccagtcctcttggtttcaagttgcagttgatctcctggcaggccttccagggggtctcctcagctgttctgagtctagatcaggtcctttgcttagtcccttagctaaagcttcatcttaatccatagtttagtccattctggcggctataacgaagtaccataaactggatacattataaacaacagaggtttattgctcacagttctgaaggctgaaaagtccaaggtgaaggtgccggtagattcagtgtttggtgagggcccactttctggttcatagatggtgccttcttgctgtgatctcacgtattggaagaactaactagctcccttgggcctattttataggggcactaaccctattcatgaggctctaccctcataacctaatcacctcccagaaggccccacttcctaaataccatatgaatttgggagggggggcgggccataaacatccagaccatagcaatcagcttaccccgattcacactccaccgtctcctctctttttcctgtccttattcctaggtggcttgctgacccctctcatgttcctctcccactccacacattcctctttggaacatcctacattctcttccccacctttctctcagaagcagatacttccccataaggatcttgtacctctccccagttttcccagcccatgacattagcccatcaagcctagatcaaatgccaatttccccagcatgtttactgtgtttcctttcactggaaataaattttagcatgttaaagacagcctctatattacttatgaatatcacagaatgtgaattttcaaaactgtgaaaaccacagaagtcattgctcagttgcctttattttatagatgaggaaactgaggcccagacaagttaatttactgcccacagttataactgtaggctagagctggagctgattccaaatgcagtcagtattgttgtcaaaatagtttaaactgggcatgttattgtatccgcatcctccagtctggtgtggccccttggtcaaagtttggaaaggagtttcgcccttgccacaacagtctgattggactcagaccatgaatcataagaaatgttttcttttacttaaacctgttcactcctcaataggctacaaagaactattggccattcaactttttttttttttttttgagacggagtcttgctctgtcacccaggctggagtgcagtggtgtgatcttggctcactgcaagctccacctcccaggttcacaccattctcctgcctcagcctcctgagtagctgggactacaggcacccactaccacgcccagctaattttttgtattttttagtagagacggggtttcaccgtgttagccaggatggtctcgatcttctgacctcgtgatccgcccgcctcggccacccaaagtgctgggattataggcgtgagccaccgtgcccggcctgccactcaactttaatttgtggccaggaagagttaagtctccccttagcttgcctgtcttttaggttcaataataccagatctttttgctttttctcacagttcttgttctccaacaatttcatcatctttatttctatctgttgaactatatccaagtgctccatgcatctcaaactgtgaagtccagaagtggacaaagaagtctcatgaaggtatgagaaagtgacgatgacctcacaattccttcaaactgtgcttccgttggtgcggccaactttcatgctcgtgtttcaagcgatagccgggcctcactggctcaagttcagcgtattatcctcatttggctggacactgcttagcctgtgtttgtgataatgattgtttcctccatgtagcatccagaacttttccgattgagcttttttccctttgttcctgactactactccaattcatcaactcatttgggactctaatcctattcttccacctcttaattcttaaccccagctactgtcccaagtagcttagcacattaaaagtccctggaattcacccctgagacttctggcccctcaaagcacttctccctcatggctccaggattggataaagccagtagtccatctcccagtacacacaaggcactcacacaaggttataagttctggataaaataagagatcaccagaaagccttccaagaggcatgtagctaagggtcattacatgggtagattcagagataactgactacacttagacctaacttgggtatgatggtgggagtctccaagattttcctttggctcagaaatgtgataattatgaatatttgcacttataaatcacttatctccattagcgtaagctacacttataatgatatacattaccccagtttacagatgaagaaattaaggctcagtgaggttaaggtcacacagcccagattagtacttatgtttcctgtctttaaattccttgaactttctgtatttcagcaggttttaaaatcttagaattcctaaaaatcccgtgtgtgagttgggtatggtgcttttgaaaaatagagattccaggccgggcacggtggcctacgcctgtaatcccaacactttgggaggtcgaggtgggcggatcatgaggtcaggagatcgagaccatcctggctaacacagtgaaaccccgtctctactaaaaatacaaaaaattagccaggcgtggcggcatgtgcctgtagtcccagctactcgagaggctgaggcaggagaatggcatgaacctgggaggcggagcttgtaatgagccaagattgcaccacggcactccagcctgggcgacagagcgagactccatctcaaaaaaaaaaaaaaagagagagattctagggccctggctctaagacatactgattgcttaagtctgagtggagccctgggatctgcgttttaataagcaccgtagagggttttgagtaagcctttgcatgccatacttgaagaaaccctctcctaaactatgctgtctaggccagaccctttaaatactacagatctacctttgccctgggataaagctggcacataaaaaccagccacagaaacctcctgatccagacagtagctcagagggctctctgatgaccctaagacccaggactgtggtgctcagagcctgccaccaaccctggttccgtcctgtttttgtcctcttcagttttgctgacgcattgaactcctctctttagagcactctgctttgatcccactcaggtcttagatatgctctcacccctgattttgtcggcctcggctgctccagatgagaaagcctatctccctaaggcctttccagatgccgctgtaaaatggatctgaaacctgactcatgagagacaatctgaagactttatctggggaactttctactcccgtgcaccccagctgggcaacatttacaaactgctctgagggaaagcttcacagccagtttccccagagaggcatagtggttcttacagtcctactaaactaagtttacaatctattgttcctgaaaaaccagatactccaggaggcggatagatgactagggaatggacagcgcaatgaatgttgattgggcatgcacagtacacaggcactgcactgatttctttccatgagttgtgtcttcgtctcctttcacccataaggagcacagccaggatggtttcacctggtgcctgctctctactcccagggcacttagggattgtgtgttccttggattacaaacatagccctgctacctacacatccctcgggtctttcaggatcacaaaatgtgcaagtggtctctggctggattctcttatgtgtgttttatcaaggaacaagtagattcctgatgaaaaaaagtttttagactgaaagcagactaacagagtggttgaaaattgacatgggacgcaaccgaactcccagtcttggtagacacattccacttactgcctcttctctattcccttttccaagtgcaggaatcttcttttttatttttatttatgtatttattttattttatatttttgagatggagtttcactgttttgcccaggctggagtgaagtggcgcgatcttagcttactgcaatctctgcctcctgggttcaagcgatcctcctgcctcagcctcccgagtagctgggattataggcgcccgccaccacgcccagctaatttttgtatttttaatagagataaggtttcaccctgttggccaggctggtctcaaactcctgacctcaggcgatccacccgccttggtctcccaaagtgctgggattacagacatgagccaccacgcctggcaggcatcttctgctcaataggcttgagtcttcctgcactttttcagaagcaaatccagcttgtgatagtggggcagcatgcaataacatatgctggcagcaaatcccaacacagtgggaagaaactgcttttcctgtacattcgtctctactgtcttgtgacaatctgaagagaaattcccaaacataagtctcctgagtgattgtcaggtgtataccttgccttattgttagcagacgtgaaagctctttgagaagacagcaaagtatttggagctggaaggaaaggggtgtttggagccttgttagagaccagctgtagagccttagaatgttctctatataggaaagcttacattgtgctgaaagaaacagttgcctattgggttataacttggcgagttatgtaatgatacaaatgttggatgacttgttaaaggatctgagagcattatggcaaaattctataccctatccttaattagatcaagttaaactgaaagggaaaagcagtctggtttgctaaccacagtggaagtattgctttcgggtggaattcatatccggattgcattgtctggcttgaggataatacacaggaagcaatctggagtttttctttcttttggttttgatatttcagttacaaggaacttgaagtctaggaactggctttgcaatgttaacagttatcacagccagctagccaaaatgtccctgtttaagatcttgctgtttatcataacatgaagtgtgctctatgccgtgtatgatttccaatacacatgtgttagtaattactaccaatatgagtatctacccagccattaatcaaggcacccaacacatcctgccaatgtactttgaaactttatctgctgaaaaagcaaaattcccctccgctaatgaacacttttaggaaagcaggctggttaagagtgtctgaagcatttgagtgacagctccagagaactcccatttatgaccgcaggtgacctagcaaaaactgggaaatataagcacagttctacattttagtttctcctaaagatcatcagtttaataataacagttggcctttactgagccctgatcaaaagtctcttgacatgttttttctcctttaataatcccaggacataaggtctgttaatatccctacttcccgattaggaaactgaagctcagagaggctaagtagtttgcaaaaattcattcatggaggaaatgacagagccagggtactaaccctggtgtgctgactccggaactcatgcttcttggattccattcttctttcaaaaccgcttggtgcctccaaagagaaaaatggtttggtaattagtcccatttgcttccagtgatgaagaggaactctttgatgttgatatcttttttttttttttttaatggaatctcactcttgtcatccaggctggagtgcagtggtgcaatcttggctctctgcaacctccacctcccgggttcaagtgattctgttgcctcagcctcccatgtagctgggattacaggcgcctccaccaagaatggctaatttttgtatttttagtagagatggggtttcaacatgttggccaggctggtcttgaactcctgatctcaactgatcctcctgcctccagccacccaatgtgctgggattacaggcgtgagccactgcacgtggccggatgttgatatctttcaaacatttattgagcactgaccttgtcccaaggggttaaacagaccatatcactgaatccacccaataaacaaataaggtaggttgtagcatctctgttttactgtcaagtaaccacctgttccgtcccatcatccagcgttgcccctgtggccctaagggttgaccgactttctgtttgagtggagtatgtaaataggaccaaaaagccatgtggtagttgtaggagagaggacacagcaatggaagcccaaaagtgtggttctcatcctggacaccatcattcgtgataactctcttcatctcctctgtacctgtgttcctttttcgtgcctatagtatttcctttaactaaagtggaagtgttatctgaagtttcatgaaaatagcatatgcatcagaaatagggagatatcagctgggtgcagtggctcacgcctataatcccagcactttggaaggccgaggcaggcggatcactggaggtcaggagttcaagaccagcctggccaatatggaaaccctgtctctactaaaaacacaaaaattagccgggcatggtggtgggcgcctgtaatcccagctactcgggaagctgaggcatgagaattgcttgaacccaggaggaggttgcagtgagctgagatcacaccagtgcactccagcctgggtgacagtgtgcgacacagtctcaaaaaaaaaaaaaaaggaaatagggagaaagatattttttctaattcaggatcttccactaaatatcagtattcaaattatgtagcctttttgaccctcagtatcccaatccgtaaaatgaaggcaatagtacccagctctaaatgttgttgtaaagattaaatgagacaacacctatggtatgtgcagcacagtacctgatatgtatcagtagtagggccctttaaatgtcacttctgtccctcttctcaactccccacctcaccacccgtattagtaagtagtgcttacaatacagataagatggggtgtttgcgaacagcgtcgtgccatccacagtgtcacttatcgggcggcaatatcaagtagtggttaaactctttgaatccctttaagtagactgatgaagttgaaatctctgctccaccatttcctgtgtgactttgagacatttattgaacctccctgggcctcagtttcctctttctttaaaatgggttagtacttctctcatggggtttctgagagggctgaattcattatatactacattcacttagaaaatacctggcccagagtgaacacttattcgatgttagctgccattattattagttatttatttatctctgtgacctcttgtaagcttattaaaggagctgtgcagagtgagaccatgaaacagattttctagtgcaaacggggctgctcacaggaggctcgtggagtctgagttgctgaccttggccccattagcaccgttctctaaccagctcaggcacggggctgtaatgaggattattgaagtaacatatggaaaactcttagagttagctcttgggaaaggaaaaaggcactaaataaatacaaggaattattaaaaaccgggagacgacctcacagggatgctgagccttgtatgttatttgctattctaagaagaaactggggcaagaagccaacttcatcaccaggcgacaaagtggtctcctggctgctgttcaagggatggcagcatgcagcatcacctccaggccatcacagcctcttcctggctgcaggaagctcagctttcccacgaaaaagaagggctgggtcctatgccagatgctatgcctgctgcctcccatatctcgtgcccaaatacccctcctttgaggagagctgggaggtgatattctaagtgagaacctaccaagtagaatattgatggtaaattccctctggtactagtgcagatgacttcggggccaccagcaatctgcttccacagcaggactccagtcccagactgggccaagctcggggcttcgttgccaagccttaacaagtatgtggagagcacacagctctgtaattctggagataacagtccatcagtctctacttacaactttaccacccacccctgtgacattcctctctccagaaccaatcctaaccctcaaatgaaatatacttaaagtggtctccaggtatcacttgtgaaatggtgcacaggaggcatccaagaatgaatcaagatctggcccacagccaccacacagcttggggcctctggtttccccgtggtatcagtggcataagattaatttctatggctccaagcaatgattacagaaacatcctatttctctttgctacaaaatagagaatatcttagccatgatgtcttacactataaaatcttagaagatgaggatagtgtctaagtctcatcactcaagaatatagcacttcatgacatgtacctttatttatacttttctggtaacaatatagttttaaaatactcaaggcctttctaaataatggtataaatatgatatctcaatcctcaaaactaccaacaaatttaaggtatttataacacatacaaccaatacttatgcataaatattataaaaacatggcctacctctcaatgtgcatagcaaaaatagtttggaaaagaaaaaacagaaataaaaattccaccactcaaaataaaaaatagttatctttccttcttcaaccagtttcaaagatgctacattaaccatccactatgaaagggatcaaacatttcagcagccttttaaacctagaagaagtccttaaaaatgtaaagattagacagtagaatattttctctggcatttaagatttttgaagggtctagttaggatctagtaagttcttcagaaaggttaggctgactataaagacaacactgcaaaatttagaagattctctagttcacttactacaatggactgtgttttttcttagagatcaggattaattattaaaatatttaaagaaaaagatgtttctaaggctgctaggaagacaaatcataacagtagatcccaataataagcctatgtgtaaaacagtctcttaaaaaagaggtggcatgtggccgggcgtgtagctcatgcctgtaatcccagcactttgggaggccaaggcaggcacgtcatctgaggtcaggagttcgagaccagcctggccaatatggtgaaaccccgtctctactaaaaatacaaaaattagctgggcatggtagtgcacacctgtaatctcagctactccggaggctgagacagaagaatagcttgaaccctggaggcggaggcagcagtgagcggagattgtgccattgtactccagcctgggtgacagagcccgactctgtctcaaaaaaaaaaaaaaaaaaaaaagaagtggcatgcatatttaaaagtagttacaaagaaagtcttggcagtttttcagagctcccttcatgtaatcactctattacagtgcactcctcaagttgaaaagctcccatttatttaacatttttttaaagaattaaatattttccttatttatccaatttgcaaacgtaaagcaaggctgcatcatctctcctttttccgcatccttctttccgtccactaaggtagttctctgggactgttgacagcttctgaaggtgatttgatgtgaactcccccctgactcctggtttgtctgcttcttataaagagatagtatgctccagagagcaccagaggcagttcttacccagcaatcccggaagcaattttcttctgcttttcttactcaccagagccctcctggaggtttcaagcaaaggagctgagcagtttgcagtagctactagatagaggttcataatggaatagcagcttcaggtttttaatccatcattagaaatagttgttttgcaacttgagagagaaaaagtagaaatctatggcataatgaagggggaaaaatgggtcatgttactgtagagatagatgcaaattctatattatgtcataagtgaaagctttttcggtccatatgggtataaattaataagagagaatgctgtcagcgaagaaagtgtaagtactttgtctggagagtaagagaccggccagttagtcctaataaatccgagggtttggggagcctcttttgagataggtgatgcattgcgcattattagagaatctcttggcatgagtacttttgcaccaagcatctgcttttaaggtctcttcatgaatgttcttcttatgtgctgatatctttatgcttacacaaacttggtggaaggcactattgttgcatcattaaattacctcactgtattctacaactaccctacctaatatgctccaatcactcttactgtattttgttttcttcataacatttccctgtctgaaattattttattcatgtggtatcatttaagtgcttattatctctctcaccctgctcccatcaccactggagtaaaagctgtaagtagacaccttgtcatcttctcctgtatatgcaagtttccattttgtttcataattagcttctctctcctcccagcaaggttttcaagatccaacccaaagactgcttaaggagtggaacttagacttcttttacttcttcaagagtcacttcatggataaaaagcatcctgttcttgggactttgactcagcagagccaagaactttcctataagctattgcttggttgttaaggaagcacaacagaataccagcctgacgtgtcacattctgcatgcgctcatttataatacagtgtggtatttttcacctcctatctgcagcaagatgagataatcgctggctggtgtgagtttttttagtatctctttgcatcaatagatctagttttcagactatatacttaagtttataaaacaattgctaacatttgttttctttaatcagattcaatttgattcttattaagaccatgttttagaaagcccccaatggccctcataatagtgggaagttttagaaacaaaggccaatattatgaacacattaatatataacccaggtgtcatggaagtgctctcaaataggaaacgtggaagacattagttgcctgcatcccaagtcagagacttattttcttaatttgctttctgtgcctccacaatggtctttttccttagctttggaaagaaattataacagccagctaactttattgggtaacatgcatcaagccccatagcagaggttagatatgcattaccttgtttgcataacaaccttatgaggaaggtactaataaaatatgggtataaaagacctccatagttaaggaatgaggaaataataatgcaagtctcttttcctacaacataatggtcctaaaacgtatgtatttctttgcatcttttaaaatgcagcataaatggggtattctaatatcattttgtttttcttcaggtttctcttttgtacattttaataagtttaaaatatataaagtggccaggcatggtggctcacgcctgtaatcccagcactttgggaggctgaggcgggcacctgaggtcaggagttcgagactagcctggccaacatggtgaaaccccatctctactaaaagtacaaaaattaaccaggcatggtggtggatgcttgtaatcccagctactcaggaggctgaggcgggagaattgcttgaacccaggaggcggaggttgcagtgagctgagatcacaccactgcactccagcctaggcgacgagagtgagactccatctgaaagaaaagaaaagaaaaaaaagaaaaagaaaagagaaagatttatatttgcttgcagtgaaaataaatgcagaattttccacagtgaaaagttaaagtttttctctaacttcttccctcagcctctgtccctcctctcaagataagttacaaccctccaaaaatatattgttcagtgaaaccacgatggtatagaatagaagtctacagttagtctacgatgtgttgttgacagctgcgtctaacattctttttaaagattgcatagtatttcattatgcaggataccataatggccgtttcctttttgatggacatttaggccaagttttcctttgtgaaaagtgctgaaatgaacattcttgtctttcctgtgtctttgtgtccttttgtgagtaaattaagcacaacttcttagaaatgaaactgctgggtcaattgtatatgtatcctaaattttgtcaaattctttttttaacagcttacaccaaattatattcccacattggttatagcaattttcaatattatgagttttggcttgtattttaaatatcttcattttccttttagatgttcacatagctcccaactggaaaactgtacccataccctgccaccatctccaccaagaaccctcttgccctatgcatatcatatgtgtataacagtattaccaagtataatagtactttctgaatatccctttctttcctcctttatgtaaaatatgtacaatctgatgatattatttgctaaatacataaatgtatttacagatggctttctaaagactaagtgatataatccaaactttagaaaatcagattttgctcacaaggggtttggaaagtgccttttcaggatcgtaattaaacttagctaattgtaattccaagattgatgcaagaaggcaaaaggttcaagaatgaagtcaatttttcctgaggttaggactaaatctgtaaattctggttatatgaatcgctaaagaattattgcgcagggatcaataaatcacttctaaagcagtgttagaaggctgttccacctcctcagtatactagttattaggctcaagagtgttgggcaaactggttcttttagcttttaacattgcagtaaatggcttggcaacagatttaacattttctttgtaacatccaaggttagctctttttttttccttaagatctggaatgttcccaacacaaagaaatgataaatgtttgaggtgagggacattccagtcactctaactggatcactacctgtcacaaacatgcatcaaagtaacacttacaccctagaagtgtgaacagtcaccatgtatcaattaaacaaacaaaaaagcccagcccgaccttggaccaattaaaacagaatctctgaagatggaactctttttttttcccccccgcaaggttagctctttagtcactggccagaaaacctctaatcccagcagaattttagagctattaagtactttagttcttagccacttagaaatcacaatgacataatgatgctttacaagaagaagaggtaggggaggagggaagaatttctactcctcctcctcagtgacatgagagtaaagaagaaaaatgagaggttataaccatgaatatctgcatgttatgtttacttgaacaaaaatgcaaattttatctcttattgaaaagaattgtttttgaacaaaagtgaatagctaaaaatagtgattctgtacaaccaactgagggactggttttcctttagtttttttgtatttgtttgtttgctttgtttttgttttggcttctcaacactgagcatagctggtggggcagaggcagattcaacactccacaccctctcaggagggtaggctctgagggttaaaatgttgaggggcagatgtcgcttgtgaagcgtcacataccgcgtgaccatggcagagagttccttgagcagtgaaaagcactttcctttcccaacagatagtcttatgtgtgcaccaatcccaagcagaaatcatgattttctttactctataggtgataagcatgagattcttccccaagaagaatgctgaaaaatcagaaaggatataaaaatggaggaaggggtgggatattcaggaaactaccaaaatatgtacatgtgaaaataaatttcatgaaactgattctttggttaaatagcgttttaaaaatctcttcaaagctctcaaatgggcctttgaaaaattaaattacaccacattggatctgaatttagcatgtaattttctaacacatttttatttttttattttttatatgtttttaattatactttaagttctagggtacatgtgcacaacgtgcaggttaacacaaacattttaaagttagaggttctacgtcaatgaaataaggctaaaacatgaaccttgggaagaaacattggaaactttagtacaaaggaagttacgaatgaatatgattaagtttagaaagctttcctaggagaggaaatgtgagatgttgattcaggttttcgttcaaagaatgaaagcattatttaaaatatattttgtgatgcaaacagggaaacatcatagtatttttgtgtgtgtgtgctgaatctaagctccattttacagctagtgtgtccccaataaaccatcctaattagaaagcccctggaaatctccagcattatcttaattaaattagcctaatctaataaatgcatcataattaagaggactgtgccattctttagtgttcagcacaccaggcattagatgatttgtcccactttcagccgtcagttgtcatgcttgctaaaagaaaagaaaaatgatagcaccagtcatcgtagtccctcaaggaatcatccatctagttcttgaattttctttacaacacctctgtcaattatttcttcctcttcagagcatctagtgacagggaactcactaagccattttgatctatttcatctttgaacatatggaataattttagccataagaaacctcagggaattttttttaattccttcaacatagacctaacatagtacccagacaactatttttacgtccaatttcaaacaacctggaaaaacagcggatcagtggaacactaaaggctatagggagactatgatcattcttgcccaaaggaattgcaaaaaggcaggtgtgtaaatagtatttacatataggatggacctctccacctttttctagtacagattaatttttaattttcccaacatctataaattgccagaatggtaaggtagtggggaaacactttctcacaatgtacacagacttgaaagctgttgacctgtcctccttatgacagacagttcttggcaaccccaaggagagatatggctgaggcagaaatcacattatctagctcttcggctatacacatattgggctctgataattagaacattgatccacaagacaacctttgagtatgctgttcttttccttcacagcaaacacgtatagtcattatcgtttgcttgtttgtttgtttgtttctttctttctttcttttttgagacagagtctcatctggagactcccaggctggagtgcagctcactgcaacctctgcctcccgggttcacgccattctcctgcctcagccttctgagtagctgggactacaggcacccgccaccatgcccagctaatttttcgtatttttagtagagacagggtttcaccatgttagccaggatggtctcgatctcctgacctcatgatccgcccacctcgacctcccaaagtgctgagattacaggcatgagatcagttattttttttttaagacacagagtctcactgtgttgcccaggctggcttcaaactcctgggctcaagcaatccttcaacctcagccttctaagtagctgggactacacatggctcatcagtgataattttaaacacaaaaatacacatttttatttgcttatgcaaacaaaggaacgattataatttcctgcaactagtaaatatcatatgctaaatcctttttttctaattccacctcttccccaccacaccatgtaatagctttagagttgttttttttggggaggagggaaggggtgttatgtgtatttttttgtcttttgccaagtctctaagtgcctctgaagccaatttttaaaagttgtgcattgtgagatcacagttgctttagggcatacaggatataagcacaaaatgatggactgtagccaggtagtgaggctctaattgtgtcagaaagaagaacattttcatcatgacataacgaaaactgtatttttcaaagaaaaagatctaaatctgtatcaagtgataacattagttttcctacttttaaaaacaaaatctagtctattattaatagaatgaaatgtcagccttaggcaatttgctgtgaaaaaccaactgaaatgaaacatggcattttattcgttattcaaatggccaaataaaacaaggtgtaattagtcctgacttcctgttcttgctcacacacctgaggcccctccccgctctgctgcagctctgcataaccaggctctcaggggaagcagtggaggcagccttcttggacaacagctcacttgtctacacagtcaaaagtatgtatttgatcaaaatggttgggaggaggacaggtgttacttagagaattacctgtgtaactagaacaagaaaaggaggcagcatttgcagaatgtttgcaaatctttcaggaacttgattcaaggagtgtgtcagatgttaaatccaggcatatatgtatatggctacttgtgtgtgtgtgtgtgtgtgtaatagtgtaatttcacttttttaaaaaatgaagacattcacaattttagccagaatagttggtgcaaggtccataagtgctacctgctaagaatataattccttctacctctaatgtttcattatcaaattaaaagagttctctcctcagtggatacttcatttatcatagctctccttggaaagctgacctctaaacatgaacttctagaaggaacacagaataagaacaagggaaaagcattcgggaaggagggtggctttgaaaggagttagctgggaaaacccttgaaaaagaaagtgaatccatttctgtacatacaattattgactgacggggcagtttacagttttaagttcgtgtgcactcatgccctgtttgagatgcctgttttgtggttcctcagagaccacactagccacatttgaacaccattagattagactagagccaggactctgcaaagggaggctcttcctcagcctctgacagaatcaccaccaaatctggctgtcctccttgccctgagcaattgaacttggctctgtggagggagcctcaaccaactgaagcatcatttggagaacagatgaaaaataaagaagcgaagccttttgaattctaaagttttagctttttccaaaagtaaggcattttcctctcattctcaatctcttcttccattcagttttctcctcccatattcttagtcgtgattacatagattaaggcaaggaactgggggtttcactaatgaactcggggaaattttgagggacatctcctgtcctttgactttggggaaagttcttccattgctaaggaaaaaagttgtattggatgtaattgtttgttaaatgcaaagaactaactgctgggcattctaggagtccgtacatgaactgttttacgtgggtttctgcaattccatagagtcgaagacaccaataggagctgtggcccctttgcctagtttgactttagtcctttggagtttcataattctgaggggatcattgtatttcagtggacaggttccaaatgcacagaagactgacagcattgtctgataaagcatctcccattttatcccatttggaatgtaatccaagttacaacaatagctaataattacctgctgtaattgtagcaacagaatagctgaatgtgcacctctagctgatttatgtatgcaatttctcattctcagctctctataatccattctccacccccccaccccccacccccaacgctttggagccttgaaagcattcaatacaaattttcacaatgtaggtaactttgaagtgtggcttgtcaggtcatgctgacttatttttgtacttgcatagggaattggtgaggatgaatctatttttttagctaacaagtgtaacttgagaatttgtgaatgagtgacagatggggtgggaacctttttttccttcacgtattgtgaaatgtactcctgtctactcatgggaatgagtcacatttgcaaaaagccataatattcattagtgccaaaacgacattttttagttgctcttgcaatgagctgtaagtaggacaactgcccatcctagtttacccgaaacagttattatttattcctataattatcaatggttacctatttatttcatcctcagaaatgtcccggcttgggcaatatatgtttaccctgcatatccagattgtggggggaaatccagtattttcatgtgccatgcccaaatggcagcttatttaaaaaaacagaaaattcttggaattaacggtcaaggatacgtgagagattagaaatcaacatttcacattaattcctgtgtaagaaaattatacgtaaacatagactgttaaaacaggcatagcaaatatgtttcaactcaggggccaacactaattggttggtagtggctgcccctagcatcactggagaaggactctgaaaccgagttggggatcaatgggatatagggcttgccgtattactgatgtctgccataagctctggaaaagctagttgtaaaatgtatgctaggtattaaatgtcaccaccatagagccagatgaggttttagtgataatccaacccagtgttttcaaaatgtgttcccagaacactgatccttcaacatgattcacagaacacatgttccatggtccagtaagattgagaatgatgcctgccatatttctctctcagaaattcagtgtatattggcacagagctctaaaaagttctgtttaactttctgacagatgtttaactttgtttaacccagtgcttggtaaacctatttggccacagaaaccttttcaatgttatctgtcaacttgctacagaactagtttcttggtacacatttgaggaaactctagtcttagcccattccttgcatttcacgaataaggaaactataaccccaaatgagagactgactggaccacagtcaacttagttgatctatggaccaggcaaaactggaactcagtgatataagagttaagaagaaattatttaggcagatagtgagggtataggagtccttggtaaggttttccttttaatgaaaagcagccccaaaattatactaacgagcagcctgtaaaattgagctgcagacacagacaagcaagcgggaagcttgcatgggtgaatgccagcagttgtgccaataggaacaggcacctgagactaggcatgttcaaaatggcagctccaccttcccttttctttgccagccacatgtacagtaaggagcagatgacatgggctagccaagtggaaagcccatttgcataataagattagggtggggtggccagccttcccaaaacgtcacacctggtccaaccaatctgtgggccctacgtaaatcggacaccaccacctcaaacctgcctataaaatccagtgcactcccattcgggagcccctctgtctcaaaaaaagagagagagctgttctcctttatctttctttcgcctattaaacctttgcttctaaacccactccttgtgtgtgtccatgtccttcatctttttggtgcaaaacaacgacgaaccccaggtatttaccccagacaatgaggctgcttcatcagaactgctgactccaagtcctaggtcctttccactgcatcaacaatgaggaaaatattagaagcaatctaagattttaatagcttctggcagcacagatatttagtagatttcacttatctatttttataggttttggttttttgttggtggtgggtttttatttggtttttttttttttttttgtgatgagatcttgctttgtcactcaggctagagtgcagtggcacaatcatagctcactgctgcctcgaattcctgggctcaagtgatcctcccacctcagcctcctgagtacctgggactactgacacgtgccaccatgcccagttagttttcaaattttttttgtagagacagggtcttgtcatcttgcccagactggtctctaactcctgggctgaagtgatccttccaccttggcctcctaaagtgctgggattataggcgtgagccaccatgcccagcctgtatttgtttttaaaagatggtaaataaatatctgtatattcctagtgtcagacactaagctacctctcatggtcaaaaagaaaaaaaaaaggcaagataaaatcatttttgtagttgagttttatctgggctggtccatccttctattttatcctttttccttaggagataaagtggttatttgaggaaagacttgctagacatgaatctggttttggttcaaattctattttattatttcctgggctttgaatttcaaaaagccaatctatttattggtctctttggggccataaggttaaagtacatctgttgtccacacaaatttagctattggccttcgagctaagcagtcatgaaattatagccatagtaaatttagacaacgattaatttcacttcggtctgcctataagtccacatgacagaataaacatagtgtgtcatgtggttaatgtgaacacatgtaaaaaattaagaaatctttggtgaccagacaaaaaatactccataaaaattaattagtgtttcattgtggatgtatgaaatgcaatacttatagatggcctgacttggagcttaggcagcaacaaaacttatcttgggcatcactttcaaatttcgttttggtggttctccagttcgtggcagaccactgccattcctttgaggaaaaggaacacctggaaaatataaccattgctgaagcacttatctctctggggttttttcctaccctttattttcattattataccattacagaaactggttgcttcagttttcttcaagtatggacttcatgaagccatgtggttgcatgtgctttgggaggaggaggcagctgggggctaaatttgccatcctgaaatcacccgtgacatccctttgaagatacattttgtcaggaagcacaaatcagtgaagttgtgaggaagaaatggagagacatctttcaacataaccttgtttccccttgagcataaaggaattgatttaaaggagaaaataaagactcaacagtttttaaaggcttttatttaataagcacctgattgtttccattaactggcttttaacatttaccattttgcttagcaaagttggagaacattagccaagattcactgatgaaactttataagcgttataagtcagatttgtttcattttaaaagccacatgtttaaaatacagtgcacagagaattttcatgatacgtagttgtggttcaataaaataaagatagccaaaagaaactgtcactcataaaatctatatttcctgctaagtgttagtattaaaatagatactgctagtcaacttgtaagccaagcaatgccatatgtgattttttaacataagctatttgtagtctatactagaaagtgtatcttagactttgcagtgatttgttggttcctttcattaatcatgaatttattatcataaaaatcaacacccatgaccctatcttggagaatcggagtgttctgagcattcccagatgtgtactgcagctccagtatacagttcagagccccactgccagttgccaggatcacaagagaaagatattagtagaccacgtcagggaggtgaatttttaaatgttcttacaccacccaagaatggaagtgactggtggttttcaaggacagccatttggtctgaagcagctgcagccccttgattttaattatcctcctgaccctttgatccctaaccaaaaaggccctaggactgtggacagatgcagccactctcctttaacaactggactcagaccaagtcagcagtcacatttaacctcaccttgaaatgtagaaagtgaacaattacatattgaacattttcatgtaaaacatcttcttgaatttcaatccagccacatcctgctagtgcgataatgtgatccttgaatttttggcaccatctaatttttaagctggaatgtttggaaaatccttacggggagggaggaatcattatgcaacaacaacaatacacacacacacacacatatgtatgtgtacgtatacatatttataaaaaacaatttcaaaatcccagcacagaatagtataaagaaatatgccatcttacagaactataatgttacaatcctttttccttttatgtactataatcctttatgaacaaggaaaattcaatactggagaatattatctcctctccaacaaattgacttcaacttgagtattatatccaaagaaacttaatctgtaagtatgaagctatacccaactttgaaagatttttgaagcagtacaagtttctttcttcttcctcttttttttttttccttttttttgagacagagtctcgctctgtcacccaggctggagtgcagtggcacgatcttgactcactgcaaccttcacctcccgggttcacgccattctcctgcctcagcctcctgagtagctgggactacaggcatgcaccaccatgcccggctaatttttgtatttttagtagagacggggtttcaccatgctggccaggctggtcttgcttgaactcctgaccttgtgatctgcccgcctcggcctcccaaagtgctgggattacaggcttgagccaccatgcctggtgcaatacaggtttctatgtgatggaaaaatctaagctcattaggtaaaatatagtcattgtatttccttatgtctacaattggattttcttctccgttagcccctgctactagtctcatgaactaagaaacctggcttagctgacatctatgcttccagtcgattcctgcattgcggttgaagtgaaaaaagccccttgatgaatgaatgaataattgattgatgaatgaatgaatgaatgagtatgactagatcttctaatccttttacattttatttccaattagtacaaggtaattttcatacgctgtttatggtcttgaaatctgacagccagtcccaactggtttattcttatattagcaacttaattcttttgaaggggcatgtaccatgcccactaattttgcaaggtttggctctccagtttccctcagctccttgtttgtgtggcaattacatagctatttaacagctgcactagaaattaaagaggaagaatcagtaggctttgttaaaacatgtgtctatccatagatacatgttttgatgaaagatgaaagccaaaagcattaaggaaaatgaaattttggagactacgtggtttttattgtttgtgttcttatttttaattgctatagataaatgagagttgctgtatctaaaaatataatgacaactacttcacaaggtacttgtgaaaataaaataaggtcatatttgcatataatatgcattcaataaatattctctttcccttaatttgaatttttataagtccttaagaattgtcattgttcccaaatattgtatgatctttccatcctaattatgagatcataattacatatttttatgattttatggcagaaaataaaaaatgtgattgaagttgaaatttatcagaagttcagaatgggaatgtagataataagattttaattttttgatatgctacccagatactattcactagataaaaggcttccaggtattcaaaatggaatgaataaatgtccgagggggttctcaagtcaaattttacttgagtggattctctcttagccacattccacccacactcctctctcaatcaaaacccctctccactcttagcccatagcaattaaacagggctttcaggatctggaggaaagtgagaatgtatcccctagaaagagatcaaattgaggatggcaaatgtgtttcatttcagccttcaactttagttgctttgtagccttaaacagctgtgctgaggattctcagacattctgtctcactagcaaagaacattctgatgagtgagtgatgtctgccacaggaagaagggggatagtgtccttgcctgtgccatgcatttaccaaacctatacttcatcctattttgtatgtttcactgtttagcttgtcaccctagtatctctttccctaaatgataccagcaacaagaatttaatgtgagagaaatttcaagaggtcaaaatttaaccaacagatctcctcccatttacctctttagagaatagtaaatgttttgagttctttgccaggaagctggtggaattatgacctttgagaaactgaactaaacaaacatgactgtagcacacccatctcgtccaatgtgtggtgccaaacttcaaaactctaagattctgttagtttagacaagaaggtgatgcatctttaatcagctacatgaagagtggatgaggcagatttccttttctcatatatgcactaactagattattttcagtttaattttatgctttttaaatgcacttcagtttgagttggtgaaagtctataagcctctctccatatatattttaaagcacaaactgtggccgatattaaactatttgttcagtcctttcttcatctgtaagcatattcttctttgataagctcaatggcaatgtgccctgtttgaaaatgtaggtttgactgctattcggatgtggtgaggtcaacagattaggagatgactgtcattggaaagatactaaatagtttgttattcatagttcccaagaggagggggcatgccacaccacaggggactgcaggggacgtgccagggtcagtcagaaggccaaggagcaagggggaaatgtggacaggtgcctttgcctaggaacccacaggaaagggataggtgaggcaaggtacgcagggttagaactgcctgttttgagtaattccagtgggttctcaagcacaggggctgtttctggttgtctggtatctggccctgggttgatgtggggagggaagttgtggccctgagtatgagagcccaatagagggggtgcagagtgtgtgggctctggactggttagtttgcatatggagggcatgctcccaggagggtctttaacacctctaggaactggctaaccctgggatgggcagtccctgcagggtcagcaatgtcctagatgcaaaattgaatgcatgcaaaattatgttctttttgtatgtttctctctgtactcaaaaataattaacctcattcatttgataattgatcatttgtccctttctgatatcgtctgtattgtttcctcatgccattatttgatatcaaatgtatttatgccaatttccccaactagaaatcaactacttcttgattgtttaaaaaaaatgcaatttttaacttttaaaattgatccatagagtattgaacatagttgatgctttaaaatatttattatcagccccacattactttagaacatgcatccgatgaaataacaaatagtgaagaaatctgtgctctaatagatttgtaaaatgctacatacatattacatctccctccttgatgtttgcaattcacatttccttatttaaggccctgggaaggcctgcagcaaagaaatttgtttaacgttgtctcaatccagccatttactaaacttatttgaccatgaaattttttctcattgagtacctgctaacaacccgtgaatatgttgcagaatgcttttctgtactgtttcttccatggaatttgtactttaaaaaaataaattaagactgattataaactgagtgatgatgagtttaaggctaaagaaaataatcagtaagtgctataaagtgcttgaaatataccttaatactggcagaaaagttaagacaatgaatgcattttctgcctcagtctaactcatctatttagtcatctgaaatggctcattatgtaataaaactcttcagcaaccgcatatggcaaaatgattggtgcttgtaaaccactaggctgacctgtttttgctttttaaatatgcatgttttttgttctccacctcagtgaataaaattgaaacagcatctcagattgtaatacataggagaaataatgcagagaaaagaataaatttgcccagtaaggtataagtaaaataattagcatgagccatgcatattgctttcagggaaagcaactgacagccagggaaagtcagttattgacgtaagtgcctgtcaagtcaccagttctatgttgttaaaatgtggtaagttagggtgtgacccaagaggaggaggaaaaaaaaaaaaaaaaaaccctgcaaatattttgatggcaggctctccctaaaaacaaaaagggcagcatagtttctggccagtatttagatcagtgtgtgtttgatctatgattggaatcatttgctcaatggaactagcaatggcagagcaaagaggctcaactgtgactttaggaaagtcattgagccttccagttcaggttcctcatctgtatgaagagacaaaatgtcaagggttttttgttaaatggaagagtgtatttttaatgattgtgttaaaaaatatttcacaaaatgatgtagaaaattctttgatgaagggtgcaagtaattaatggcttagcttacttggaatatactaggatacaatcatgtttctgagatcacaggcccacactggacctttaaatgtattgatggatttggcaccttgtctttatcacaaccatggtacttaactttccatgttatactgaaattagctcttgatgggcctttctatcctattggaatgtaagtttttccagggtagaggcctggtcttatattaacttactctctaggttctagcacaatgtttggcatatgaatgtattaagcatgccttttaattttcagtgtctctgctgctttggcatgcgagggaccagaggtacaatatacatttttaaaaaatggttgcttgggaggttgaggcaggagaatggcatgaacccgggaggcggagcttgcagtgagctgagatcgcgccactgcactccagcctgggcgagacagcgagactccatctcaaaaacaaacaaaaaaaatggttgctatgtgaaacaagtgagcaacctggatggaaagccaagactctgtgaggcgggtcattctggtccagaacttatcagaccaacacttcttaaagtgcacatgatcacctaggggatctgaactgattcagtagatttggggtgagggtcaagatactgcacttctaacaagcttccaggtgatgctgatgctgctggcctcaggaccacactttgaggagcaaaaagcaggagtggggaatcattttctataaagatccagatactacataattggggctttgagggccatataatatgttgcaactactacttgactctgactataatgcaaaagcagacatagacaacatgtaaatgaatgagcatggttatgttccccgccccccaccaaaaaaaaaaaaccttatttaaggactccgaaatgtgaactttatgtcacaaaatactcttcttcttttgatttttttcaaacccttaaaagtataaaaaccattcttagctcaaggaccttataaaaacaggcagtaggcttgcaggctataagttcactgagttagaggacaacatactagtcacttaggtagttggcaaatgtttccctgtggagtacatctaaccaaaagaaacgaatccttctctctatggaacctctgttgcatttttttatgcttcattttcccccagtaggtggtttatatcttttttatggaatgtagaaacactctaattcacagacagactcaactagtttcagagtttagcaggcgttattttttctattacctgtagtaggtaatgcagttcctcacacatagaagaagctctgttagtgtatattcagtttattttagtctgttgaagatgcctttagcttggtcttaaggaagaatagttcctagatgggattaatgaacagggtaaggagataattccaaggagaagaaaatgtgggcacagaaaagtaggcaggtaatatttgagggctatgtaaggagcagtaagtccatgcaaatattcgacagaaacagaggattagtataagaaaacgatagggccaagttatatgaaaacccacagtgacagatctgaagtttagagaatgatgtatgtagggaaaaacctcaagggcattaatctgatgacagaatatagaaagaatttatagtctgctggtgatggagagaccaattaaaacactaaagccacagttaatactgatgggtgaggatctggactgtggctttggaaagataacagaaaaaaaagaaagagactggaggatgactctgggctggaaagttcttcaagactttatgacaacaaagaaaaccatacagtgccccagaatcaagaaatactgtcctgctccgttgcccccaaaataatatggtttgcattgcatagaatgctcagttggctgattattgtatgttctttaattccccaggtcttatctcttctttggtgggaatcacatatttactgttgagcatggtttctggggttgatactcagagtattagcaaactcatttgctttattaactttattttcaaattaaattagacaaaaacctgtattattctactctaaatacagaaaaaacatgtcttccgtgtcatatttcacaaaaggatgtgaaatccaagtaattttataggaaactggacttagagaaaatctctaagtgctcattaagagctaaatggacaatattttcccagagaattcaatccttttagttctaagtggcagatttctacatatttctttaaaaataaatcccatttggggtttttttagggcagctttgggctttgttttgttttgtttgtatgtttgtttcttggtaaaatgtaaaggccaccaaatgctactgagaatttgaggtgctgggggaagagaggagagagagtgagagaacctgtgttcaaacagtctggcagcctgaaatttcccacacgaaggacctgattgtttgggaaaggaaaagtgctgacgagcaagaatgaattacagcacaactgctatatctctccacatcttggaggccaaggcggtctgctagaaagttttgtaaatatcagaaatgtggaaggcattaaatctgttactgctcagctgatcagaagtcttaaggtcaacaaaaatattgctgcctgtgattttttaacatgatgataagtttcttttcatatattaaatattttgagcataatgtttatattttctatttttctttagataagactaatagataaaattgtaataaatggaggaggtatttgttataaagcattttataagacactgagtttctgttccttttataactgaaatggtctttctgagtttgatagcatcacttgggttgataaaatgtacaagatgctttacaaagaaaacctgtgggaattgtctagtcattaatttcacagtctaaattgtagagtttccattagtaacactgacattgttttttttttaatcaaacaaacatcattttgcatagcaaccagccttcacttctgctttattgttttaaacatcaccatttcctttctttccctcctatcctttgacctccatttggcctgcagatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtaaggaggggtgcctggtaatgggggataaaggggtgtcaatggtctaatgactccagtatcttgggcatgcaaatgtgcctttccaatgcaaatggcacaatggtgttctaattcaaacttcatttccctgaaaacctttataaattgaactgttccgacatttaggcacccatcaactatctctgatgtcaacatttgttccttttaatgtagaatgtttccactccattaacttgaattatttaaaatgtaaggtatccaaattatttttgtctttctctagtaaatgaagcatagaaacacaattgaaataccatatcaagcaaagttaaacgataaatgactcaggaaatcattcatgagaattttaagtgattgaatactttttaatgttctcatttttactaaattctagaattttgtctcttttgttaagaccccattattccttctaaatgtattataaacttgcaatcactaggtgagaatattcaagaatcaatgttgtattaaagaggggtacgcagagaatgggctatttctgttgttctgttcatttttgacaggattcagtctccagggagttgaaaaacttgatatcaaagtattatattttacatttttattgtgttttgatcaataccaataatttagaatagttggaagtgttttaagcactgtagtgtatatactattcctaaatccataaattgatgagtgctctgttaattggttgctttcaaaataatggttaaaatatagaaagaatattaaaatccttgaggtctgtacttttttaaactatttaatagcaccaatatctccattatgtggaggtgaagaaggcaagatgtgagccaccatttatagctccttcaagaactggcccacaataattagctttaaaagtagggccaggtgaggtagctcatgcctgtaatcccagcactttgggagcccgaggcaggaggatcgctcgaggccaggagtttgagaccagactgggcaacatactgagaccctgtctcaaaaaacaaaacaaaacaaaacaaaaaaacacttttttaaagttagcctggcctggtggcgtgtacttgtactcccagctattcaggaggctgaggaggtaaggagggaggattgcttgagcccatgaggtcaaggttacattgagttatgatgataccactgccctccagcctggaagacaaagcaagaccccatctcttaaaaaaagagaaaaatttaaaaataaaaagtaacgattactgatgactaaaagtatgtacctttactttcagtgaaaggatcctccacattacctttggtagaaaacatcttggagtgcctcaagggaccttgtcctattaataaaaacaaacattctatatgtagtaacaactaatacttacatgacacttacaaaatgcacacacacacacacacacacacaatcatttatactttgccgtagcctacgaggtattattagtgttccttttttataactgaggcctggagaggtagaagaaacttgttcaaagtcacacaataatttgaaccaagacagtcttgctccagggcccatattaaccaccctatcatactgataggtatttcaaaatgctgcatgaatgaaaaatgaatgataaaaagatgtttaaaatttcactaatgagttagcagtattattcaggggtgggttatgtagcaaacttcttaagccatcttagaatacagtgaaggaaacaaacttccataaaaatcctgtctgctaatgatgatcagatgtgtctccaagttcagatagagcacttttaaatgaaattctttatttgcttgcaagattgctagaaatatgataaattttgggttgtgctgctttcatactacaaatattaaatgaaatcatattagatttaagtaaaagcctgtcaacttaatttaaccaacatttattaagatcctactaagtgccacacagtgcaggtataaatgtggttaagagacaattcctgatatcaaggagttctcaatctaacagcagataaacacatttttttaaaaaaagccgggcgcgggccgggcgcggtggctcacgcctgtaatcccagcactttgggaggccgaggcgggtggatcatgaggtcaggagatcgagaccatcctggctgacaaggtgaaaccccgtctctactaaaaatacaaaaaattagccgggcgcggtggcgggcgcctgtagtcccagctactcgggaggctgaggcaggagaattgcgtgaacccgggaagcggagcttgcagtgagccgagattgcgccactgcagtccgcagtctggcctgggcgacagagcgagactccgtctcaaaaaaacaaaaaaaacaaaaaaaacaaaaaaaaacaaaaaaaaaaaaacaaaaaaaacaaaaaagctgggtgcaatggctcacacctgtaatcccagcactttgggaggccaaggaggagatcaagatcagcctggccaacatggtaaaaccccatctctactaaaaatacaaaaattagccaggcatgatggcaggcagctgtagtcccagctacccaggagactgagatcatgccactgcactccagcctgggcaacagagcgaggctcagtctcaaaaaaaagaaaaaaaaaatgtaaaatgataaagtaatattataataagtggtataagagaaatcgaaagcattttaagaacttataaaagttaaatgcatgatatataagatatatataaaatcatatatatactataaaatgagatatttcactgcctcttgaaaccagctgcagaatccaactgggatagacccaaactctcaccatactgatctttaacttttaatgtggttcttctgtgtaaaagcctctgaactgccagtcctcttttgccagtcctttcaaatcatctgcctcaggtactgaatatgagaaaagtatccctctagttctatatggtacgtatctttcatgttcgggacttcaacagagatagtggatttcttccagtgcccagctttccatgtgacactgctgaacttactgagacatccgacacctttgggtacctctgactatagatagatcgtatgtgactttagataaattgaagggagagtaaggaaactggacatagcaagaatgaagaggtgtgaagattcagtctgctaagcctaacataaagtgctttagaaaactggctccttggccttgtgaaatatgaataattttttaaaaaacaaaagattttagtgttttaatccctaagaacagttatgtgaagtgggagagaacctcagataaattcttagcctcaacttatgactcaaagtaagaaatttttatattttacttattctagcactaaattagactcacccatattcctattgaattgcttcctgaagcatgttattactacatcagctgtcgttggcagcctatctatcagagggtagaaaggtttctttttgaaattaaaatctcagcaaagccatctctaaaagtttaacaacctacaaattagaaactttctaaattccactgtcccatgcgtcaagttttagaatgatacaaaagaaattacagcttaagaacagtggctagcattcatttagtgtcacctaggagccaagcactgttcttcatttttacagagatcacctcatttcatcctcacaaatatcacaccatttaaaattttcttatttttttaaattgacaaataataattgtacacattcgtggggtatgtggttatgctttgatacatattacgtatagtgatcagatcagggtaattagcatatccatcatctcaaacatttatcatttgtttgtgttgagaacactcaatatcctccttctagctacttaagaccatataaggtattattgttaactatagtcatcctgtagtggtatggaacattagaacgtattcctcttacacttttagctgtaattttgtatcctttgacagtctcttcccattccccccttctccttcccctttccagcccctattagcccctgttctgcttttttacttctgagattaactttttttttttttgagacggagtctcgctctgtcacccaggctggagtgcagtggcgcgatcttggctcactgcaagctctgccttccgggttcacgccattctcctgcctcagcctcccgagtagctgggactacaggcgcctgccaccacgcccgtctaattttttgtatttttagtagagatggggtttcgccgtgttagccaggatggtcttgatctcctgacctcgtcatccacccgcctcggcctcccaaagtgctgggattacaggcgtgagccacctcgcccggccaagatgaacttttttaacagcaagttaagcaccgcatgttctcactcatatgtgaaaactaaaaatcaccctattttatagttgaagaaactgaagttttaaaaggctaagtaatgaccaagatcacacatatacacacagcacacacacatgcctgggagtcaaggattcaaacctaggcagtgtgactcctgaatctgccctctaccctacagcataaaatccaaataaactcatcatcactggggcagctacagttccttgccttcatcaggcaacaggattttggatctgagcacagcatttttcagggcatataattgagcacttttcggtcattctcaagaatacagtgagtgactactgtaagggaggccgtggttcaccctcgagacacacagcagcgaacaagcaggcctctgccatcactgcacgaacactccagaaggggggcagagtaacccagtaaactcataaggcattccagcagcagcaagtgctgtgaaagaaatgaaggtggctgatgggatgcggtgatcaggaagcctgctccaaagagatgacatttggtctccgataggagcctgagaaggagccagtagggaaggctggggaaagagtgctccggaccaagggaacaaatgccctggtgaggacagccagatgtgcctaagttgcaggaagaagtccagggtaactggaacatcaggtggaagagttagctcagaggcttgggccgcagccggggtatgccggacacagggcctatagtcaccgttagtttggctaaataaaattgaaaatcatggagggtttaaactgattcatattttctaactgactctctggttggtagaagcctattgcagcaggacagaggagagatgcgggtgcctcaggaggatatggcggagatgagggagtgagtcagattcgagttgggttcagaggcaggtccaaaaccctgcagtggttccatgtggaggcgaggggaggaaaggaatcagggatgactctgtggattcagctataccgtttgtgaggacaacggtgccaatctctgaaatgaggaagacggaaaaggaataggattggagacagaaggaattaagtgctgtcttttgaacgtgctgtgtgtgtgtgtgtgtgtgtgtgtgtgtctgtgtgtgtatttggagatggagtctcgctctgtcactcaggctggagtgtaatgccgcgatctcggctcactgcaacctccacctcctgggttcaagtgattcttttgcctcagcctcccaaatagctgggactacagtcacgagccaccatgcccggctaatttttgtatttttagtaaagatggggttttgccatggtggccaggctggtctcaaactcctgacctcaagtgatccgcccaccttggcctcccaaagtgctagaattacaggcatgagccactgcgtccagcctgaacatgctgtgtttgaaatctctatttagctagccatgtggatgtgtcaggccggtagttgcaaatataaacatagatgtctagagcacagggtgagaatgctgtatttggggagcatcaggatatagatggtaactaaagctgtgggactggatacacctccagacagatcagctagggaggaagagggaatggggacgaggaagggatctgaatctgagcctgggatactcctgcctgttgaaagaggagttgccagcaaacaagataagaaagaaaagcccccagggtgtgagagaaaccaggcagaatgctgtaagggaaggcaagagaaagagtttccagaagacagggctgcaagatgtgtctgctgctgctgagagctccaatcagatgcgggccaggagaaaaccactggggtcagcaacagtggatgttgtcagcgattttagcaagaggagcttgaggaatctgaacagggttaaagatcaaatggtactggttgagaaaagtttgtgaaatatggaaagagaagcagcaaataacatacttgttggagaagtttggcttaactgccaactaagagataggagctggtatctggaatggagcatggggtcaaaaagatggtttttacaatgtgtgtgttttcaggcaggatttactagaatataggctgaagaagatagtgcaagagagaaaaatagatcatgcaggagggaggagagtaagatggggaaaggaaatggaatctgtactagatggcgagagggtaccctcaagaactagctggcagagagagcttctcaagaatttcctatgtaaataggaaagatccatgtaaacatgtaaaataaatacagacatctcaagttcccaccactgcctccccctgtgattgtaaaatgaattacacagactgtcaaatgaatagctttatgagctccgaagagggcaagatggtggccctgaaatgtgggatgaaggaagctggattaaaccggaccttgtggataaagaggattggggtcaggaggagaggagggcagggcagcgttaaaaaggtagggaagagaaccagcgtgacacagattggcaggtcctgttagacacaggttctcagtgctacgaataatcagataaaatgtgtgcccctttgaagtgacattgtgaagcgtgctgtgatgtgaaatgtggaattgttcctggtaatcacatagggtaaagcccttggtgctgggaccactgccgtgcctctctaggcagagattccattcactgggttttgaaaacttttggagaaaagctaaaccagtttaactttggccattcttcgtgttatctattttaaaataacctttcatggtattttatgatggctctatgctttggtttcttcatctggagaaaatcagattgttgtaagggttgagtgggttaatccactggggtggtgcctagcacacagtgtaggccattattatttttaaataccatatttttatttttaaaaagctaaaatgtacggataaaaagaagatataaaaatcatgtctaggccaggcatggtggctcatgcctataatcccagcactttgggaggctgaggcagaaaaatcacttagtccagaagttcaagaccagctggagcaacatagtgagacccccatctctataaaaaataaaaaaaatagccaggcatggtggtgcacacctgtagtcccagctacttggaaggctgaggtgggagggtcacttgagcccagcaggtcaaggcagaagtagctgggatggcaccaccgcactccagcttgggtgacagagtgagaccctgtctcaaaaaataaaaataaaaaagcatgtctaatcctagtgccttatgacagtcactcttaatatttttatctttccaattttttcctacatgtgagtacttaaattttgctgtatctactcttttgaacttttttttttaatttaacctattctgtcacagacatctacccatgtcattaaacgttctttaaaaccattctaattcctttgtagttgttcaacatttataaagttatgtgtcactgacattgcttcggttactctgatctgtaaatgattcttgctgtattggtaattatagcaactgatttaaaagagaggaaaagaagtaaataatagaaatgagagaaaggatgtatttattcctcaaatcttgaaaggcaaaatatgtataaaaggataaactccatgactcagttcagtaaagtcagttagagatttaaaacatatctatataatatatattatgtttattttatttttatatgtttatatattttacttatatgtattaattatatatatttaaaaaaaaattttttttttgaaaagtctcgctctgtcgctctgttgcccaggatggagtgtggtggcgtgatctcggctcactgcaagctccacctcctgggttcacaccattctcctgcctcagcctcccaagtagctgggactaccatgcccatctaatttttttttttttgtagttttagtagagatggggtttcaccgtgttagccaggatggtctcgatctcctgaccttgtgatccgcccacctcggcctcccaaagtgctgggattacaggtgtgagccaccgcgcccagccagtaggtttttaaaatgaaaagggagcaccttttaaagtcaaggcaggagactcatttttgtgacatttccactggccaaagcctggagcaggatcgtcggcgtgtgattccttcactctgcgtgggaggcagaataggaaaagttaaggtttaggcaggtaactgttaggtgaacagatgatagtaactacaagggctagaacatgtaactctttcagactggagcctacatccaaaactgaaagtgacggttaataaatatggagaaagacgttaacctgagactccgtagtgttgtttttttttttttctcctgaccagcaggtgcaaagcagatgactgaagtgggaacagagtgggagagggcgggagaatcgccctgaggggaaggcagggaactggctggcacagagagggagatttgatctgcccccgtctccaagagctgctctgacacctgagatgtaaggtgactttcagatttcacaagggttggacaggtgtgcaaaagctagcaaatgtgtgtttattcagggggccccagcctttttggcccctttttcctttgaaaatcagctggaaaaaagtagcaagaatggctttctaaagagaggtcatcagaaggaattttttgttttttaatgattgaaacattttgaatcaggtgaaaagtaactgttttctctccccaatttttcgctaccttgagagtgtgtgtgataacttccatatggtttttgccacccctccccttctcctaaatgcttttatgattccagtaaaatggtctcccgggtcacccccgaccttctgatcgccttcactggcttttcctcagggtttctcagctccctgcatctcctcatcacagagaaaacttctcctggcccataacttgtttttgatggtttgttgtttgccccgtttgtgtccctactccgccagttaatcctgcacactgacttttccagcccccactctcggtgcctacacgaccaggttcaaacaagtcagccccagcgtcccagtcctgcctgtgtttcgagatttgcctcccgttactgcccccagcctgctgctcctctctccttgcacgatctgcgcctcgtccccagacaagctttaccacttcccagttctctttcttcattccagcagaagcctggaaggtgtgtatgaggaaggcatgaagctaggccctctgaggaactcacacgcgcgcacctcatgaaggccacctggaggtcacgtggtgtgggggcaaggtcacagaccacgaggctcaacaacaacagtgctttgcctgtcaccactgctttctagttatgtgaccttcaattacttcacctcttggttccttggtgtccttgtctataaattggacataattcacttcttagtgaggttcattatgatgatgattaaatgaggtaaagtgcccagcagacgccgggcacataggacatatgcaaaaattggtagttccctttctaacccagcgtccatcctcagggaactcatcattttctagcaggcatgatattctaggtgacgtgagtgctgtaaacaagaacgctgggagttcagagaaagagcacagaatagtgcctgggctgaccgtggaagatagcgtatcaagaaaagatggataggagtttcctaaggagtgaaaactatgactaaggtacaggcatggaaaacaagcagggagagagagtccccactttctctgtgtcctaggggaggcttccttgccaccatccttaaaattgcagccccccgggaagtcccatcacagcccgtgcccctcccctgcttgatgactttcctgcttcactcaccaccgtatcatgtacttatttctcttctgtgtcctcacaagatcagaggggtatgtgtgtgtgtgtgtgtggtgtacgtagtggatgtgggtatggtgtgtgggggggtatggtgtgcgtgtgtggtgtgtgtggtgtgtcgtgtgggtgtggcgtgtgtgtggtggtgtggtgaggtgtgtatgtgtggtgtgtgtatgtgcagtgggtgtggcagggtgtgtgtggtgtgtgtgtgggtgtgatgtgtgtggtgtgggtacggtgtgtgcgtggtgtgggtatgtgtagcatgggtatagtgtgtggtgtgtgtgtgtggtgtgggtgtgtgtaggtgcgtgtgtggtggggtgagtatggatgtgtttggggtgtttatggtgggtgtgtgtgtgtgtgtggtggggtgagtatggatgtggtgtgtggggggtgtgtgtgcatggtgtgtggtggggtgtgtgtgtggtggggtgagtatggatgtgtgtggggtgtgtgtgtgtggtgtgtgtggggtgtgtgtgtggtgtgtggtggggtgtgtgtggtggggtgagtatggatgtgtgtggggggtgtgtgtgtggtgtgcggtggggggtatatgtgtgtggtgggtgtgtggtggggtgagtatggatgtgtgtgggtgtgtgtgtgtgtgtggtgtgctgtggggtgtgtgcgtgtggtagggtatggatgtgtggggtgtgtgtgtggtggggtgagtatggacgtgtgtgggggggtgtggtgtgtggtggggtgtgtgtgtttgtgtgtggtggggtatgtatggatatggtgtgtggggagtgtgtggtggggtgtgtgtgtgtgtcctcttcactgcgtatcccccttacttatggagtgcacaccattagatgtgcaggtgaactcagctctctgacttaaggttacatgacttggaagtccaagaagttctggcagatagaggtagaaaatgaagttggaaatcatgagggccattaaatgacaaatttggggttttttattttactgagtagagattctaatcatctcatttttaacagggaaagtgtgctctaggaaaatctagccgacacagggagggcaacgatgaatttgagaaggaggagatgggaagacaagaatggattgtggtagtccaggccccaggcaaagaaagcctacactggatggtagacacagaaataaataggaagggacagcaaacattccagcagagttacctaaacatgactgttttcaatgtcaataaaagactggaaaacatatcacagtagagtcactggaaggaataccaggcagctatccaagagaatgcagtgaacgtatgtattctaaatctactgataggcaaaagtagccaaatgccaagtgaacatgccatgtgaatccatttgtataaatatgtacataaatgtaaatatgttgatatgctgtattaaacttatccaggccatgtgcggtggctcacgcctgtaatcccagcactttgggaggccgaggtgggcagatcacttgaggtcaggagttcgagaccagcctggccaacatggtgaaaccccatctctgctaaaaaaaaaaaaaaatacaaaaattagcagggcgaggtggcacatgcctgtaatcccagccactcagaaggcaggagaatcacttgaacccaggaggcagaggttgcagtgagccaagattgcgccactgcactccagcctgggtgacagagcaagattccgtctcaaaaaaaaaaaaaaaaaaaaaaaaaaaaacacttatctggaacaatacacatcagacttaatgtggtatttgggaatggcatttaggaaggtacccactgatctttactattaggctgcacaattctgtgctatatggttattttcctataagcatgtattattatataaaagaatataagtgacccaagttaaatgtatcttggaaacattaagaatatactttgaaccattgcaattttttaagtctgtcacctaaaatctcttgacatgaaatatgtaaacatcaaaatctgactgcagtttaccttttgactaaaaatctggtaagttgaccctttatttaagaacagtaataatgcaagtgaatttgggaaggcatgatccaaaatcaaaggccctcttattcaagaacagaaccactgtcatactcagttttacccaggagccagaaagcatcagtccttaccctgcaatctctggagaaggttacagtttaaaagcgtgggtattcttcacacaaacacacacacatctttatttcatagtttatagccatttaaaagtacggttgtgatgaccacagtgataaaaatgaaattaataataaatctgtcattaaaagtatattgctttgaagaaagctatttatagtagtactttttaaaaatgagtttctgaagaaacagtacaaataaaaaattgtctgagcctgaatcactctattttattgtgtgtttcggtcaaaaagactttgtatgttattttatttaagggaaatataattctttgcaattattatagataacactgatatcttaactttaccattatctttaatactttcccaggtgccagttcaacagattctgacagtgaaagtttagctttcaaatcaagagctggagctatgccacagtaagtgcctacaattccatcgattatgtggaaacaaagaatggcaacagaatggttggggtatgaaaccatgtttgctgtgctttgaagaaaaaagtcaactgatgttaatcagagatcaaatactgaggttggaacacaatttttttttttttttttttttttgagacagggtctcactctgtcacccaggttgaagtacggtggtgcgacatggctcactgaagccttgacctcccaggctcaagtggtcctcctactttagcctcccaagtagctgggattataggcatacaccaccacacctggctaatctttttttattttttggtagagatggggtctcactgtgttgtccaggctcatctggaactcttggactcaagcgatcctcctgcctcagcttcccaaattgttgggagggattataggcatgagccaacatgtccagcccgaacacaatttttaacttgtaaatttgaactttgaagtctgcatttcatcattgatatgccagaattttaccatatgcaatgttagtttcaaagacagccatctaatttattataaatgtatggaaagagaagtcacattaagagaaaatcaattaaatcattactaaaatgtgaggaccaatttatttatgcaagttggaaaatatctaattaggccagaagtaggttctcctttggatacgatctatatttatttagatcttgtacccgaaattcacaaaacttagttattcctacaaagacataccaattattaaaatgttaatatcttaattatttggcaaaaataaaatctaccagaaattcctattatggaaaagtccataaatattgagtctgttctaataaatttcttttatctgctagtatgtacataaaaattatatccattcagcatcaaataatcagtgatgcttaaaggatcttctaaggttattttaccacccctggtttttataaggagctcaagtttagtgaagttacatggcttgcttcagatttcacagccagctacttgacaaagctgggcctagaaatcaactcttcttaatcttctctaaatatctcactaacttatatgcactaagaaaacacaaaaattccaagataccgacaacaaaattagaaaccagaaaaaagaacagctgttagacttaaaatagacaaccaaaactttgagttaaatataggaccctaaccctaaacatttcaaatctctgcttatcaataaagattggattttttccaaatattttctcttaggattttcaagtttaatacgttagcatcttcaacagcgtctcagttacatctagctacttttcttttactcatgttttgattttgcttaatgtctataaggtacattctataaggtacatgtatatactgaccacagctattctagctgtaggttatgcattcccattgtggaagcaattacagttgaagcggattgcgtatacaaaaagaaacccagcttttctgttgaaacgtttcaaggaattatttctgctaaaaaaaaaaaacaaaaaaacgaaaacaaaaaatattctgactaaacactcaccttcctattttccagagctcaaaagaaaacaacttctgtttccttgacaataggatcatcatctccaaagacaggggtgaccacagctgtgattcaaccactgtctgtccctgtgcaacaggtaagtatgctttgagccagagcccataaggggtcgaactcatcagcaaacttgtggattttaagaatatgactttgattctaactagtatactcccttgaaatattttctaagtggacacaaaattcagagcaaagaaaattgtaggtaatgtttctcctttcagttcactaaaaacaacctttaaccaaaaccacactgccaattagtcaacatttgcatttccattgggaacttctttctctaacagctaataatctgataaactggtgtctgttttagctgtaactatttgattattccctcacatgtgtatgctctttcatatagccaaatttattagctcattacaaattaaaagacaagtctgcataccaacaaaaagctttcccactcctaaaagctaaacaaataagaaaaaacaactcaaattccttgacttcaccatgctttttgatcttgcttttattttattgtaagactgctatagccatgaaagaacaataatataaactactggaaagtagttgtaatgaatttactttgcaaacacaaacaatatgaacttcttttaaaaaaaaaagtagaaaaccattacatctggatgtctctaaatcatggtttaatgaatatgttcaaagacaacactcacagaaaggttttcccccacagtctggaaatgtaaactcattcctaagtaatgagtatgtcttataagtatcaccatgtcctccctcagcctttattacctattgaatgctcaggggtgtttcagccactatagaggccaataggtgctatcgatatgtggaaaatacaaacagtagagagaagacatttgggtccataaacttgaatcaacaagtatcagttactcagagatggcatatatagtacatatttcctttaaaccccttaatcagagtggaatttatagaaatatttgattaaatcagtgggcattttttggtatttgatgtttaaatattgataaatatttattgagtgcttagtacggtgctaggcatttcatgacaggaaaaaatgtcacccaccccattcccaaatggggtgaatgtgacagaatgtatttagatgtaagacagaagcctaggaaatagagagatacacacacatctagatatgtaaataccataataatgtaaagagtgaatttttaaatggattaaattctacaaagacatggaatggaaggtaatttaccccatgtttatagttgggagaatgaagcacccagagaaactccatcgctttattattgcaggcaatgtgacatcaagtaatgctctggaaccagactccctgggtttgaatcccagttctatcacttcctaacggagggaccttaagcaaataaaatgtaacccttcaagccgagtttcttcatctgtaaaatgaagatgataacactatgtatctcataagtttgtcctgaagatccagtgagttaatcttcatatgacacttggaacagtccctggcatagagtaaatattaatactataagagtgttcacatattcttgggacataaaaagacagtgaaaagtgaaacccagacctcttgaatcacaggccagtaaagtcttccagggttaatgaataaactccattagcatcctagcatctctaccgctctgccacaattcttcatgatgtcctgtggcatatttagacacacgataccagatcaccatcatcttgggttaagaagctaacaaccacttacataagtgaataaatccagatcatttaaaaataagtgatagtacacaaagaaatattttccattcactactctgaaatccttatatttctccagagatgaatgtcattgaataggtattttagcacgtttcttttttgcacgtcaataaaaaaaaattcttttctctcctttcccataatccctatatcaaaaaagagtacaagttaaataagataggtagatgtttgataatttaccctccagtgccaatagccaatggcttttatgcattgaatccaaactgtatttaaaaataaaatacattgtctacgagaactttaaaaaagacgcatgtggaagtcccacacacagaaatccatttggtaatagcatttaaaagctcgtggatccccaaggacccagggaacttttaccttgaatatccttttgaacagagaagagtaacagatgtgaaatgaggaagtggaacaatgtctgtactgtaagagcagacgagcaaaatgatgtatggtggtactttcattcactcatttccttcaagtgggtgatccccataatgaaaggtttcttcagcccatcttttaggcaatttatatatttagaatttgatccatatgtctctgcttttgcaggttcacagtccaacttcatatctctgccgacctgatggaaccactactgcctactttcctcctgtttttacaaaggtctgacatctggaagtctcattctctgtgtttgctttggtccttaaatttcatttacatgtggcttcgtgtagcaatctttaaaaattaaaaggaacagattagtaggctgattaccatggttacctttgggactaaatagatatttgttgaacgactgccgtgtgactgtaatcttgtgatgggttctgagagatgtgagcaggaacttgatagagcctaaaatctagtgggaaagccaagacagatagaaaaaaaaaaaaaaaaaaaaaaaaacctgctgtgtaggaaattgcttaggagatctagcaagttttatagaaattcagaaaaactgactaattttccatttgtcctgagtccggaatttgcattgccaggctgaatgacatccatttcattggtcagcctctcaagtcagaaatgcttccatatagcatttcttctctttctttttcctttttccttccttttttttagagaaaattataaaactttattaaaagacattttaaaaggcccaaataaatggagacatatgacatgcttgcagactaatagaccgtataaagccatgactccctgattaatctgtatttaatgtaatctggctaaaattctagcagcttcctgggtttttttgttttggtttggtttgttttttttactttaaattctgggatacacgtgcagaatgtgctggtttgttatgtaggtatacacgtgccatggtggtttgctgcacctatcaacccgtcatctaggttttaagccctgcatgcattaggtatttgtcctaatgctatccctccccttgtcccccacctcccgacaggccccaggtgtgtgatgttcccctcccggtgtccatgtgttctcattgttcaactcccacttataagtaagaacattcagtgtttggttttctgttcctgtgttagtttgctgagaatgatggtttccagcttcatccatgtccctgcaaaggacatgaattcattcttttttatgcctgcatagtattccatagtgtatatgagccacatttaaaaatatggaacgcttcacgaatttgcatgtcatccttgtgcagaggtcatgctaatcttctctgtatcatctcgatcttagtatatatgagctgccaaagcaagcacaggttcctggtttttaattgtttgtttgatatggaatttagcaacctgattcaaaaagttgtgtggaggaaaaaagtggctaagaatagccaggatacacctgaggaaggaaaataaggtagtgttaggaaggagtgggatttgtcctataagatagcaagacgttttaaaggtatagtaattaggacagtatggtactggtacaaggctagagaaattgatgtgtaatcggagtagagcccacaaagtttctgaatacctacagaaacttgcaaattgctggagaaagaatgaattcttcagcagaggtgaaaaagtatccagttggactcctacctcatacttttcacgacaaacaattcctagtaaactaaagacaaatgtgaaagcaaatctataaaacttttgtgaggcagtaaagaaaagcatttttgtaatctccatagaaggagtgattttttttcccttcagctggttgaatccaagctttataaaatatcttttcataagcagttatagtatttccagttgggcacaggcaacaaatgataacaggtggtaacaacttggaaactaccctcctagctagactactaaaaaagaagttatgtaaaaccctgcctaaaaccatgtcaatctgataaccaatgaagtcttcctttgatgtttagaacagaaaatgtttacagaggggtggacactccacatttaggatgtagtttaagagttttgcacaagcagcttcccaaggtcatcaccagaaagggtgtgttgtccaatgtattggtatccaagacacagttgatttgggggtgccagggcccaacacgcctcttggtttaaacaaataaagtccatgctggtggcacaagggaaggaaaagaggaagcaaagatttgctttctttcactaccgggctttcctgcatgggtctggcatgtgtagatattatggaattcctcctgggcaccaagaggaactctcaaatactaagtacaaaatcctgtttcctcccttgcaatccagctcccgcaacatagactttctattagtggtctttcccccttccccaaaagataaccatgaagcattctttgtgctaacagcacagctttaaagagaagtaaaccaaaactctgttctttatataggttgatttttaagaactctcaaactgtcaattcactggaagctcagagccactgaaagctcagagccactagaagctcagagccactggaagctcagagccacttctccagccttccactttctgtgtctggaccatggaacatctctcttctgcagggctgttcccttccttgatgcatctgcttttccctttctcactttaggcagcttctgtctctgatttgcagggtccttcttaggcctggtctctggttttggaggggtaggtttagaaaataatcctgctgatctcctctgtaactcaaactagcctttactttgtcactcatagcaccttcactgggctttctcttaggcatgatgatgacagtgaatggcaggtgggctggctttcatagtccaagggttacctccatctgttttctcatgctactctggaagagattcctaggtctcacagctggtcagaggcagagccagtgctcctgcctgcaggccacctggcagactggtggaccacaggactgtgggtagcatggacgtacatgtgacatttcttcccaaatagacccctccaaagaatcacaatgtcaggtggacttgatggtatggccagaggggtccttgtaaggatcctgaaacccccagggcccccagatcctacacaaagtagatgatccaggttgccaggtgcatcctgtaaaggttgactttcagtctcctttggggctccttgttatgttcccgaaggttctcctaatggcttactatgtttagccatggcttttgccaagataaaaatgttagctccaggaggatccaaatggcaatcctggaataactgtggagctttgactgattaagttacttggcatctacccatttcctacatctttgactttccgacactgaaaaaaaaaaatgcataatcttaggaataaatcaaagtctcttttggtgcctcaaagctgaagcatgaaaaatattttggtgccatttgtagtctatcctgaacagcttcctggacaagcctagagacatttaataggttaatccgtagaagctggaccccataagtgacacttaccctgttttgatctaataaattagctattctatggacccagtcacaaaggaagaaaaatatgatttaaaaccagagattttctccatttaaaaatacggaagaagaaagaacgcaatcagaaatagttgatcatctaaaccttgtcacttaaagacattctagttaactaccaaaatgtctatcaaatgtcttctcagacttcacattagacttttatagttcttctgccaatgtcataggttttagaattccctcagggttttagcacacttactgcaggacattggttacagaattggttttttccaggacatcatttattgtcccatcagataatttaaacacacatgcatacaaacaaacaaaacaattcacacttcctaatgaatgtgaatttgtttgcttttggtgtatatatggataaattatgtttgagttattttgagagtcctacaccttacattcgatccaatattctttttttttttttttttttttttttttttttttgagatggagtcttgctctgtcacccaggctgaagtgcaatggtgtgatcttggctcactgcaacctctgcctcctgagttcaagtgattttcctgttccagcctcctcggtagctgggattacaggtgtctgccaccacgaccggctaatttttgtatttttagtagagacaggatttcgccatgttggtcaggctggtctcgaactgctgaccctaggcgacccacccaccttggcctcccaaagagctggaattacagatgtgagccaccacacctggcctagatccaatattctatagtcagaagtttaaatagtaagaaagtttaaaaggccctattgctagttaattctggagaaggagggtagagagaagatatatgtgagggaaatattaatgtcctgatatttaagaacaagtataaaagctttacttctttgtatctataaaaccaaattaatttctgatctgttggattgtaaagatttattggtctggagttggagtgcggtgagggacaacaaaggcaggagcaaagaaggaggaaatgaaggtcaataaggaagaagtacagcatgtttcattactttactcagaatctcaaaatgagaaaatgtagaaaccccttagcttaataaacttgacataggaaactagtcaggcagaggtggtacatgaaaaggctgaggcatgtgaaaacaaatgcatgtcttttttctcttcttgtctggttttcataagaatctacttttatttagagtgtggtcgtttcaagaaattcacattccacctgcttccttttaaatgtagataaagaaagttaacattggttaccatcaaattccataaatgcagagcagtcagtgcaaatttgcagacaggccagaaagctctacaggacttatggtacactttactcattttatgacttggagagggtgaaaagctgataatcggtgggtccaaaggtgtttatccttacctgagtcagtgctaattatttgatgatgcaagttttgcattttgtgtttgtatctgttttgtctgaggtttggaatttttattctgtgttgtgaaattgcttaaaaatgcaccaaagtctgatggggttttccttgaatttccttgaatttcaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaagtaaggagaagtgcccatgtccccaaatctgaccattttattctctccagcttcaagaaaaccaagaagggctaagtcattaagatgaattgatctctatgttcaaagagtggcaggatcagataatctacagtgtgttgaaatccagtaaatggaaactatgacccccttgacactctaatgaaagtcatatattctttcgtcttaaaaaatgcatatatacatttgtactcaaatttgcatgaataattttaggaggtttaccaggctcctagagcccatctatgaactgcagttggaaaaatttcttagtgtaagttgatacaggaatttgagtttttatatttatagaaatataaaccgatctatcactttatatcttttgtatgatggagtttgactgtaacatttcttcagacatgtcctagacaaggtaatggaaaggaacaagtaggttttttttaattaaatggaaccccattctaatactttgttctaatttatttttttcatgtggcaaacagaacctagatctacagctgaacctggtaagaatatttttagggtttttttttttggtggtgggggagcagataatgtatcttttgggtctcaatagttctttctttctaccttaaagccgtaagcagaacaatgtttttgtggctccctggaaatgtgaaacccccttaaaaacaatatcttctttatcatggagtctgtacactgcattttacatcaacgtctttattagcaaaacattaagttccattcagacaagaaggtcaagctcagtgacttcatgctttttaaaatacagtcttttaggctcagaaagcaaactaagctgatgatgaaaaaacatcctcctaaaattccagtagagaaggacaatctactgcctatttgtactgatcagaacccactaacaaccccagcttagaaatgtgtctcaaatgagagcagctcaaagaggtaagcaaaatggacccccaggtgtttctcatttgtgtgccctgagccataaacttttactattctgcaagcatgaagaaagtcatcttgcccccagatcactcttaattatcaggtcgtttgaccagatcacagtgctatgtgatccaggagcctcgggcctagctgttccctgcctcagacatattgcgtatttatggttcctcgtggagtgaaatagtgtttgtaaaggaaacaaatttttgtctaggtacttcatcgtatgtcctcctcaagactattttcttttgtatttttcccatcagcagggtcacaatttcacttatttctgaacaaagggtagaaaaacaagtcattttcctgtttctcctgtttgttcctctgcttcagtgtcaagcagatcttgccacatgtgtcttaggagccatgaccttgctctgactcttcttgggggaactggaaagtcctctgtgggccactgcaggtcagattactgcagtcagtccctgaacttctcacatctgtgtactggatctttaaaagcagagtttgaccctattaggatccaacgtttaagggaggctgagtagcatccttagggaacaactggaattgatctgctgccctcctgtcatgaattataagcagagcaagtccccccacttaatgtgtcagtcatcacatcaaatactgtagtcactttccagactgtggaaatatacaactgcatattttgtctgtgaaatgtcattgaataaaattgcataatgctacttttctaatacatggattttctgagattaaatctgctgcatgagctaatatgggaatcctgtagggagttagggcacatcttgtgcatttgctattttaaacaactttagataggtagatataaaagtaggaaccaaatatcttttatctacaagaaatagctttttatgtgaaacaaacctataaagcaatttatgtcttttaatgctttgtgtataaataaggctaaaattttgagccaaaaattgtaaaaatgttactgctagcatgaaataaggcagcttttgacattgcgttttggattcggagtgaactcctgcaactctcttttcatcgtgttgttatacgttgtcatcatgcacataggtgatgatgatttatcaaatgtaggttggaaaatcacaaacagtcatctgcaaagtcaaaacattagttagaaactgcacagcttagttttcagtatgtgtatatttgaaaagggaaaacactcagaatatgctagctaaggaagaataaatttggatgaggagggaggaaggaaacatctcccccgcaccctgcgtcttcatcacttatcctacatacgctccttctgtttcagatctcccccgcgccctgcatcttcatcacttaccctacatacactccttctgtttcacatctaccctgcgccctgcgtcttcatcacttatcctacatacactccttctgtttcagatctcccctgcgccctgcatcttcatcacttaccctacatacactccttctgtttcacatctaccctgcgccctgtgtccttatcacttaccctatatacactccttctgtttcagttagtttgttgctttgcttctaaactatagttttgattgtgaattatttaataaaattagtcctaaacagcttcatggaatcacctgacctctagaacgtacttaaatgccatttgctttaatgtagcaaaatcatgcagaaaagagcaagatatggaaggccttccttttaaatcccttgtcctagcaatgcagaaaaatgtttcctctttgtgttcactgaattttcttatttacatagttagatctgaaagcgtttaagaaaacagattccttcattccaactacaataatagcattttctgaaaaatttctcctggcagagaaatatttctagcaaatctgtcaatacaccaaaaaatattatatagtcaggagctattaaaaactaacacaatgagttttcctgacctacgatgatttctccacaattgtttttaccatgacacgacgagactttcttctttcccttttacagcgttaaaatgctgtgcttcaggaaatcagccgttggcatgcagcattaaataaaatccatgatcatgttttttaaacaaaaaaaacccttaaacacatgaatgaccacgcaagtgactaattatatgagttgttgtgagtaagaacttcagaacaagcaaatgttacagtgtatttgtgcttaaacaatgttttgtcatgcctgtcaaaactaggtatgattcttttactagttgccaagtgttttccttacattgaccttgaagttgctatgtcagaggaaaaaacaaaaaataaatatgactgtttaccttctttaaatgacctgattgactgttatatctaatggacctctgagctattaaactatatagaagtatgtaggaaccggcttccctaaaaactgttttcttagccattgttaagtggaaggaagaaaaacagacgtgactacaatacatctgaggcaagagataaattttataggactaggtcagtgatattttccaaatgctaaaacataaatagcctttgaaattcaggaaaacatttaagcattctgtttttattactgtctcttcctaccctcttcctttcctctgagagagtcactcttgctcgctctctccccctcctctctgtctctttctctcccctcacctccttcattccctgcctctcttcctctttctccatctcactccctcattctttttatttattttttctttactcttctctttactctcttctctttactctcttccttattcatgggcaagatgttttaaagctccagaaataaagttgaaattccctagtacctagatatagccccattaggaattagatatttagataaagaaggaaatagcaggttgtctccaaatggatctgtgcaactgaaacaggtttttcttgtcactgctgcgtcgtatctgtctgatgtgttttacactcccctctctgtctagacagaagtcagcttgcatcacaaatcttttcagactgttttgtgaattaatagctagtcagcttacttaagaccaacatccgtttgtcatagtaccttctctggccttctttgaaattctgactttgtactgatagactccttcaaagactagtctgggggtgggggacacagaagactcatttgacagctgttaatactcagtctcttactcactcagctgtctggaaacagccacaaactgtgttgagttacttctatagcactgtctaatagcgtgcaaaattaaaaacacaaaaacgcgtcttactggttgtggaattatacatataaaagtatattgcctcctgctttcaattttaatttctgctcaccagtgtgacccatgctagatcttgtacggtagagtctaggctttgattctctgattcaaaatataaagtaagttacacttagttaaatgtactaaggtgctgttgtaggagggcaatgatagggatgtttcttgagatcccagtagattgtatgcagtaaaaacttaatgcatgttctaggttaggacggtgggttgaacaaaagtaggccatatgaaacttatagttcaccaagagtgtgacaggatgccctggggtgccacaccacgctgacagggatgctgtaatatatttgaaatttttttatgcaaacacattcaaacttgacatttgacagatatgacacaatgactggcttgaactagttcagaatttcaacattagatcaccctccattcttttctatgacataatctctttgtgaaactgagtttttgatgagtgtgtgataaaaagtaagtacctcatgaaaatccatgtaaaacatgaaatgaggctggctcatccaatctgattccaagagaggtggtacagtgcccagcagatgcacacagccattagtaagaaatagtggttatttaagaataaaataatagtatttttctttcaatttatatgtatttttaaacactaaattgtttaggcataaacacttattaagttctttggaaataactacataacaaacataactattagttatgtcttttggcttaggagcaccatttaaaaagtattgagaaacttagagtcccatgaaccaagaaagtttgttttactctctagaggaggagtgtccaatcttttgaattccctgggccacactggaagaagaattacctggggtcacatataaaatacactaacactaatcatagcttttgagcttaaaaaaaaaatctcataatgttttaggaaagtttatgaatttatgttgggccacattcaaagctgtcctgggccacatgtggctcagaggccacgggttggacaagcttgctctagagggagagggggaagactcaagacacatttgagtacacagcaaaaagaaaattgagtgggttttgaaattcttaatgccaaatgtgcctatttccagtcctcttccaggactcacattccagcctgctggcctatgaactttacctctctcagcagagactgaaggactcttctctgggcaatttaaacatcccgagagaaaaaataaatccaaagataatgatttgggagtttctcttataaagatgccacttagattgtgctatagggaaggccaaagtggataagttcctctcttatactcagagcttaataaactcccatccctgtcagacaagcagagagaaaaggcatctggagaaaacctctagcatgaatgatatagaaaaaaacaagtgaccttcctaaaagggaactttgagaaaatgggtttgcaaagagaggaaaatgtaaaacaaaaacaaacaaacaaaatctctcttaaaggatccaaggaaatcattccacccaagaaataaaaatgaaaagctagaaaaaaaaaagagaggggaggacacttgtaaaacagagttcttgaaatgaaaagttcatagcagaaataaaacgagcagatgtcccacaaagtacagcaaaatgacgaagaagggatgtaagagagaaaaggcaacaaagttagagatgcatagctgaataactgggattccagaaggagagaagaaagaagcggcgagagacaggattatcaatgaaataatttttttaaagttccccaaactgaaagttatcaattgccagatggaaaaatccactgattgcacaacatatggaataaacccagacccaggcacgtcatcatgaaattcagaatttccaggacaaggagatcatgttataagtgtcctgggagaaaacatcaggttatatatacaaactagcaagatgcaaatagcttaggccttctcagcagtcacactagacacaacgagacaatgaagcaagaacttcaaaattgtgaaaaaagttacctacaacttggaattctgcccctaggcaaaacttcacatggaaatctagcaaagatattttcagacttgtaagatcccccaaattttcctctggaacccgacagtgtgctccaccacagcaagagaattaatccagaaaggacaagatgtagaggtggggtacaggaagcaggagatcacatagaagcaagaggcaaagggcatccccaggagggtgacagctgtgcatcaggaatgaagggcaagttcagattgaagcctcgtgtctcgagggacaaatgcaatgaggctttcatcattaggaggttcattgcctctggtccagcccgtcttttatttggatgacagaatggcagggcggtaagcctgacccagaaatctcatgtctacttgggctgtcctgctctcccctccatggactgtcacctggatcagctgggaacactcatcttacccccacagaagcgttctgctttggtcagtcctgacatctagaagtcggccatgttgagtttaattaacccatctatgcctgaggttgcaattttttgaatttttgcaatcagaccttgacgatgaccttgagcagtaggatataagtaactcccaaatgcttagcattccaataatggaacactaggcataaatgggtaaaaagcagaaaataccagcaatctcattgctggatatatacccaaaagaaaggaagtcagtatatcaaatagatatctgcactcccatgtttgttgcagcactattcacaatagttaagatttggaagcaacctaagtatccatcaacagatgcatggctaaaggaaatgtggtacatatactcgatggagtactattcagccataagaaggaatgagatcctatcatttgcaacaacatggatggaactggagctcattatgttaagtgaaataaggcagacacagaaagacaaacatcacatgttcttacttatttgtgtgatctaaaaatcgaaacagtagaaggatggctaccagaggctgggaggggtattgagaggctgtggggggagatgcagatggttaattggtacaaaaatatagttagaaagaaagaataagacctagtatttgatagcacaacagggtgactgtagtcaataagaaattaattgtacattttaaaataactataagagtgtaattggattgtttaattggagtataattggattgaataactaaaagaataaatattataggggacagataccctgttctccatgatgtgattatttcacactgcatgcccttatcaaaacatgtcatgtacccagtaaatatatatacttcctatgtaaccacaattttttttaatttaaagaaacaaaatatggagataccatctccagcaacaactatattcctgctggatgcccacatgaggccccaccagactgctccaccgagtgagccttatatttcccagattcactcaagaccttacccactgagtgccccgtggggcttttggaaactttcaaggacgttgaatctagttgatggcccaagatggttcttgggatctttttcctaacagtgacaaggttactttttctttagtcagccaagatttgtgctcactacttaatttttttaaactaaagaatgcattttttaaggatacatacatatatggtaaacacataaagaaaatcgaaggaattattatctcaaaggagaaggaaaattaaattggggagagcctatgaggtatttctaaagcactgggaatgttttatttcatagacttgaggatagatacacaggggttcatttcactgttattcgttaaatggtacattttaaatatccttctttatatatgatattaaatacaattgacaatttaaaaaaatcctttgcaatttttttcttttctgagacagagtcttgatctgttgcccaggctgcagtgcagtggcatgatcttggttcactgcaacctctgccttccaggttcaagtgattctcctgccttagcctcccaagtagctggaattacaggcatccaccaccacgcccagctaatctttgtatttttagtagagatgggattttgccatgttggccaggctggtctcgagctgctgacctcaggtgatccaccagcctcagcctcccaaagtgctaggattacaggcgtgagttactgcacccagcctcctgtgcaaatattgatacaagcattacatttacccacactggatttcatcttgttgattttagctcagagttcttttttaccaactgtgttagccaaaccatgtggtgtgaaaggtaaaagctggatttcttttttagggacttgggacaaaaaaaaaaaaaacagttgcaaaggaagccatttatgaaaatgtccccttattacccagggaacccagtaatcttatccttgctgcctcatcattttatgagtttccacaaacaaaatggtttttatttgtatttaaccaagtgttaagtaggtccaggaacttgaatgcaattcaaggttgccttctgggagatattgctgtgattttgtaatttttaggtaactataaagaacagaatttatcaccagtaaaaacagtttctgatttagtaatttattaaatgccctcaaatcaaaaccttaggaaatccaaacatgggaaaattagattaaaatgcatcataattaaggttattaataactttaaatttttccatttatactggagacagtttctttagtacagataagtaagtctctaaatccctttatgtgacataagcagtcattttctgatttccattccttaccaaaatttattttacagatgtcttatacgtctttgttcgagtgagatgccaccagatgaaaattcagtattacaacctggctcatctcatttcctcatggctttcttcatttttataatgtcagaaccatacaagctatgatgcttctttctctcaacaaaatgtgagcctcttgtcactgttggatgaacttttctttgagaagaaaagctgaggaacctgtgggacattgtattcaaattttatctagttaaaaaaaaattatctagcaaaaattgctgtgacatttcaatgcatgaggatcactaaaagaacatcctagtgtttattttttatttttctatttttgttctttaattctgtaatttttctaaatgttccacgtgaactatatacaggcatataccttatttatgcatggaagtattcctataaaatcatacacaatgaattctgctcaatcaactttgaaacacacaaaggaagcttgtaggaaaattggtcttactgagaattcctttagaaaatagtctttttacaaagcaagtgtttttttccttcatctaaatttcatgcatgcatttatttaaacataattatagggagcctaccatgtgtgagatgctaagaatatggccatgaacaaaaattgtttctgcactcagaggttatatttcagcgaaccagaaactaacaaactaattacacaataaattatttagcagggtgaggtggcacatagtcccagctacccaggaggctgaggcaggaggattgcttgagcccaggagttcaaggctgcagtgagctatgatcatgccacttcactccagcctgggcaacagtgaaacccctgtttctaaaaaaaagattttaaaaataaaataaaacaaaattgcaccagctttatttgattttgtgattgtcttctactgtctgttaaaatctcccactagaggcctgggcaacagagcaagaccctacctttatgagtcaatagatagatagatattatttaattacagttgtgatgatattatttgtgatagatattatttcattacagttgtgatgtctccaaaaaagtttaccatcctaaaattgctttaaggtggtcaaactgattaagtttaataaaaaaagggattctctgagaaagtaatgtttgtggggaaacataagactgagtaggagagtgccaagtactccaggaggagccagggcttagaaacttaccagagcgtggcttcacaaggagctgccccagagcccatgtgcccagtgctcagaaggcaatgatgtgcgaggcacagaaggagcctgacaagaagcagggacctaattatgcagggcttcagagaccatgttaaaattttttattttatcctcaaagtcatggaaggatgggaggatgataaaatttcgttcttattaagagagccctctgatttagaaggggcaactgtatattcatcctcaggttttctgaaaaatggcatgactaaaagaaccacaaagtcgtagaagcatcagaaggaattctttacaagtcatcaagatcatcgatctaaaaccactttatattatccctactgaataaaattgtatcctgtttttaaatgtaggtttcaaggcacagaattatgtctatgtttatagttgaagcatcctcaggcattgaactggcaaggacatttctctcagtgttcccagaacctctgtctttccaggtgtagatgattcaaggttgagagaagtgcttcccagagagcactaagccctgggaagatagtccagggacgtaagccctggttgtctaggcaggaagtgcccaggtgttactgaaagctgagaagccttcaccactcacagcagcatctgcgaagggagaaggaaagtgacttagcactgcctgaagcccactactccaaacctcgtaagaaggggctgttaagcatgtccacattacaagcttatatcctgttccaatgtgtcttatacctcagaggacatattgccctccccttgtgcagatgaataattctcatgaatcatttggataatgagaataattagttttttcagcatcgggaaactccatttcctgacttaaatctttcattaccttactttatgtaagatttcttgtgtcctgaactaggaaaaatgcagaactagagaggctagaaaaaaagaacatcagctctagaaaaaaagaacatcagctctagaaaaaaagaacatgtgctctagaaaaacagaccatcagctgggtgtagtggctcactcctgtaatcccagcactttgggaggctgaggcgggtggatcacctgaggtcaggagttcgagaccagcctgaccaacatggtgaaaccctgtctctactaaaaatacaaaaaaagttagctgggcatggtggtgtgcacctgtaattccagctacttgggaggctgaggcaggagaatcacttgaatctggaaggcggaggttgcagtgagccaagatagcaccattgcactccagcctgggcgacaagtgaaactccatctcaaaaagaaagaaaaaaagaacatgcgtgtcggagatgggacgccaaccttcagcattttggctctagcattaattagccaggaccctgagagaatcactttgaacacccaggattcattgatattgagcctgaagaaatgagggatttgacctaatcaatctcttacagtactgatcttgtatgtccccttctatggctaaccacacttttaactcattctgtaaccatatgcattcaatttaaaatttcccaatcccttgtaactttccagagacatctcactttccaaatgattaatcttttttttaactttgtttttattttatttatttatttattttatttatttatttatttattttttattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctgtgtccatgtaatctcattgttcagttcccacctatgagtgagaatatgcggtgtttggttttttgttcttgcgatagtttactgagaatgatgatttccaatttcatccatgtccctacaaaggacatgaactcatcattgtttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatgatatttccagttctagatccctgaggaatcgccacactgacttccgcaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaacattttctcccattctgtaggttgcctgttcactctgatggtagtttcttttgccgtgcagaagctctttagtttaattagatcccatgtgtcaattttggcttttgttgccattgcttttggtgttttaagacatgaagtccttgcccatgcaggctacagtaaccaaaacagcatggtattggtaccaaaacagatatatggatcaatggaacagaacagagccctcagaaataacgccacatatctacaactatctgatctttgacaaacctgagaaaaacaggcaatggggaaaggattccctatttaataaatggtgctgggaaaactggctagccatatgtagaaagctgaaactggatcccttccttacaccttatacaaaaattaattcaagatggattaaagacttaaacattagacctaaaaccataaaaaccctagaagaaaacctaggcattaccattcatgacataggcatggacaatttttaattatttaaaagatagagaaccatatacctgtttgtaccttaaaaaatttgtatgttgactggacgcggtggctcacgcctgtaatcccagcactttgggaggctgaggcgggtggatcacgaggtgaggagatccagaccatcctggctaacacagtgaaaccccgtctctactaaaaatacaaaaaaattagccgggcgggcgcctgtagtcccagctactgggcaggctgaggcaggagaatggcatgaacccgggaggcggagcttgcagtgagccgagattgcgccactgcacctccagcctgggcgacagcacgagactctgtctcaaaaaaaaaaaaaaaaaaaaaatgtgtatgttgtatttgtattacctattcaaaaaaataaaaatttttaaatggtagagataaatcttaagaataaagaaaaagaagacaattcaggaaactacatttggttctgtttttacagactcaataggaggggttgcaaagctatcaagacaagtgggagaaaaagaccaaaaagatcctgtctttgtgattataggatcattatagtagatcaaatatttggtcaattttttaaaatactgcataatgaactagaattttaatttcagaagtttgaaataaacttttaatttttaattgcctaaaaattttaattctatattatatttcctacttacatcttatatttcaaaaaatttttgccaaagaaagtttctggcaaacatttttgcttgcaggtgacttaactgcgtttttaagacagcacaattttgaaggaaagagagaaggagggcttaaaaaactataccattgtcatgtgggcattaagagtgtaagcttttggagttggaatagacctgatgattttctcattcaagtttaattcatgtaaaagatgtgtctcaaccccttgataagattacaggaaactcaaaggcaggaaccattaattatctccatatctgcagctataaaatattaagacagtgtactcttaaaaatgcttaacaagtgggtagatgactataaaagcttctaggagctgttcatggatggagattccagactttatctcaaaaaattttctcgacatcttaaaacctttccttaacaagtctttccattcatttaacccaccttctgctctcttgctgcaattaggaaccgtttgttcttattgttcttcaagaaagatgtagaatgtttgagcaacttcttcctgattttaatgtctttgcatttatgatacccatcacagtgttttacttaaattagcatttttggctttctttttttcttttgagacagagtttcacttttgttgcccaggctggagtgcagtggcccgatcttggctcactgcaacctctgcctcccgggttcaagcaattctcctgcctcagcctctcaagtagctgggattacaggcacctgccaccatgcctggctaatttttttgtgtgtgtttttaggagagatggggtttcaccatgttgcccaggttggtcttgaactcctgacctcaagtgatccgcctgcctcggcctcccaaagtgctgggattacaggcatgagccactgcgcctggccttaaattaccataaatggatgaatacttaatatagatttcattgccctttactttttttattatggttaaagaaacatataacatgaaatctaccttcttaaatttttaagtatacactacagtattgttaactgtatgcttaatgttgtgcagcagatgtctagaacgttttcatcttgcatgagtgaaactatgcccactgaacagcaactgccattcctccttgcccccaatgcttggcagccagcattcgaccttctgcttctaagagtatgactagtttagatacctcttaagtggaattttgcagtatttctcctactgtcattgccctttacttttacctcaactaaataatttagattcaatgtagaacacaaaattaataatagaacataaagaataaactaagtttttcacaccccattcaaacatcaaattgaataatatgctgaaagaataaggtgtgtgtttttacaactcttgcaattttaaacctgtattaatatatcttagaaatgagttgaccttgagctacactacaatgctaaactctcagaagcttataatcaccgtagtcctcagatctttcctaaggaacgtaacattttgacacagaagaatccttgcattttagcttttaacaaaatctcaagcagtctgttaaccagattaccatcagcatcatcagaaatggggaaaaggaaaggctttggtgggtggggcagggggttgataaaacctaagaatggagtgagaaatcgagtaaaactcaatgatgcctataggccatattacttggtaatacaaaaaaatagatatatatatttgacccaataacacgacatcaaaaactatatagtttgataatacttggacaaattttgaaatgatagatacatgaatttttttctagaatcaaatacaacaaactctgcatttgcctttgaagagtgagattattaaggggtattaggtatataaagggaattcgattataaagagaaacatttacactttattttatacttagtgtttaatttatttacttttgcacttattaatttgatgtataggtaaaaaattaaaatatttaaagctctcttcaatagacaaaaatgttttttttaaacatatcacttttacctacagttagtacttcttttgtttcagggtttaaaacataaaatgttttgaaacagatttgctgattttcattattgatggtctgaaacgtttgctcttagaaggatgttagtgaaggaggtttatcttatcaaattctatgagttagctactgcaatacagtagagcaccccaaaatttagttgcttaaagcagcaaccataattcggtgggtgaactatttggcttgacctcagctgggtggtttttgtggtctgtgccaggctaggctgaccacagctgggctgtctcagtgcggccatggtcagctgccaggatgacgaggaacgagtcagttagtctaggatggtctcttttggaagggcttatgtctgctccatatggtctcttcctcctacaggttagcacagccttgttcacctaagggttcatcagggttccaagagatggagcagaaacaggccaggcctctcaaggatttggctcagaattggccaacaacatcactttcaccacattctaggctaaagcaactcacagggccagcccaggttcaacggatggggaaatagactctgccactttatgaaggtgttgcagaggcacattaaaaagaggcatgtctacaaaggaaggaataattgcagccattattactaagaaatgtacaatacacggtcttatgctacccccaaaatttgtgaataaccaatagaatcactttgtgggaacccgaaatatatcacttttcttaacgtttgcccacataattatctttatactggtacaatataagcaattattcaactagtaaaactaattaatactctagatatagcttccttttaatgttaacagctaacactggctatgaagcatttgctctgtgccaggcaatgtcctaagcacagtatgtcatatcacaaaagtaggtggtggttagggtttggagtctggaccccagcttgctttgaatccctatgttagtatttattagctgtgtgaccttgggcaagtgaattaaccttattgtgcttccattttctacctataaaatgggctaataataaacttacataactcataagattgacatgatgattagatttaatctatgttaagtgctggtaacaatacctagtgtatagtaagggttatatagctgtcagctcttgttatcgtcatcatcatcatcatcatccccctcacaataaccgtgtggtggttaattttgtgtgtcatgcatgactaatacaaactctgtgaggtagcttctattattgtctccattttacggagaagaacactgaagttcagggagactgaccaaagtcacaaaggcaagatgtggcaggaccctcattcaagccctggcagctgtttcgagtctgggcttttcatgccctacaacactgccatgccacttaacagtaccttccagaatagttgtctacaggtcaaacatatacaggtcatgttcttttttcccccgtggttaacatttcagaagagctttattttccccactgcttggtttgcagctgagcagatataagaggtagctgtatgtacagaaagaactctgacatgcaatcagcttaactcctacatgcaaaatacagagctgcacacttgcagacatctcgttttatcttcacagataacccattgggtatgtattatccccattttatagatgaggacaccgagactgctcttgtccaacatcacaaagaatgggtctacctccaaagctttttctgctaggcagaattgctaaattaaatgtaaagagattctattgtaaacacttttgtaaagtgaatctgtaataatcataacctaatttgtttgttgtggaaaggtggagggtctcacttcttaaaagtgacttcatggttcaactctgatgaatgattctgttctcttcacttccagaggagatttgcaccctagttatcgctgagactttccctgaagatgcagggatctttacatgttcagcaagaaatgattatggatcagcaaccagcactgcccagctggttgtcacctcaggtatgtgaggagtaaaaaaaatgactgggttctgttccccagcaccagtgtggatggccacagcagaaaggcaccgtcctggccaggtgcagtggctcacacctgtaatcccagcactttgggaggccgaggcaggcagatcacttgaggtgaagagttcgagaccagcctggttaacatggtgaaaccctgtctctaccaaaaatacaaaaattagctgagtgtggtggtgcgtgcctgtaatcccagctactctggaggctgaggcaggagaatcacttgaacccagaaggtggatgtggccgtgagccaagatcatcccactgcactccagcctgggtgacagagtcagactccatcaaggaaggaaggaaggaaggaaggaaggaaggaaggaaggaaggaaggaaggaaggaaggaaggaaggaaggaaggaaggaagggagggagggagggagggagggaaggaaggaaggaaggaaggaaggaaggaaggaaggaagggacaaagcgactgtcccaggaagagagctcagctcagccttcaggaatctggccactccaggagtcaccctaacaatctaagttcatcgtgaaacaaaggctttaggggaggggagaagaaggagtgaagtggagatgacaaacaaaaagataatgatcgtgtagcaactgaacacacagggggctttctttaaaatcgtgcagtcttggtcttggaaacgatggagctggtttcctaacatcctcccgctaacctagaatcatattcacattggaaagccacctctgcatcagaggtgcagtcactttctcagcagtgccaacacatgagatctggagatacttgtacaaataagccattgtctgatccactgttgaaacttctgaaaaggtaatacaagataagccttcttgtataaaatgtaatacaagataaaactcagagaagctgtaaaggccttcaaactcaaatttcactgatagtctgtatcaatgatagtatataactaatatgaaaaagaaagcaatgtattgtattattgaagtcaattttcaaaaatatatggatattttctaaactcaaaaacttaccactagggaaggcaatatgaaacagctttttttctttttcttttcttttcttttctttttatttgtctgttttctagttactaatgagcattagcttactttaattgcctcatctctgccattcatcttaaagatatttttaaaatatgtttttgaccaagcctggaacataatgtacatagtagggaatcaataaatgggtcatttgttaaatgatacggacttggagagaacaactgaattgtacttggattccttcagaagagcaagaacttggtgctaggtggcagcagagacacaaccaaaacttatttagggaccttagagtggcaactgtaaatgctttttcatcttcattaagaaaagaaatgggagggtcatcttaagtgggaaatggtttctgtgaatgactactgtaagtgctgaaagaaacctaagtgtcaggatcagagttacagagcaaagaggaccccagcgttttgattccgagttggcttcaacactgtcccatcaaatggccatagcaggagtgcagtgtttaaacaatatggccaaaaccctgggctctataagtctgagtggcaaaaatttgtgtgtaatattttccatttgtttctgcagtaaatctgctataggtcaaacataatcaacaaatattttatttctgagctttttgtttacctcaataagcatttttgagtgcatgccaggagctctgctgggctgtgtgggcaaggtgcagaatctaaaaaagacgtgatctcaagatgctttcagcctattgagggcaacaaataaaaatctctttcgtactgagttatagttggagcaatcacctaatatggaaaaaaatatttttatgagattatgaaattttacttggactccaaggtttaccttccctagctttagatgaatatccacataaaacctttacagcttgagccaatttgagtagtgacagctaggatgttcagtcggacccatggaccaaaacgtgagaggacaaagcattgttggttgatactgtttgtgttgtcactttttttgccaagttctatctttagctcttgtttggaatttttatgattcggtagctgggttccccaaatgtgagctcagtcaggaaatgaaacggtagcactcgttcaaaacaagcttgaaagaaccaggccctccagctggcagtgcttctgcgtcagatgagagcagcacaatcacctcttctttaacaacttcacacaacacagggattctcagaagactctgacagtgtgaaatcacttgttgaactagtggcatcttcttatgtttttcctctctttccccttccttagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactgtgagtatttctgcatggttttataataatttccatacccctgttacatttcctgtctggtgagaaaaaaacttttgcctgtattcaactatgtggcaagttggccttgactcatgggaccttgctgccaagtggtgtctttcaacaatataaaagacacctaaaaataaagaagggaaatgaaaagcttggtgaaatctgccctttgctgaaagctataactggttatggctgtgaaaatatctgtgcccagtgtgggcttccaacatacagctaaggatgtagccactccctggaggccatggaaaagggggatctactttcagccctttattaaaagcatttcaaaaagtgagtataagtactttgcatttgttactttaaatattaagtatcagtaagaagatctgatatagacaagcggggaaagactaaaaactgaggctggaaattcagggtgcagatcctggcagggcaatgaaactggagggaagcaggcttgtgggcaagaagagcgcccttcacaacacaggctacttggcttggaattccatggagctgcatatttccatgaataccatcttcacagttgatgtccattattttcttaggatgataaaccttgcatgagctgtttccattggcaccgcacagcagagagttgttatgaatggagccattacaatgtcagagagaggcagaaataaattagctcaaagggttctaccatagcgcaagagaccctgaattactgccctgccagaggttagtggaaatgtaagagtcatagtgaatgtgtatgtattctatgaggtcacattcccatgagaatgtatttgccagaacctaggaaagccccttctatttacccatatctgatgtttttgatttggggcaggaagggcttctttaggggttattctttatttccctagcattgactagcctactcttttctctctgtgatcagttcatttgttagaaatgttagaatttaaaagatatttgaattagaataacaccttacctttgtacatcactttattgtttactgagtgatttcatgaacaacattagactaatcaaataacaaaagcagtcaaaagaataccttaagttaagaaatgggctaacaattatataaaaccagacttctggacaatcttgggttgcagtttcaaaaatcgatatattgctaccctctacttaattttgcattgtgttctggctctcttttaagacagtagggctactcactaagcttgtacacaatagtgtgaaaggtgctggtgaacatttaatacctatgcgccatctccattcagaggctgaacaggtataatgagctaaaaaatggtgtccttaaaagagatttatgctcttgtagcagcaacccataaaattaattgccactgctgacttctttcatctttgcattttgaatatgtatttgcagtgcttttaatgaaacaagggacctgctctccagggagagaaagggcaaatgtgttgaatgactaggacttgactgtggtcttgattaagtaaagtctatctactctaatgggtatcataaattggatgtaaatcacaggagagcaaatacgaggagctgttaagaggcatctacagcccgtcttatctcaggagtttcaacagctctgcagcttttagctctgctttgcagccaggttaatgtatatggcaagggggtaatatctacagaatgtagacaaaacaacttcgcgttcattaagaggatgacagcttaagcacaagtttaaagaacatcaggatttgcttgtgagtgagataaaatatgaatatatataaatatataaatataaatataagataaaatataaaataagatgcagaaaaaatggacttaaatgtatgaggcccaaataaataggttactctcccttcatgaggaaatttaagggaaaaagcagaacacctaaccacaaaacccaacagcttagaaacaacatttacttgtactaggttttcccattgttttttttttttttttttttttttttcaaatcttcgtatgtttaaacatattcttagggaatcacttgatttttgttttttcgtgttgcatatttacctgccatttaactaggtagaaaataatatgtgatgatactttttaaatatatatttttaaattttcttatgatttagaatatgttattggattttgttttattacaaaatcagtggatgcttgatgtgacaattcaaacaacacagaggctattaaagtttatactctctgcttcccttcttccaacccagccctctgaaagttgtggtatggtgtattatcagagccttttctaaaaaaggtttttgcagtgttttcaaagttttctttcagtgtttgttcagttttcaaagtgctctttgcttccccatttccacccctctcaaaggtgtgatattctgtattatcacaaccttttctaaaaaatggtttgttcagtgttctcaaagttgtattattgatagagaaatactattgaatgacatctacaaataatgtagaacagcatctgagttattgataatgaatgactataggtaactgccaagtgaaattcttacacattcatttttttcttttcatacattgtgggaaaatatgagattttatttgcctcgtgtggtcagcaatgaaaaactatggtttgctcaaatcttcttttcatcggtttatgatttgattttctttcacaaaaggaaaggcttatatttggtggcgttatggcagtttgtgcatctccatcatttgtaaacaaactaataggaaacaattcggagggcgcaagtaataggaactaaaatatttactctcacaatgaattaatctgaaaatggtgtctgatgtgtcagatgtctgggggaaagaagatcattttcaaaaaaaaaaagaaaactgcattttttttctctcttgaatagctccaatactgattgcgggaaaagaaaaaaaaaattcaagaatgaaacaaaaacctggaagggccatgagctcttttctctaactaggcccagcccccaccctgtactgtccaacagaagtcgtcacctatagactcacagccatcccagacctccagccgagtctgtggtaccgctcataaagtaggggttcctggtccagtctatgatacctctcataaagtaggggttcctggctcagtctgtggtacctctcataaagtgagggttcctggcccagtctgtggtacctctcataaagtgggggttcctggcttagtatcgtggacgcatccacttcagctcctacatctccctttgtttctaacactctccctcaagtgtaagcagaagatagttaaatgtaggccatttggtgagtcccagatgacctgcacacaggatttgtgcaacgccttaccacccgctgtgggactgcgaagtgtgcttaaacgctgcacaagaaaaaattaatagcattatttctgcaactcagtggctgacactcacaatcttcaatcacatcatgaaagaagcaacacaatgcttaagtcataatcttaacaggaggaaaaaggagggaatgagcgtaaacctaacttatacactattcttttccttggttccttgctgccctctcattacaaatgatatttgaagatcaaaataaaggtagggctcactgtgaaaaatctctgcttctctttattcctaccaaaaaaacggtccttcagccagggcgcggtggctcacccctgtaatcccagtactttggaaggccaaggtgggcggatcacgaggtcaggagatcgagaccatcctggctaacacagtgaaaccccatctcttctaaagatacaaaaaattagccgggcgtggtggcaggtgcctgtagtcccagctactcgggaggctgaggcaggagaatggcgtgaacccggagggcggagcctgcagtgagccgagatagcgccactgccctccaccctgggtgacagagcgacactccatctcaaaaaaaaaaaagtcaaaaccatagacatgcatggaatccccctaggaataagctctgaagggaaacctgtgaatggcaaaatgtggtaggcgatttgccaagcatatagaaaggcatggtcatgtttttccactgagctcacctcctacggcagatccaacaatatataaataacaatatgctgttttcaaatcccctttgttacttccttttttatcttcttcctttgtcttgtgggagaaaggtaggactctaagcctgtagacgagcaaaatgagaactccaaagggaggttactgaagggtgatgcgatgggcaagttcttaccctgggacagatcagcagataaaatgatgcttatttgttactctagtgccaaaaatatgtgcattaccgtgaaagtctgtgtccttttgcctgggaaaataataatgaaatgattgttaagtgtttacatgctaaatcaacagctccccttgctcctactcttactacttgctcttaccccagtctctaaagaagaaacagtattatgattttctatcttaaaagagtaaaacgatttcaggctgaatcaaccttttcaaaattactgcattttacaacctttgcttttctcttcctttctctcactcccaccctttgataccctattgttctgcaaatcctgtctccagagaaagacatagcctataaaatcattcatattgagctgttagggattgttagcatcacctcagtccagttctaggctaacaaagtaaagtacatcttaataagcaataataagcactgcacaaaatcaggaaaatatcatttcatgagatgatgtgtttgagagatagaagagaaggaaatagcagcctttatcattctctttattagtgaggttttccatatttggaaattcctgatgggtttcctccacactcctagacacaaattgaagtacaagttgttcccttgcctggaatgttccactccccagaatgttctgcctcttatggctggctcttacttgtctttcaaatctcagcttaatgtcaccacttccctgaccacccagtctaaagcagccacccagccatgttccaataactcatcctcattaattatcgcataccacataattatttccgacagttacttgctttttgttttttttaattgctccctgcctccaatattataatgtagcttcctgagaatgggaaccctgactgtcttatttcattgctctttcactaggaccctagaacagggcctgacaaatagtagatgctcaacgatgttttttgaatgaatgaagcaaaagcagaacaaaaaagaggaaaagaaagatctcccacctttagagcaacccccatttgatctgcctaacgttctttttttgtttttttgtttttttttgagatgaagttttgctttgtcacctaggctggagagcaatggagcaatgatgtgatcttggctcactgcaacctccacatcctgggtgcaagtcattctcctgcctcagcctcccgagtagctgggattacaggcacgtgccaccacccctggctaatttttgtacttttagtagagaccgggtttcaccatattggccaggctggtctcgaactcctgacctcaggtgatgcacccacctcggcctcccaaagtgctgggatatcaggtgtgagccaccatgcctggctgatctgcctttcacctagatataccataggacttctattttcaaaccccatcaactccagagttttcccacattacagtacttttccaactgacatcatttatcttgtaaaccaaatgagtatgaagaattaaataagaatctcatgggatagaattacattagaaaagtttgtccaagttacttaatttgggaacactttcaactccttcctcatttcttctgtgttctcatttgattagcatcttaatttaaaacattatgaaaaatgagacattcggaaggactaggaggacattttcactctctagtacatacttgcaatgtcagttggccacagtgcaatcacactgctatttcaaggtgtgtgtacttgacatgttaacaccccatcagatgccagacttgtggtgaagggccaagagcttctgtgctactcccttcctgtcctgtttatgttggactgcagcttcaactccaacgtgtggctttggcaatagaacttacaaagttgaacattatcccgtccttcaacctctactagttagggttcaagatctcactatattactgtttgacattagtatacaaatggtttcttaggttctgttcttgtataaaccttacctggttgattgaaaagcaaagcaaaataaaaacaaaaaggacaaagacaaggtaagcaaaaacaagttgggacaaaataactaacaaagggtcaaggaaatgtaatcattgaatgtacataaaagtattttaaaatctagcacacttttttttcttaaccaatatttctaattttttacatgtctgcaacctgtagacttaaatcatccgtaatttccatggaatttcatgtatgttcagttagctagccattactttcatttcttttcaacttaaatttgttttttctaggtaatacaatcacacagttaaaagtataaagaaatatatgcactgaaaagtctgcctctcggactcagtaaccagttgtcactgtcttgtgtatcctgccagagattgtttacatgcctatcaagcaaatatatacgtatatataaaatgtgtattttttcttttatttttagacaagtgcctacccaccacatatactgttctgcaccatgccttttctatttagcagtagattttagagatgtttcatgtgagtaattaaaaagtcttatttttaagtgattgtatatatttattgtagaaatgattgataattcctttctctattgttgccaatctaatttttttttttttttttgagacggagtctcgctctgttgcccaggctggagtgcagtggcatgacctcagttctctgcaacctccgcctcctgggttcaagtaattctcctgcctcagcctcctgagtagctggaattatggacgtgtaccacaacacctggctaatttttgtatttttagtagagacggggtttcaccatgttggtcaggctggtctcaaactcccgacctcgtgacccacccgtcttgtcctcccaaagtgctgggattacaggcgtgagccactgctcccagccaccagtctaagtttcaatgacctaagtaattatcaaaagtaatcttctttttttttttttttttttttttgagaaaaattctcgctctgtcacccaggctggagtgcaatgacacaatctcggctcactgcaacctccgcctcctgggttcaagtgattctcctgcctcagcctcccaagtagctggaattacaggcacccgccaccttgcctggctaatttttttgtacttttagtagagacgaggtttcaccatgttggccaggctggtcttgaactcctcacctcaggtgatctgcccgccttggcctcctcaagtgctaggattacaggtgtgagccaccatgcccagccaaaagtattatttaaaaaagtttttcttacttgtattttaggttcggggatacatgtgtacgttagttatatatttgcctgtcacaggggtttggtgtacagataattttgtcacctgggcaataagcatagtacccaatagataatttttctgatcctctccctcctcccgctctccaccctcaagcaggccttggtgtctgctgttcccctcctagtttccatgtgttcttgttgttaagctgtcacttctgagtaagaatatgtggtatttgtttttctgttcctgtgttagtttgcttaggatcatggcctccaactttgtccatgttgctgggaaagacatgatcttgttcctttatatggctgcatagtattccattgtgtatatgtaccacattttctttatccagtctaccattgatgggcattaggttgattccatgtctgtgctgttctgaatagtagaacaccattcatcccctcactgttagttgaacatctgcaaaatgctgggtaatgtggggtgctgaaaacacaaagatgaaagagacaagagcagtacctttgaataatctataacctggttatctctacgatgattttggcaagaacgtgcagatgcatacacatatacacaaaatgctgcacatctttcagcatcatacaaattttgtagaagaatggccaatccctaaattagattcagtgcaacccaaatgccttctcttcccactttaatgtttgaaagatacatcattcagtttttgattctgaagatttaatatgcaccagcttttgtttctggttaagtgattttcattatcctcgaaggctagtcaaataacaaagcaatttagtaatggcaaaagcataaagtgtggaccagaggggtcttcaaaatattagggaagatagagcagaaaaccatttttttcagtttgttgttataaaattatacacacactctgagtcaccaaacacattggaggttgataaggaacataggagtagtcacgggtcctaattctgcagtacgtggctatgcgggtatgaactcttcataaatacaatgtgatgatgactttgcatttgcatttctcttcctcctttctctcactcccagtcttagatacccgattgttccataaatcttgtcttaagagaaaggcatatcctataaactcattcatgtgaaggtatttgcattagcagtgttggtcttggatcactttgcaaacaacccttccctgaaaatgagaagtccaatcaaggagcttcctgaagtataaaacttttttaactaagtaataacatttaggtgcattcatcctcatgattttttaatgtaaatactggctctgacacagtgccacattcttagatattaggctaattgtgctttgctgtgccagtctcttggtgaatgtaatgtttaattacatttccagaagaaagctgagttctatttttatgattaggagttttatttgatgtctgaaatataattggaaatacttgcagataccctatctgtgtttgaagtggcactcaatcatccataagaaataccatatgtccatttcaaatattaggtgttttacatgaaggaatacatgatgataacaatatttcttcaacatatcttcattttacctaagtgcgtaggagagctcttttagtaattacaaagtaaggtgaaaatagtcatccctactgggtagagaccttttattttaaaagggggagtggctaagctcagagataagatggagccacatatgaacaatatgctcatagataaagctatgaatttgatggaaaatatgaacaatatagtgttaagtgaaaatagacaaaatgatatatgtaacttaatgtcaattttatgaaaaaataaaaaataatacactttaaccaactaaaatgtatattatatattagaagaaaatacaccaaagtgtaaccagtggttctttgagtgctggaaatttgggcagattatatcttctcattaactattcctgattttccaactttttgacataatgcttttataattacaaagtattattttaaaataaataggtacttttgatcctttctcttccatcctccttcctccattaaacttcagttcatttgactgttcatcatggatgcttcttgttaaataatagttgcttgctaagtaagcttaattttgagcacattcagaagtggaatgctctggcactgaatgttctcacctcccgtgtgggatctccttctagaaaccaatgaccttcaggattccatctggatttttagaactcttcctaggaatccttccccagaaaatgtcctatattccaaaataactttactcctccacaaacactgttttccaacaacacctgcccccaccaaacaaaactcttatccctttaattgtacatctcaggtgtttaaatgaatatgatatgaataagctatttatgtatatatgtatgtatgtattttcaagccagggtctcactctgccacccaggctggagtgcagtggtctgtcacagctcattgcaaccttgacctccctgggctcaggtgatcctcctgcctcagcctcccaagtagctgggactacaagtgcacaacaccacacccagctattttttttattttttgtagagatggagttttgccattgttgcccagccaggtctcaagcaatctgcctgccttggcctctcaaagtgttgagattatgagacgtgagccaccacacctggccaattttaaagttaaaagtaaaccaaatactttaaagaccaacatttacagtataatccatacaaggccttccacagaaagtaggatgaaaactttaccctcagagacaatggtgaaggagaaaagatgcaatgaaggcaagactaagattccaattcaaataacaataatgtcaggaaagtatgcgatgaaggcatctgctgaaagaggaaagacagttgtggtaactgtgggtaatattacaaagcacgaaaagggtggagaactaagagagagaaagaataccaaaaaaggaatgtgtatatttcctggcaatcaagagaacccatttgaatttcaagagtgtaaacccacattcaattcagtgagcatggtttcatgactttatttcagcaataatgagcactgtgaaggtagaaacaggacatatgtctttggcagtactggcacagtgggatgttatggtatttaattagatgatccttgagaaacattactgagattatcagccaagccgtgtgtaggttcagaaaaggaaacagattcaacaagattaaggcttgaggggaaaagagaaaggaatcaagaaaatggaagttataccaagaatgaaaatggggagtgtcagatgagaaaatatggagagggagcagtggttgtgatcaaagagaggattctgaaagtttaaaaaacttaaactctttccaagtgataaaagaatgtaagatgcatctgttcgagtggatagtttaagtggaagttaaggtcgcaggagcagaggaagtggtcagggaaccatgaagccaggatgttagaaggaacattaacatggatggtggccaacagtgatggcagaaaaccaaatgctaaatagtaaagtcactgagaaaagtgaggaaatgaccaaggttgttggtgacaagcagggaagacagaatgactgtaggtggagtgcaccaacttcaaaagaggaacagatatttcgtagtgatggcaaaactcttctgagagttgccttgggaaacaaggaccctgcagaaccctccttgctcagaaggatactgaggaggctggagacatcatcagggacagccagacttcagttaagacaaagcatttctaaggaaaaggtttgaggaagcagagtttggttagaaacagccaaggaatcccataggcaatagaagagatctagaaaagggattcaagggagaattggagaaggaagatgaggaggaagaaagctatagtgcagagttttgcactacgaacctctggatgctagagcagatacagaaattctgtgtcagcattcctactgtgttgtgctagagcacactactctgtaccatctgatgctgagaagcaaaagcatcgtcctgaggatcacttgctgctatttcatgaagagtgactaagattacttgcagttggaaggaaatagagccatttccaatataattactacttactttttagcctcctatttattttagttacgtggtagcaccatgatccattttgtggttactaacctctaagtacgactttgagttgggcttttttttttttttttttttctggtggagtctcactctgttgccaggctggagtgcagtggtgtgatgtcagctcactgcaacctctgcctgcgaggttcaagcaattctcctgcctcagcctcccgaatagctgggattacaggcacgtgccaccgtgcccagctaatttttttgtatttctagtagagacagggtttcaccacgttgaccaggatggtcttgatctcttgacctcgtgttgaattgggtttttattgaacaagcccaattcctcatttgtgtattttaaaatgattgttctcaactaatgactctctaattcatatttgcttaatttcattttatgtttacaacttttactactagagaatttatttttgtctactacaggctgaaatacattaggttgacaatttttttaccattgatttattttttctgcaaatgtgtgagtttttcattcatactaatacatcacctaatagtgagaacattagttacagggaggtttattttaattggtttctattacaagtatgaaaccagagagttcattttctcaacaaatctgagagtgattgtttccttacctgactaaagtgatgattacacaaaccttgtggatgacagtggagtcaatgtggtttttaaaaaaccttttccatatgtgacaaggaattagatagtatgtcatttgattttaagaatgatgaacatattaaattgattctgtcaaatgtagatttttctaaaataagttggctggataaatcacgtcaatttgaacacacacatctttgcttcattattcaaagagaaaccataattacgatcagaacctcagattttgctctaggagcataccaggttcatgccttccaacctctgtatgtgaaggtttcctggtaggatgatactggctcctcttgcccaaggctgtcatgaggatgcacactcactgcaagggttttttatggtgctgagaggaaaggccttcataaatatgtacatttacttaatttctgtatctacattcccactgtgttttcctagagctcactactgtacaccatctcgactctgaagccctgggaatgtctgctctatgctctgctccatttcacaatgttctttaggtctgttttgttatttaaatgtaatgatgtatgtatccacaataggtagcatttgagagactccagctgtgagcctctggatgtgaagctagtgaaacaattgaatgactaacagttgaatgcctagccaaatattttcacttcactttatatgtcagcaatggaaaagagtaggtgtagccatcgactcttcttttcgctcagagaagtttataaataggtcaaaaatgggtaattatatgcctcagctacaatttcaaacttctgctttcctagtaattgccattaaatgagtaagttgtaaaagatttctggaaagaccacaaatattttcttttccttgtttctttgttaaaatagttcatataccatctggtttcggggatgtatcattatgctcaatgtttgaaacaaaaaaaccctaaaagacataaaaggtggcttgagtacaatgcagtgaaaaagaacaatatattttattctctttaatttcttttttttttttttttttttttgagatggagtcttgctctgttgcccaggctggagtgcagtggtgcgatctctgctcactgcaagctccgcctcccgggttcacgccattctcctgcctcagcctcccgagtagctgggactacaggcacctgccaccacgcccggctaattttttgtatttttagtacagacggggtttcaccatgttggccaggatggtctcgatttcctgacctcatgatccgcccgcctcggcctcccaaagtgctgggattacaggcgtgagccaccacacccagcctgttctctttaatttctaaaataaagttttagaaaaaactaaaactctaaaaagagtagcttagtcttccaaacagtgctagttacaggggcaaattcttgctccaggtgactgtttttatgtgccttcccttccctcatagccactgctttcttcaaagggcatcctctaactcaaatgtgaaatattcatgtgtatttttattctatcacaaaacaattttacacagataggattactcatgatgaagcattctagaacaacagcaagagtttcacttcatgtttgttgtaattattctatctttgaaaagcagaaatatatgtggttattatcataattaagacttcctgatactgaacagctgccttactggagagaaatgttaggaattttttatttttactaaaaactgtcagaagtttctaaaaggaattagatgaatcctgaaggtcctgtaacttgaaaagttgatttacgctgaggaccccattttcatcaaggtatcaactagagagaaacttgtatttttcttattttgcattacaataatgcatcttgcttttcttttttatgaagtgttcactttatttttattactccaggtacccaggatcattcatgctctcttctttaaggtgttgtacaccttgtgttcagtagacatttttaatttttttcttctctgagacaaggtctcactctgttgtccatgcctggctaatttttttcttttttgtagagacagggtcttgctttgttgcccaggctggtttcaaactcctggcttcaagcgatcctctagccttagccttccaaagtgttgagattataggcatgagccaccacactcagcccagggttcagcagacactttgagaggtcagatagagttcatccttcaggcagatgagatgctgtccctttaaaaaaaaaaaatcaacttctattttagatataggggatacatgtgcaggtttgctacatgggtatattatacccatgtagtgaatgtagtatccaataggtagtttttcaacccacagcctcctccctttcttctccttctggtagttagcagtgtctgtcatttctacgtttatgtccatgtgtgctcaatgtttagctctcacttgtgagaacatgcagtatttggttttccatccctgcattaatttgcttaggattatggcctccagctccatccacattactgcaaagtacatgatttcattcttttatatggctgcatagtattacatgatgtatatgtaccacattgtctttatccagttgaccactgatgggcacctaggttgactctatgtctttgctactatgaatagtgctacagtgaacatactagtgcatgtgtcttcttggtataatgatctattttcctttgggtatatacccagtagtgggattgctgggttgaatggtagctctattttaagttctttgagaaatctccaagctgcttttcacaggggctgaactaatttacattcctaccaacagtatgtaagcattcccttttttccatagcctgaccagcatctgttgttttttgactttttaatagtagctgatgtgacatggtatctcatcatggttttgatttgcatttctctgatgattagtgataagcattttttcatatgtttgttggctgcttgtatgttttctttggagaagtgtctgttcatgtcctttgctcattttttaaatgggattcttttttatctgttgatttaagttccttataggttctggacatgagacctttgtttggtacatagtttgctaatattttctcccattctgtaggttgtctgtttacactgttgatagtttcttttgctgtacagaagttctttagtttaattagatcccacttgtcaatttttggttttgttgcaattgcttttggaaacttcaccaaaaatgatttgccaaagctgaggtcaagaaggttatttcctaggttttcttctaggattgttatagtttgaggtcttatatttaaatctttaatctatcttgagctaatttttgtatatggtgaaaggtaagggtctagttttattcttttgcatagggctagccagctatcccagcaccatttattgaatagggagtccttttccccattgcttgtttttgtcagccttgtcaaagatcaaatggttgtttgtggctttatttctgagctttctattgtgttccattggtttatgtatttgtttttgtaccagtaccatgctgttttggttactgtagcctagcagtatagcttgaagtcaagtaatgtgatacctccaactttgttctttttgtttgggattgctttggctatttgggttcttttttggttccatatgaattttagaatagttttttctaattctgtgaagaatgacattggtactttgacaggaatagcattgaatctgtaagttgctttgggtggtatgggtattttaacaatattgatctttccaatccattagcatggatgttttttcatttattcatgttgtctctgatttctttcagtagggttttatagttcttgtagagacctttcacctccttggttagctgtattcctaggtattttattttctttgtgaatattgtaaattggattgtgttcttgatttgactttcagtgtggacattactggtgtatagaaatgctgctgatttttgtacattgattttgtatcctgaaacctttctaaaattgtttatcaattctagtagccttttggtggagtctttaggaattttctagatatcgaatcatattatcagtgaaaagagataatttgaattccttttttccttttggatgccttttatttcgttttaattgtttttttattttcccataagttattgtggtacaggtggtatctaattacatgagtaagctctttagtggtaattcgtgagatcttggtgcacccatcacctgagcagtatacactacaccatatttgtagtattttatccctcgccctcctcccactcttccccccaaggccccaaggtccactgtatcattcttatgcctttgtggatgccttttatttctttctcttgcctgattgctctggctaggacatctgtgtcttgcctttctaagatgaagttctgttttaactcttggtgatagtagtaaatgacctaaataaattaggtccaactaatttagtaagcgacctaaataaattgtgttccaactaaaatgggaagtgaaatggataaaaagaaggtacacgttttaaattttgtccaatttcttggtctttttagtcagaacaaaggaggaagacaccagctgaattcagttctagggttttgctaggtactacatcatgggcaactactgtgcttttgctttggatctcaacctcaaactcctgggctcaagggatcctccaacctcagcctcctgagtagctgggactataggcatgcaccaccatacctggctaattttttttttttttagagacggggtcttgctatgttgcccaggctggtcttgaactcctgggctcaagcagtcttcctgccttggcatcccaaggtgctaggattacagatgtaagccactgtgcctggcctgggcatcttcttaaacattgtttttctcatgacattttcctgctccaaaagtagtgcctcttaaaggcaggaaaactccctcccggaattccccatcattcattccacccttgactactgctccctaggatcaatgcacagttgttctcctaggacttcccttcaacatcattctcgtgtacttttaccctcttcttctcctggctcccttggttcctaagtgccatatatttcactttttattttatcgtctcatttaccagaagcacattctccagtagcttccaaagaaagggtacagaccacattaagcttctagaccctgcttgtctgaaaagtgtctttattctagcctcacactaaactgactgtttggctaggtttaagagtatgggtttttcctaagaacgttgaaggaattgcttcatattctagttcctagagttactgtagcaaaattcagtgccaatctggtttctaatcctgtatatgactgactttcattgtaaaactatctcttcacccctagtactttgaaatgttgtgatgatatgtaatatttttcagaaattatagaaaatagtgggccctttcaatctgaaaacactcatgtatatacattctgaaaattttcttatttttaaatttcttctccattttccctgttctctctttgtgaaacttgtattattacattaataaaactcctaattgatgttctcacttttttcttttgttgcctatttttattgtactttctttagacctcttcacctttgtcttccagaccttctgctgaatctgttatttctgctattgtatttttaatttccaagagttctttctcattctctatattctttcatggcattctgttctgtctcatggatgcaatcgtgtcctttgcctcatattaatcattggattttggaggagggaatcctattgttattgtcattttgttttgttttgtttttcccctgttccctgcattgtctctatttcttaaaattccttttttttgttgttgtttttctgtgtgtgcatttggactaaatttcatgttcgaggctttccataaacatggaaagcgtgatctttggcaccagcaagttgattggaaactatatgcttagctagaatgtgtcaatgggcaggctttaccctaggattgggcaagacccccaagtgccaatatcttcaggtcttgggttaatcagtttctctagaaagacagatattcagccaccttccttgggatggtgggggtggttgtgggggcaggtaacatgcttggcagacagcatttggagcctgagtaagggaagggggttggcttttatcatttagtagacatatgcatccatctaattccttacccccatttttcaccctcttctcttacctgttcattctgctgtgccagatgtttccgagtttgaaacccttttggctctccatctccataaagtgagctttctgtattctagagtagtagaggaggaatggttgactacctacaagaaatgggggaagggattcagctgccttcctacaaactttcagccagtcttcttgtactaagctccattcctcttccccaccttcagaggaatctagtgatcaaggtttctgctgctcacgttagcatccctcatgtttgattcactctctgtaggcacttgggttttcctctcctgataagtcagtgacaactcatccttttacttttaattccagtgaacttacagtttcacaatccgttgctctcagttttttcacgatgaagcaaggaacaaaaataaacacatccattcaatctgccatctttaagtggatgtcaatttatgagacttcacagcttgtttttgaagatgattctttccagctaaagaaagcagtataggacagacagaatctcccctattcccaagctagatgaccttagataagctactcagtgccccatttcagttccctcttcattaagagggaatcgtgacagtacctacttcacaggagtgtggtcacgtgaaataatgtgctagcacagggcatgccaaagggcagatagtccaattgatattatctgtctttgtttttgttattattaagacaatgttcacaatgaatcctttgttatttgacgcacatatagaaagtttcagaaataagcaatttgcaaaacttgcaaaaaactgtaagtgaattattcctctgctatgctgagttttcttcctccaccttcaagaagtggcaaggaaaaaaagatagaaaaatcactgaccaattagaagtttttgtttcaattcagaccaccctaaagttcctggaaattgcatatatgaactctagtaagctgaataccaaaaatgagagggaagtagctgataccaggctacagattgtgggctacaaaagattgataaacaagtggttcttttgtgcaaatttagatatgaaatcatgcagaaaacacttaacagaccactagacagaggattttatgagacatgttacacatggatggtgaaaggctgaaaattaatacttaacttgtcatgctttctgctttgaaatgctggagccctccaggaattttgttttaacaaccaatggagatatcattagggagatacttctgaattcgctgcatctcattctgtgacaaagtgctgcacaaagtaaaatgtacctaccactttcatccgagtttgtagcgttggacaaatccctattccacaatatcatgtgtacaaagagtttccgaagaacttgtggcatatttcttgtcagttctcttgaagttctcatttccccttttcctctcctacgggcaggtgattgattgacttagagtcagtgctgagtagtaaataacttaaaaaacaaatctagagatgatctggagaaggctcgaagaaatgtgatatgtattatctgggataggcctagaataacctgaatttacaatgaaggagcccagtagccttttctagaaagccgcttgctcttccactcttgtttcctcttaggcaagagaatatcactagaagctcagaaaattcaggattgattggaaatgtttaaaaagtgaaaataaacacaaatatctataaggctaggaacataaccagaaaactcagaaaaacataggggcttaaggatgttccaaaggtaaaaatgacctcaaagtgaatttctttcttttctaatctcgacgtaattcagttcttattcaagctgagactacccaaagacaaaaatgttgcactgatttaaaatatgactcatcagaacattaaaatacttatgatacagatttttatacaatccgatagtctattcctcacaactcattatttgctccctttaaaatatttcacaaagaaagtcttaaccagaacatgatcatgtaactaagagctccacattcagtagtaggataggtcagaagacttacagggatgttcctcatgcttacaaaaagaaatttgatattgtgtgataatacacgtaagctagaaacttgtggttaaaagaaatgtttaggactcatgtaagcataggttcttggtatctttttttaactgatatatcatagttgtcattttggggggtacatgtgatattttaatacatatataatgtgtaactattaagtcagggtaattgagatatctgtcacctcaaacatttatcttatgttgggaacattaaaattctcttcttttagctattttgaataatttattgttaactataatttccttactcttctatcaaatcctagaactttgtatttttgtacccattaaccaacttcttaatttaacctttaaataaaaatattttcattcctaaccctgaaattctacaaatttactgcttagggatgactcctgcatgttttctcttccttttaagtagacaagttctaaatcttagctgactttcattagccatttgactaatcccattttttaaaagtgtttgagatgggttgaaaaatatgaccaatgtgatgagtacaacttgatcataattgtaaaatattagtgtgctttaggtgttagcaattaagaaaatgtgaaatgttttatttcttttctttccttcccttttttttgaggggcgggggtgggtgggtagagacagggttttgctttgttgcccaggctggttttgaacttctggcttcaagcgatcctcccaccttagcctcctgaagggctgggattacagaaatgttttttgttgttgttgttggttttgttttatttttttgagacggagtctcgctcttttgccctggccggactgcagtgggtgctatcttggctcactgcaagctccgcctcccaggttcatgccattctcctgcctcagcctcctgagtagctgggactacaggcgcccgccaccgcacctggctaatttttttgtatttttagtagagacggggtttcaccatgttagccaggatggtctcgatctcctgacctcgtgatctgcccgccttggcctcccaaagtgctgggattacaggcgttgagccaccacgcccggccacagaaatgttttaagtagtaacatgattgttaaaatctcaaatcctgagtatctgagatatcggtttgatacttagaaaatcatgagctctggaatcatttttcaaatgcctatctaggatttgaattggcatcttaattagtaacatcagtgttaactatggcaactcatttgtttcccaaaaaaatttactattttaaggttaaatataaaataacggtataagtcctgggtttgatttttttttttttaagtgtaaaaagttatctgtgttcagtaggtggagaagccagctacatcctgctgacacaaagctaatcagtggcttgacaactctagtcaaacatccacatagaatgtcttggccataatctatgtgtctcctgtattgtttttgttttaaaagatttgagaggaggggatgtggtggaggaatggtgcagctcgaaattgcacgtagttgccaattttcttttttctagtttgaacatatttctgctttgagcttctttcagctcaagtgagccattttcacctattatttcatctgtcttgctctgtcttcaatcttcattagccgttactatggataagctgctgtaaacgtttttaaaaatcaccctcaaggagtacaatattctattaaaaaatgacctttccaggaaactaactaatagcattagaaaattaacactattcctttaagcactaaaactgaaaaggagagaaggaggaggaggagccaggcatggtggcacacgcctgtagtcccagctacttgagaggctgagacaggaagatcacttgagcccaggagttcaaggttgcagtgagctatgatggcaccactgcactctagcatgggccacagagcaagaccccatctcttagagagagagagagagagaggagaaagaggagggagagggtgatgctagtagtagtagtgtagtaaggatggcaatgttctgaaatgtctacttttctatgtaataactgaaatttttcttggaggctgagtcattctcatgaatatcaaagattgagcctgttattcattgaagagctcttgcaatataatatttgattctgtttgccccctaaacaatgtcttactcctatacaatcagcacggccactgagttcaaaagttatgtgctgtccccattggcagacaggcatccgcaccacagactagactgcctgtcccctgccctcactgctctcgccccactggccttttctcgaggtcccggccctcacttcatcagttccattcagtatatcccccaaacagcatttccactcagcctgccaaggagaaggaaagagagtatttagaatacgtccttcactttcctgagagaacagctttaagaaaagaaaacgtcactcctactcatgttaaccacctattgccatataatagaacacattcttatgctctctgagcctgtctcttttcttcgtctcactgtttcttgacggttatgttgcaacctgaggcagagtgtcagaaagagatgagagggatggcaaaaacccattcatactttgagactccttttctctaatttttaaagctttttctctccttccattagatactgttgtttctgcgtgcttctagtatacatagtcaacaatcatgttggtgaaaactccctcagggcctttttttcttttttcttgttctttctcttttcttcctggctgggggcagtatttcagctttgggttttcgtctttgatgattgctgaaagtctgtcttctgaacaagcgaggattagttgtatccgttttgactctgactttctctttccctgttcctctacctcccacatttgcaaattactttcattgccactctgtgaaaagcagaattactcctattaatagctgggcacttgactaacattccacaggttaacccaagctttgccaaaaggaaacagcatagaaagacccagaaactctccagtgatgtggtatcagtggaataagctctgccactggagctcattcagtggctcaatgagtggcagagcttgggcagcaatgcaaagtcttcctgtgaccacatctttaatttgagtctattcgttgccgcaattttgcttttgtttttcctttctcaaaaatggcctcattttgtgaaaacaaagtgtttgcactgataattaataattactacacttttattctggtatgtatacatacttagaaagcatcacacatgcatgtgtgcacacatacacacacacagtgtgtatgtattggtagcttaggcctgggtcagtagctcagaaacatcagaatgcatttgaaggctttagcctttccttcatgattagaagatagctgtagctgctcaaataccaagtgctgtcaccatctccagagcaggaaggatggggcagaagcaatacattttgtgaggctctgcttattttattccgaagtcctttctgggagacttcttaagtgccattgaacacaacggtgtctcgggtcaatttttagttgcaagaaaggctgggaaataatgatccagcaaaggcgaatggaatcctcatggagaccaggtataactcattcctggacttgcagaaggccctaggtgcaaaggatctccatccaccatctgaacatcaggattccgcctgggtggagatggctgtgagggagctaacaagcggaacagcatctcccacaacatgttttaaaacattcacaacactgaccctcaagtttgtgcttccaattgctagtgacctcagtgtcaaaaatgtgctgacaactgtgatgaagagacaaggagagaaaaacagaccctcaggagaaacagtgggagggggaggggagtggttattaacgtgaagtttaaaatattcaaagataggaaacgagaagcttaacgtgattgtctacagtggtgtaaagaagatttatatgtgtgtgttcttcttttcaaaaggcagatttaggtaccttttggagcacaattggaatatgcaaattgctgaccacaattgctataatgtattacattctatgcatgcaaaaaagaataccagggtttgttctctcctcttttaaacacccagatttaatctgacctacaaaacaaatagggctaaaacactgggcacgtttatcaagtcttcaaaagaatggaatagaggctaatgaacaaaatgctcacatcccttaagataactcaaagattcttgctatagcacatttggggcctcttttttttcttttttataagtcaaatgatatgcaagtaacaatatttttgagtgccagatggagaagacatctgtagagtaagaaactaaagaaaacacacttccaagattaaggcacattagaagaaaattgttggctatgtgagtaatgaggagtttggaaagggttttctctatgtacaacatgctcacttactgggtgacacaaatggaagatgccaatttgtttttttggttttttttttgaaaacagttttctttactaaaaaggggctttgcagtcaaacaaaagcacactactttgctttctttcctcatcttttctgcattcctcagtgacattctgattgtttccatgaaggtgtggcagttttgtcaatctcccaatatatgcttagcctttcaaagaacctatctttgttccttgtgtctatggtgaccgtctgttagtgacgaacagatcaaggtcaagtaagaaagagaagaaataattcggcccatacctctaacccttccaaagggcgtagcttagtagtttagtagtttcgcttcaaacactgaggacagggtgattgctgagatgctgtggcagtggtttcgggctgagcaaaacacgcatagcatgctgaccagagacagcagcagctgtgaggctcatctgtttcccaacacattttctagactgtgaagtccccttggaggaggactgtccatgaattccaagcatggaaggaatctgaccattctttttcattttaaaaccacattacctttgtcctagccttcagctttcaaggccatttcacttggcatttttcattgatttgtggccagaaactgatgtgaaaaaggagaacttaaaacctgttattagtcagggtttggaatcaattatgcttcaagagtcattttctataaccaagatttcattcgcagaagacatacacttagaacaatggcttgatcatggattgggtgggggtggaggacaagaatgaaagaggactgagatggctgaaggagcctctatggaagacacagagcatacacgagacttgtatgtagcaagcgttaagaagagtccacaatgttcgataatttttattttgttttaatatgtgttctatctacttttcattttttatttttattcttttgagatgtaatctcactctgtcacccaggctggagtgcagtggtgagatcttgactcactgcaacctccgtctcccaggttcaagcaattctcctgcctccgcctcccaaatagctgggattataggcgtgtactaccatgcccggctaagttttgtatttttagtagagacggggtttcaccatgttggccaggctggcctcgatctcctgacctcaggtgatccgcccgcctcggcctcccaaagtgctggggttacaggcgtgagccaccgcgcccggccagtccttcttaaactcttattcacacccagcccaactacagcaaatcaattcctccagttttcattatcttactctttttttatattaatacctagcatatcaaaaattacagatggcaacattaatgagtactgtataatatttcttgaaaaaaatagttaattataaagctttcttagaaataaaaggaaaagactttcaagcatagagtccaggcaggtatctatcattctgctttcttccttcatggaatcaacatttttagttcccatgtatgagtggaacatgcaatatttgtttttctttgtctggattatttcactttacacaatgatctcccattccattcatgttgctgcagatgacagcctttcgttatttttttattgccaaattgtattccattgtgtatatataccacatttctttatctattggtccattgatgagcatttaggttaattccatatcttggctacagtgctgcagtaaacatggaggcgcaagtatctctttgatatactgattcattttcctttggatcagtacccggtggtaggattgctggatggtatggtagttcggtttttagttttttgagaaatctccatactgttttccatagtggctatactaacttacattcccaccaacaatatataagttcccttttcttagaggctgggaagggtttttggaggaagataaagagagcttggtcaataggtgaaaacatcagttagaaaaaataagttctaatgttcgttagcagaatagggtgaccatagttaacagaaagttgttgtatatttcagaatagctagtagacaggatttgaaatgttcccaacacagaaatgataaatacttgagctgatgaatactctaaatacccagacttgatccttacacattctatgcatgtgacaaaatatcacatatcccccattaatatgtacaaacacttgcatcaactttttaaaagtccagacaagaaaaaagcccatgttgttgataatatagaagttgcagtcctctccatcacacacgtcataaaggcagcaccagaaacaagccattgcccaagataagggtacctatttactgcgtgaatttttgtttcaggtttactttattgctgctctaattagaattcttgtccctttgtttcacactcgtagcatgtatttatgtcatctcttctctgatttgaaagataccattgtttcagcttaaaacagcccctggtttgaaagttgcacgggatgcttatataaacaacaggcagcatgataattcattgcttcctcttaattcccatgttagttgaaactggaaaaaaaatgacacatgccatttttaataggtagttgagcttcctgtataaaaaaaaaacttgtaaattttgtaatgcttcttgggacatatgtcagtaatcatcacatggtttcaagcactgggaaacatcttaaaagatgctttaaaggatgagttacaaaagaagaaaagtagtcacaagattctctataatccctgtttggtcactctacattttccttctgaatgcactttttgagaaagtaaacttacttcttctcttcagtgtcatctgaaattttgatactttaaagagacctttgcagttttgaattttgaatataatattcctcaatgtatgaaaaactacattaaaaatctaactgtggatgcctatacttgaattaacaaggagtttcatctcccaaaatttcctcatgctgtggttttttttctgagctggaattgacagatactaagtttcttagtcaatcttgcaggcgctttcagaataattaagcctgagactaccagaaagaaccattaaaaattagaatcagagttggtggtatggaaagttcttttgaaagatggaaagttcttttgaaagatggaaaacattaatttaaaagagttcaagagtttaagccaaaagagccagtcaggttatggagcaaaaaaactctgcaagattaccacaactgtacttctctttgaatagattttctactgccagttatatgaaatggatataaatcctcccattccaacaactcaggaacttacttaagtgcagggtacgatagcaactgcaaacgagtctaagaaaataggctgaatgtcattaaaatcctttgaaaatgttctgtgacatctgttttccattttgctatgctgtttaattaacttcagtcttgcagaattgcagaaatcttatttgttcaaaatagtatcttgaaggaagagaagtttatttaatagagaagactgttaagtgtaatacgggcttgattaacttcatctcaagttttaaatgtttcccattggcttcatgatctatccctatatatggctcatttccataaaactaaatcaaactctggatggcggatcactcttatccagttggtactgctgtcatgtttcaaggacaccaaaaatggaagaaattacagagaatagtgacaattcagaaactattcttatttgtcttcatcgctataatatgaggtcactggctcctgagctagtgaggaaatccaagttctaaaaaacattccttccttatatttgttttttttgtgtgtgtgtgtgtgtgtgatctttttgataagaatagttgtcaaggctgggcgtggtggctcacgcctataatcccagcacttttgggaggcagaggtaggaggattgcctgaggccaaggagtttgagaccagcctgagcagcatagcaagacgtcaagaccatggctctttaaaaaaaaataaaagtagccggcatggtggctcatgcctgtagtcccagctactcgggacagtgaggtggaggatcacttgagtccaggaattcaaggctgcagtgagctatgattgtgtcactgcgctccagcctagacgacagagtacaatcctatctcaaaaacaaaaaacaaacaaaaaagaatggttggagagagagagagagaaagaggaaaataaaaagagcaattcatcctgcaaagacctagaacatgagtgcctcttctgatgaggctcagtggtcctggaaagctcctattggacaaatcttggagaataaacagaaacattttggagaggtgggagagcgaaggaaccagtcttcattgacagctgactttatttttcgatttgtcagagcacgccaaagcccagtgccctgtgaccaggacaaaaggggaagtggctgcattttgacatgtcccagcttcactagagaaagcccacttgtttctgactttccagtgcgggcaaaagctggcagatccaccacctgtgctcttgctgcccagcatctagggagctttgctattctgagtgtttctgaggaagccatatggatggtgctcaactggatttttctacttagagggctttatggattttaatgtagaggtcgtggcttctctgcatcactggcaagtgttgtccatctctccgtccttcttgagttccatacccagtgcatcatgaacaaatccatcttttttatctgacctatgctgtgtctactctctcagctcctgcttttgcttatccctcaaaggggaggtgttcttagctctctgacctctgggttgatacagaggccaaatttatcccagggaaggaataagtacatttgaaataagtcactgagaggagaagactgtgtgttttaaagccaggtttgtttaaagtgttatgatagtattaagatgttctttcattttcatagaagtacttcatttggctagaaggtcaaatgcctggtgctttgaggacctgaacagtttctgttccatgaacataccggactcaggagttcttttgctccagatactaagttattagaacagtgtttcccaactatggtgaaagaaaatcaataatcagaattttttagtagttttcagtatttcaaaagatctagttcgtttcacagttcaactgaaatgatgggtgtatttgcatctagtggcaatcatattcactatgttaaccctacatatgttaatcataagctctgattgacagttgtatattttctgtttagcactaaataaggaaagaattctagtaatttattgaatgtagttggatttccttcagactacaaagaatgccttgacaatctcactccctccttttgattttcagtgattcaggtcatctggattcctggccttcctcctgctattctcttctgtaatctccatttgcccgaccacctcctaccatcttttagtttaaacgccattctctgccttccaggagctatagactagaatagattgccttctgtgtcctccccagcagtagaaatttctactgcgtgataactctcacgcaattactctctcagggttctctgacaccagagattgtgttatatcttattctttaccttgccccagcccctgccctggtgtttggcacataatctacactcaataaatatttctttgtttaatgggtggattgaattcattgtcacactgagtgacatccatctggatgcttgattacaccacgcggctatcatattctgaaggaacatgatatctatgaagatctcaatcatggtttaatccccagcaactagcacagtgtctaagacagaaacttaatatggttcaattactttcgagattttttttttaatggggacactacagatttggataaaagacattaatgatgatgtttcctgtcctatcactaggcagttctatgaaaaggcactccttttttcaaaattccaacttataatgtaagatttgatgggtttgttcaattcctactaagtgagcagtaccatgattttaggtctgtaagtagcttaaagttaaacttagaactttggttggcgatgctcaccctggtctctgttatggataacagtttgaatgaggttgatgactgggtcttttaacttgatgtccttgtttattttctgcttgctttgtttggtcaggtctggcatggagccgaaaaataagagcttgcttgcagtttgactttcactgtgattcagttttgcaatcttttaaaaacatccttcaggagaccgccatgtatctatctgtggacatctcccagattttccaaaacaagcacaagataaataagggggatttggaaatttccaaattttaacagatgggaatttgcttccactgtctgagaaatctttgctatagatagaggggaatcccagaaaaaaatctaagtctgaaagctccacagagttctctgcctttgccttccctggaaaaggggtcgggggagagcaaacagatgctagaagccagtaaagtcctgtcctcatgaaagctctcagcccagaggacaacactctggggcagtcacttcagtcataggatatttccctctccaaataaccgaggagagagcctaacctctggggtgagtgtggtgtataaagtgtgagaatcgtgcgtgtccaggaagagagtgctgctaacagatgactccttgggggccccctttgttctctgcttctgtttgtattgagtcagcttgcttaggaatatagatcagtgagactaaagtatctctgttgggccagttctttcttctctgtaccatggtcaatctacagggtgcctgcacatcctccacagcctcgaggtcacagacttactctctgtgtctctaggctatagagcagaacaaaacagagccaagacaaggtgtctggaaaaacagaactcatggtcttccaacagggcatcaaagggtttctaaaatttaaagccaaagggaacctcaggggtcacctggtccaacccctctgttattttaggaggacaagaggcattaagtgattcagaagacacagtctagtggtggcaaagaggacaattcagacagttcccaatttacaatgattcaacttatgaagtttcaactttatgatggagtgaaagtgatacgtatttagtagaaactgtatttcaagtataaccattctgtttgtcatgttcagtacaggatttaataaattacatgagatattcaacactttattataaagtatgctttgtgttggatgagtttgtccaactgtaggctaatagaagtgttcagagcacattaaaggtaggctgagctatgatgttcggtaggttaggcgtattaaatgcattctcaacttatgatattttcaacttacgatgagtttattgggccataaccccactctaagtcaaggagcatctgtataggctttggggtcaggcatcagctggaatcctgactctacctctttagttcagctatgaccttgaataagtcacttagactctttaagctttagctttattgataaaacaaaagtaataatagcaccataggactgttaagaggattacattagagaaaattcatgtaaggcacatagcctaatgcatggcactcagtaagtacctaaaaattagtagcaactattcatcttcgtcatcattatcatgatcatcaaagctggagcctaggacccaagcctcctagctcagcattcctcttacaacagccctttgaatcaccttcatatgtcgttaatacttcattgggtaccccaatctatattagtttaagtacagactgtggtgacatcattagttagagtctgtgagatgggaggggggggcaaataatgattcattctcttaaaaaggggatgtaacacttttttttttccttcttcaactggaatagttagggatgtaacactttaaaagagcatgttgtacatcaaggtaatataggtaacttaaatttattttggattttgtttatgtatggttgcaatcccattagagtttaatggtattttcattttacaacacattctagtgtgttaggaagtatgtgttaagagttctcttctatttattattttcattactttcccattccagtatagacatagtaaactcctaaaattaagtatattcttcttaaagaattctaagtgaccattttggtggaaaaactacctgcgctagtttgcatgtgatctaaatgatccaaactaatgggtgagctttgggtgcttgaggactatatgcaggagaaaagaggagggatggataaaacttttccaattttaaaataaaaattattttctgaatgtgctttaaatgcatctgctacatgtactcaagaatgttgagtctgacccctcaaatttattcattaagttttgctacatcagactacacaaaggtcgggaaatcatgtgtccaaaataaaatcagatttgagctccaccttattctggcctatacaatgtccctgttcttaccaccttttctcgtctttcacaaccttgaatcagaatctctagttcaacatcatttccttttttccctcccccacttaaacataaaatatagatatgtgaattctataaagcctgcttggataatcagcttaccctaattcagctcttttcctcatcaagaggagggacttgacagctactcaggaggctgaggcaggagaatggcgtgaacccgggaggcggagctggcactgagctgagattgcgccactgcactccagcctgggcgacagagcgagaacccgtctcaaaaaaaaaaaaaaaaaaaaaaaaaaaaaagaggagggacttcaaaccttagtgctggtagtaacacctgagacagaaaacccgtgtgacacagaatatgagtccttaagcaaaaggactgtcgtattcatccctgtgtctctggagctagcacagtccttagtgcattgtacatttgaacaaatgtttgagtgaataacaagcccgttctccattctggttaacttacgagtactgtaccaattttcttccctgggcggaaaaaattatgaaccatggttcttgtgaaagttattatttttaaatgcctagacattcattcccagaactagaaacataagaaacaagttgatacatcaagggaccaagagatataaatgataataacttggaaatatttaaagttgtaaagatcctgcttagaagagggaagttatcaaaaggggttgagacaatagttgaatgactgagaagacattaatgaaaatcacataggagtatgatctaagaaaaggtacttgacatttttccaagtgagaaaactgcatgatcagataaccatgcataggttggagatgtgtccagagaaatttattcctgaaagacagcgataaagtaccagagctaaaatagtccatctgatagagacattggagctgagatctgaaatgatgcctgtttcttattaagttggattctatttactacacattttttagtgtatagatagaaaagggtacacaataggtacctaaaagcagatagctgtaattactactatttatcttttgtgctctgaggtttctcatactgtgttggtgccacactctaatcagctgcataaaagggtagatcacttgccaccacagaggcatgtgggagaagacagcatgtctaggacattacgctgaggctgaggcagtaggcaaggaagtccaacctgcaggctaagagtcagttttcactcctgtgggaaaagcatgcccagctctcagcaaaagcatagaaatcaagagagaacagtaaaggcaaacaggatatgtagcctagttccagttgaaggtattattcctaacaatgaaaaatgtcaatataactatttccagagttaaaacttcagacacatgctatgacaatgagacagtatgtttgaaactacagatgtccaaggaaattcaggctatatgctcaccatatgtagagaaggcagggaaatttaattgtttgtagagaaagagacccaagacttcgtaaagccatgggatatggagttgggggacctgccagtcaccttgtcagttcacttcattttataaagaaaatttctagtctcagggaagccaagcaactttcccaaccaaaacgttagctttgcgttaagagaattttagagatagattattaacatcttgcggctgagatactgtaaatatcttcaagaattccaacattttgagcaattgtaactcccagaataattatttttgctataaatattttgcccattttatggtagtattccagggtctttactcccaagtcaaactcaaatattgggaaaagtcggatcctttttcttatcaattcccacttcacattccccgttgtgatcagctttctgaatttatttgtaattatttcttcagaagagagaaatatggataatggacggaggaacaggagaaaatgttagcatattgacacaaaggtttcagtattctaaataatcaaatatttgaaaaatatatattttgtccttttgccctagagatataaattgacacaaaaatatttacaaaacacattagtagacatcaatgggtctaaaactgtggtcctccaaaccagcaacatcagcatcagctaggaatttgtggaaaatgcaaattttcagtctcaccccaaatcagttgaaccagaaactctggggtgggacctggcaatctgtatgtatttaaacaagtccaccaggtgtttctaaccactggtacagacaaatcagacaagcataaccagattattggatgtcagttctaagtaatatagggggtgaatatatcaaatcctttgggagaataaaagcttagttgacttctatggtgtattcgtttcctattctgtataacagattaccatgaatttagtggcttaaaacaccccacatttaataagcttcgtaagttcctgtggatcaggaatccaagcataggttagctgggtcctctgctttgagtctcacaaggctgcaatcaaggtgtcactcaggctgtattttcatctggaggctcaactggggaagaatgggcttccaagctcctttaggttattagcagagtgcatttccttgtggttatatgaccgggccttggtctcttattggccatttaatggaggctgccctcagttcctagaggccactccagttatctgccatgtggccctctccagaggcagttcacagtgtggcaatttgctgcttcttcaaggctttcaaggccagcaggagtctctctctagtctgctaagatggtgtcatatatgtcatataacataatcatgggagtgaccttccatcacctttaccctgtgacagagtttagatatatgtccctgccaaatctcatgttgaaatgtaatccccagtgttggaggtggggcctggtgagaggtgcttggggcaggagggcagatcccttatggcttagtgctgtcctggcaatagtcagtgagttctcgttaaaagtgtgtggcacttccctgccactctctctctcttgctcctgctctcaccatgtgacctgcctgctcctgcttcaccttccaccttgagtaaaagcttcctgaggtctcctcagaagctgagcagatgctggtgccatgcctgtacatcctgcagaaacatgagatgaataaacctgttttctttataaattacccagtctcaggtagtcctttatagaaacacaagaacggcctaacacactacataatgtaactaattgagtgagtgacttcctatcacctttaaaaaaaaaaaaaaaattggtcaagagcagtggctcacgcctgtaatctcaacactttgggaggccgaggcagttggatcacctaaggccagaagttcgagactagcctggccaacatggcaaaaccccatctctactaaaactgcaaaaattagctgggcatcatgggcacctgtaatcccagatactcagaaggctaaggcaggagaatcacttgaacccgagaggcagaggttgcagtgagccgagatcatgccatttcactccagcctgggcaacaagactgaaactccatctcaataacagtaataatgataatttcaacctttattttaggttcaggaggtacacgtgcagatttgttacatgggggtattgtatgatgctgaggtttggggtacaaatgattctgtcacccaggtagtaagcatagtaccccaataggtagtttttcagcccctccctccctcccctctcctctcatagaccccagcatctgttgttgtcatttttatgtccatgtgtacccagtgcttagtttccacttttttttttttcaagttggagtctcgctctgtcacccaggctggagtgcagtggcaatatctctgctcactgcaacttccaccttcgaggttcaagcaattctccctgcctcaacctcctgagtagctgggattacaggcacctgccaccacacccagctaatttctgtatttttgtagagacggcgtttcaccatgttggccaggctggtctcaaactcctgacctcaagtgattcacccacctcaccctcccaaagtgctgggattacaggcgtgaaccaatgcgcctggccagtttccacttataagcgagaacatgtggtacttagttttctgtgcctgtattaatttgcttaggataatggcctccagccacatccatgttgctgcaaaggataaaattttgttcttttttatggctgcatagtatctcatggtgtgtatgtaccacattttcctatcacctttatattctgctggttaaaaacaagtcacaggttctgtctacactgaaggccaggggattctacaaaggtttgacttgtggtttaggatatgttcaccatgttgcagaaattatatatatattttttaacaaaattggccactatttagtatgcttttttctttgtacatgaagcacttttgaaaaaaagtcactgactacagtcttagttaccaagttgaaatcaaagatagatttttcttccaactgcaagaaaaattcagtgagtttagaagaaaaaagttattctactcagctgggtttgacagaaacactatttctgtggcctcctgtccccatcccctagttatgccttaaggcccttctcaaatatcttctccagaaagactttcctaatacttctaactggaattgttctccattttagtgcccatttattattgtacttccggtttactttaccattatttggatagatgatttgtctctctgtctggttggtaactgaaggtaacagaaactcagcaaacagatgttacattcatgagatcacatattttatatatgtgtgtgtgtgtgtgtgtgtctgcgtgtgtatttttttttttttgagatggagttttgctattgttgcccaggctggagtgtaatggcacaatcttggctcaccgtaacctccacttcccaggttcaagcgattctcctgcctcagcctcccgagtagctgggattataggcatgtgccaccatgcctggctaattttgtatttttagtagagacagggtttctccatgttggtcaggctggtctcaaacgcccaacctcaggtgatctgcccacctcagcctcccaaagtgctgggattacaggtgtaagccaccgtgcccagtccacatattatatttttgaagcctctccggcagtataatatatgctaacataaggtttgatgaattataaaagcaattaattttaggtattgggacacactaaaatctatccagtgtagatttccacactgggagagcaatagcctgtcatagcagctttgcaatcagatagccctgagatccatgcctgacatctccaattaatggctgtgtgacctggagcaagaaacttaatgtcgctaaatctcactttccttaatagagtcattactgaataaatatcaagctattcttaatatcaacttggaagtattaacatttcttaacacagttcacaccagggcacggactccacagtttaacctcatctccaggaggttagcatgcacacgtatcatgttcattcggtaggacagtaacctgctagcaaatgtagactaaataaacactggatcattcctgtagttatttataaatagtctccatctttggttgtgattttagtggttagaatactagaaaaagagtgggtagagggacaggacataaggaattccatgttaatcagtagcatgggaaggctggtcattttcacaaaaccaagggagatgaaataagattgtcctaaacactgttctgagaattacacagaacatgaaaggctgcttggagtgagtcagagctgggatgttataacagatccgggctctgtcgaacactcagtcccccttgccaaatgtaggaattcacaagatcaggctcaaacttaaaagtcaatttcttgtaggctgggtgctcacggctgtaatcccagcacttcgggaggccgaggcgggtggattgcttgagcacaggaattcaagaccagcctgagcaacatggtgcaactctgtctctacaaaaaagtccaaaaattagctgggcttggcggcatgcgcctgtagtcccagctactcaggaggctgaggtgggaggatcacttgagcccaggaggctgaggttgcagtgagcagagatcacgccactgcagtccagcctgagggagaccccgcctaaaaaacaaaacaaaccaaaaagtctatttcttaaataccatgctagagttatgttcattccttgcagtcatctaatcagttcccataactttcttgataaaaggcagatgttgcttttccatagaatagagatggttatcttggccaaggtgtttatgcaggagtgcgggtactaagatgattctagatttgtacctttttaaaagtctgttgtacagttctgtgttctgagattaggtggcattgtgtttcctttttacgttttttattctgtttccacagagaacatttacacactttcaaatgatcctgataactattccatacatatgatatcattggcatctatatactttgaaaatatggtagtaatttttttttgccatttatatctactggtgacccccataacttgaagctactttttagtgaccacaaaacttacttaaattcccaatgtatattattattatttccagtacctaaaatcttttaaaacttatagtataaataattacaaaataactttgaggagaaatttagagagtgaaaagagtaagagagaagagaaacaagaggaggagaagaaagaggaggcagcctagacttgtgaccaaagcttttacatggggtgaaaaaaagctaaactatattaagagtacatttatgagacaatggcaaagcgaacaagcaagagaaaggattttgacatatctcagttgacattatgaaaactctcattgcttatccttggaggaaatatagcaaccacctgactactcacaagcagcaaatgctagagaagactctcccctcttaatatcaataaactaatccccaccttacatgccatttaagtacaaggagaaagtagggaggtatataggcttttagttcttttaacatttgagaacccattttggccccaagtttagatacctcaacatttctgtcactaaccttcttccctccctccttcccctgcttcctgaccccccaaacccacccctttgtctctctctctcccccgaccctctcctcctcttcccttgcttctgagttgggagggatttgagaagaatgaacccataccaactccgccctagccagcattcaagatggccccatgaatcttgtctcctggtattcatgctttttctgtagtctcctcccatatggactcagagttggtctgtgtaactcacagggtgtagtgggggtgacagtgtgtcacttccaaggctgggttaaaaaaatgcacagtggcttcctacgtgcaccctctctgtcaacttccattttgataggatgctcactcatcacgtgtagaggcccatgcagataggaactggggcctcccagtgacgaccagcaccaacttgccagccgtgtgaccgaaccaccttggcaatggatccttcagccatagtcaggcctttagctgactgcggccttggtcaacatcctgactgcaaactcacgagagacacagagccagaccccccagctagaccactgccaaattcttgcctcagagaaaccataagagacagttaatgcttattgttgttctaagccaataaattttgaggtaataggttatgcaacaagtacatactatgtaataggtatgcaatagtatacaataatacaaatactttaaaagaaaagtcagaaatctaaggataacaaattcagagctttttaaaataagaatgttatctcccttgagtatttagagcctctagtaattgtccttgtagaatttgaagaaggttgcaaactttccttctttgttatttagagaaaatgtgtaacaaaacctataagaaatcactgctaatctatacctcaggagcctcatctcctgataactttttttggcaaaatatcagtgctcttccattgtgtgtgttcaaagttttagtcatccttacttagttaagatgattatatatgagtataccttttagttaacttccttttgatacatggtttatttcatgcctagggtaatgattgatgtttattcaaatgagctgatgtggatgcaagttcctcagtgctatacagtaaaattgctgttgacatcttccagaacaaaactgagataagatcctaattgtggattcccaaatattacttttcaaatactgttacattatgctgactattattttccattctggtgcttcttaagctcattacatggtgatgatttgtatatgggaacagtctgaagaaaaacaattgtgtgattttagataaaaacaggattcaaccgagatatggagtatctcaaagtaaaatgtgctattcccatctttctattctgtgtttggctccaagtccttaaacattcattcaatacacactatacagatgttcaaagaatgcctagtgtgcattgcttagtgctcaactgtgctaagcattattccacacatggggatggaacaatgaacaagacaaacaaaggttctgccctcatgaagtttacattttagtctgggagacagttaataggaaaacaagtataaaacaatataatgtgggatattgttaagtactaaaaagaaaagggtggccgggcgcagtggctcacgtctgtaatcccagcacttcgggaggctgaggtgggcggatcatgaggtcaggagatcgagaccatcctggctaacacggtgaaaccccgtctctactaaaaatacaaaaaaattagccaggcgtggtggcgggcgcctgtagtctcagctacttgggaggctgaggcaggagaatggcatgagcctgggaggcggagcttgcggtgagccgagattgcaccactgcactccagcctgggcgagagagcaagactccgtctcaaaaaaaaaaaaaaaaaaagggcagggtagagggatagacaatggctgcaaagttgagggatctaatttagatggaggatcaggggagtaaaatatgggcagggacttgaattatatagaaagagcaaaccatgcagaaatctgggggaagaacatttctaacggggaaagatcacgtttttaagccgtgagtgaacagaagcttggcatgtgggagcttaagagtaagagatgagagaggctgtcagagtacatagggcatgatggggaagggggatacagtagaagatgagattggagaaataaacaggaaacttgcaagcccgggtaaggacttcggtgtctattcaatgcatgatgagaagccacaagaaaattccaagcaaggaagttatgtgatctaatttaattttttaaatagcacactttgcagctgcatgaagaatagtctggaggtagcgagaaagccagcaagaccccttgaagggttactgtagttcaggccagaaaccatggtggcttgtggggtggaagtagttagtggaggcaataagaagtgatgggagctgcatctgctgcaagaatgaaggctgttctcagtaatcagactgtccacattccagaaaatgtcgacatcactctgaaggggcacagttcttgtgaaaggccctagaggaccctgcagagggacttcagtcacgtcagtatagaactcgggctccttggaaagaaaaagcagaggctccagattgacaaatgctgagaagatgggaattggctgccatgcgtgctatctgtagtcatgcacagaagatgatcaagggcgttatactgggcttctgtgacaagatgaggtctctgtgttctcacttccccatcaatgtcattatgcaggagaatagctctattgtagaagtcagaactttcttgagcgaaaaatatatctgcagggttcgggtgagcccaggtgttgcttgttcaatatcccaagcccagaaagatgagttcatccttaaaggaaatgacattgaacttgtttcaaattcagctgctttgactcagcaaaccacaacagctaaaaaccaggatatcagaacattttggatggtatctatgtctctgaaaaagggacagttcagcaggctgatgagtaaaatctaagagttgtacagctacagaaacaagatgtcagataattcctaagacctatttgtgatattttaataatgcaataaaagacagctattgaaaaataaagtagtgatgaggtttcaagacatgaatgatgggatttgctgatggctagcactcaggatgtaagggaaagagaaggattgaggctaactattgagttttggtctaagaactgcatgaaaggtggtatttatggacgtggtgaagagtaagggagagcaatttgggaggtggaagagaaccgagagatctgtggccaggttaagtttgaggtgtgtttatacatttccatatgggaatgtcaagtaggcagctcgaaatacaaatcgcaaagatgttggactcaagctataaacttgagagtcaccacaggagaaattgtgtttaaggccatgagactatttgctgtctcttaaggcagtgaatgtaaatagagagaagttctaagaaccggccttgaagcactctagcattagaggccgaaggtgaaaaggggtacccagtaagatggaaagcccagaagagtttccagatgaggacgatgtttcaggaagaaaagaaatgagtgatccattttatccatgctacagagtgtccaaaacaaatgaggaccgagaataatcttttgaattggacaagacgaggtcctggttgacattccaggaaggggcggagacagagcctgagtgaagtgtgttgaaagaatgaaaggtaggaaagtagacaccatgaaatacaaacagatgtttcaaggaattagctgtgaggacaaacagaaaactgatacagtacccagctggaaatgttgatttcctcagatttcttatctacaaggtgaaaaattttagataacttctaaatcccaatgtattacattgccaagtcaaaaaaacatcctagggtgagtgcctgaaaggctaaattgtgaaaaagagtcattactcgggttgttgatgtcctaaatatgatggtgtcattactgactagggagggtgctagcatcatttgtatccaatgcccatgtaatgatttgagatgacaatggaaacgttaagaaataatttaaatctattatgagaacaactctcatttattagtttacttgtagccatttctgtgattcaaatgagcattatgattattttctgacagaaagaacgaaatctcaggacagttccatgtccatctgtaattagacctcatggccagagggccacaacagtgaggtatgtgacacatcacctctgggctgctgtagctgggcggcatgatgactaagtgaaaatgacaacggcaatagtaacaggtgtcactataccactttagaatttacaaagccttttcataaaaattaacatatttaggctgggtggggtggctcacgcctataatcccagcactttgggaggccgaggtgggaggatcacccgaggtcaggagttcgagaccagcctgaccaacatggcgaaacctgtctctgctaaaaatacaaaaattagctgggtgtggtggcgcatgcctgtgatcccagctatctgggaggctgaggcaggagagtcgcctgaacctgggagctggaggttgcagcaagctgagatcacgcaactacactccagcctgggcgacagagcgagactccatctcaaaaaataataataacatatttaatcatagggaccatttaaaatgctctttcatttgtattaaattagttctccaactctgacagtttgagcatggttggcccagctatcctgatggctccttcctgctattttttttttaatgtttaaaactcatcttttcaagctcaagagctgttgctttgaagaggatttgaataagcatctgaaactgttggctcagacattgatccaactcaaatttccaaagctgctaccagaatgcttttcccatacagatccaaaatgaatgtgaaatgctgcctgtcctctttctcctgtcttcctttcagtgactccactttctccacagtggccctccacgtcaggcagcccttctaaagaatccactgcttgggtgtgtgtgttccccacgttgcattcagaaggcacatccatgcatctcaggcgtgtaggttcttcagcatgaatcatgcaaacttggtgaaccataaacctctccctgtggatatgagtttgttggtattttagtctgcttggaaacagtctgagaaacattaaacccagcttttttgaggttagtccaaattatttttttagactagagaaaaaaaaatattatgtctcctaaggaaacttgtaaccacgaacagtaaattttaaatgttttagaatggttttctttttccccctcccacatcccccacttgtgcatagttgaaatccctagtttctctcaccaagaaatactacatgctagactcacagatccatgggctgggcctgtgcaaatggatttcttagattaaaagtataaaaacaaggctgggcatggtggctcatgcctgtaatcccagcactttgggaggccaaggcggatggatcacctgaggtcaggagttcaagaccagcctggccaacatggtgaaaccccgtctctactaaaaatacaaaaaaaaattagccaggcgtgatagcaggtacctgtaatcccagctactcaggaggctgaggcaggaggatcacttgaacccgggaggcggaggttgcagtgagccgagatcgtgccattgcactccagcctgggtgacaagagtgagactccatctcaaaaaaaaaaaaaaaaaaaaaaaatatatatatatatatatatatatatatatatatatatatatagaaacaatatatgctccattatactgaccccaccaatcttaccctttctccacttttccagttcaatcatcccctaagtattcgtgtatagtaggattttaaaatgcacagtaccattcatgtgcagaaaagcacctttatttataaaatatgaattcaacttgctctacttggcaggaaggtacctagacctcactcacctattcaaggaaactgagtcacttcctgtttcaaaccacagtttttccaggttaactcaatctctgtagcatttaccatatccagcctcaaaggaccccacccatccatcctttctttgttcctttggggaaagaggaacctgtgagaagaagaaaaccacagggaaataagactttgagtttggagaagaataagagagcattataaagtgataaaacctaaacatggttcattaggaaaaagtgactgaaattctaatcctgtgcaggtccaggattatgagggaagcaaaaagaatgccactgacactagaatagagtatttcctgctgggcatggtggctaatgcctgtaatcccagcactttgggaggtggaggcagtggatcgcttgaacccaggagttcgagatcagcctggccaacatggtgaaaccccatctttactaaaaatacaaaaattagccaggggtggtggctcacgcctgtaatcccagctgctggggaggctgaagcatgagaattgctggaacccagggggcagaggttgcagtgagctgagatggcaccactgcactccagcctgggcgacagagactgtctcaaaaaaaaaaaaaaaatttatgtgctgtcacaactgcaaggcatgaggcctctctccctccctggcgtttccacatggcacttccccttgtgtttgacgtgtcagcctctgtcctcattgcaaatctcctctgccttccagcctcagtctctgtacagactctgccctcctcatcttggctgcagggttgtcaggttctttggccttctcatctcacagccacaggagcgtttgtgaacttgtgatcctccctagttcccggctctggcagtgggtgcggggaggcctcaacacagccagccccttggttactctactgtgactacctccttttggctccgggctcggtgacctacttccaaataccaaattgcagcatgggacttttctgattttcatttgccccctcaaatctatgaggtttctatgatctctttcatctcttctctttctcgtgagttacaagggagtaggggcgtaccgggtgcctcagaaggaacccaagtagcaatttcaccatagtctcatccctccaaatttctcctaaaaaatattccctcaatccaggatttttactacttccctctgtggagagaaaccccatgtctaacatctgtctcacccaagagcatgctggaaaattctttggcttcaaagtccaaagattgattctggatattgaatgtccagctaagggaaaccaagaaaagacttttctgttttctccttcaggtacctggtccttgaaattgaaacctagacacttatgcctattgtttttcttgtaactttcaaaatctattttgatgtcaaaatggaacaatggtttttttgttatccatcgagttctgcccttctcaagaagtatggatggctcaacctcagcagatggaaagctacagggaaataggaagtaccatctcaaggaaaagaaatgtgcctcattagaaatgtccgatgcattttttgttctcagtcgttcttgcaacccaaggactgagttgcaagtcaaagtgtttatcaatgttaagtttgaaccaaagacaaaaatctctgttgttctttccttcttagtagttcttaaactacttatatattagaacgctgctgtggaggaagaaatatttttagtttttcatacggaaaagttttaagacacacatttccatggagtatatttttcccacagtgttttccaaagcctctgtctttggctcagcatttctccaactggaagtttcaccaatgagtcccctgtgttcctgtggtccgctgtagggctactctggagtctctggcttattagcatgtaaaactcggagattctttccctccagttaaagtcatatccacaggatttacatgaaatatattatatatggcacctttctttgtaaggtagctagaaagtggctttgggaattttttttctgagacgagtctctctccgtcacccaggctggagtgccatggtgcagtctcagctcactacaacctccgcctcccgggctcaagcgattctcctgcctcagcctcctgagtagtggggactacacgcacacaccaccacgcccagctatttttgttgttgttgtttgtttttttttttttttttttttttttttttttgtagttttttgttttggtagagacggggtttcaccatgtttccgcggctgatctcaaactcctgggctcaagtgatccactgcctccgcctcccaaagtgctgggattacaggcgtgagccaccgtgcccggcaggaaatattctattctagtgtcagtggcattctttttgcttccctcataatcctggacctgcacaggattagaatttcagtcattctttcctaatgaaccatgtttaagttttatcactttgtaatgctctcttattcttctccaaactcagtcttatttccctgtggttttcatttataagggaagaaaagaaaggacgacaagtctatttttagggatccattaaaaattcattttttaatagtccataaacattgcgaagtaacttgggactcatacatacaattctgattattttaaattgcttcatgtgataattgcaagcatttattgagcatttacacattactgaacttaaaacacataaaaatgccattctcggctgggcgcagtggctcacacttgtaatctcagcactttgggagccaatccaggcaaatggcttgagtccaggagtttgagaccagcctggccatcataatggaaccccatctctattaaaaatacaaaaatgagccaggtatggtggcatgtgcctgtcatcccagctcctggggaggctgaggtaggaggattgcctgagcctgggaggttgaggttacagtgagccaagattgtgcctgtgcacttcagcctgggcgactggagtgagaccctatcccaaaaaaaaagaaaaagccattctctggcgatcattaaaaagtcaggaaacaacagatgctggagaggatgtggagaaataggaatgcttttacactgttggtgggattgtaaattagttcaaccattgtggaagacagtgtggtgatccctcaaggatctagaaccagaaataccatttgacccagcgatcccattactgggtatatgctcattggattataaatcattttactataaagacacacgcacacgtatgtttattgcagcactgttcacaatagcaaagacttggaaccaacccaaatgcccatcaatgatagactacataaagaaaatgtggcacatatacatgatggaatactatgcagccataagaaaggatgaattcatgtcctttgcagggatatggatgaagctggaaaccattattctcagcaaactaacacaggaacagaaaaccaaacaccacatgttctcactcataagtgggagttgaacaatgagaacacatggacacagggaggggaacatcacacactggggcctgttggggtagggggcaaagggagggaagcattaggagaaatacctaatgtagataacaggttgatgggtgcagcaaaccaccatggcacatgtatacctatgtaacaaacgtggacattctgcacgtgtatcccagaaggtaaagtataactttaaaaatgccattctctacagaatttgataaatttttaatctcagagcttgaaatcagttacaacactgttttaatctatgaaattatttcagtgtctttctatgaaatttagacccaatcttcagataccatagagtacctactatgtgccgggtgctctaattagaatcttccatttcattgtcatttaattctcacaagaaccctgctaagcaggtggcattatctcctttccacctgtgaggaaacaggttcacagccgttccacagccccaagcctcacatggagtaagaggttgagtaagatctgaagacacatggcacttttaggccacacagtgtccaaggtatttaaatgaagtagatgactgagtgttttttaagccacacacttacagaaaagacactaggagatgagcagaaggtgtttccctggagatgctgccctggtaccacagcagcaggaggtgggacaagctgacttctactctgagtgagttaagaacctcagggctgctctgggatagagacagcatgaacaccagtgcatggagccattgtaccctggccatggtttttgttttagatcagcatcaggttcagaaatccagaaccaaaaagaaatgaatgcaactcccattccatcaggtcaggagtgaccaggcctcccacagacctttgcctgtttcctccccaagcgagcctcagagccttagaagccctctcccacatggtcttgtattaaatcatgttcttctaggtcaaataacaagggtccgttattcatgcctctgtttatttattcatatgtgtattcattttattcacctataaatatttactgcagtaatattaaccagcgtccttgtggatatcagagtgccacggatataaatatgggaagaaaaagaaaccactttaaagaaaaaaattcttttagagagtatacttactatatgtcttcttatagatatgggactttgtcaatggtgagtgctcagtaaatattcagagacgaataaaatgaataaacgtatgaatgaacagaggagtgaataatggacccttgttacttgacctgagagaacataatttaatacaggaccaatttctatcattttcctataagtaatgtatttctatattacatatgatattttgatataaattatattttataagtaaatcacctctaggctggaaaactcaccctatgttggcccctaggaacatttaaaaaaatttttttagaaacaggatctttctatgttgtccaggctggagcacaatagctattcacaggtgcagtcatagcacactacggcctcaaattcctgggctcaagagattctcttacctcaacctccagagtagctccgactacagatgtgtgccactgtgcccaacttttagagattttttttttctggctcagaaaaaatccctctcagtatgtttattccaaaccctttctaacaggtgtccatgcgttaggcaaaaagccttacagcttctcagattcttctcagattcaaagattcatctgtattcatcatttgagattcatctcaaagacttgcttagagatgaccgtaccatctctaagcaagttttcctttctctctaacctgctcctttggttcccgcacctctcttggctccaggtgtcaataaacaacacctttgtcagctctttccattgcctcctcctggtcagagcatgctgagtgagcttcacttaaagcctcacttttgcatcggataactttttctcatttgaatcgagggtttatacactgcccaatataccatatccaatataaacaggaaagaacatgatttctttgtagtaggtagcctcccttctaggtcttcttttacagtgtgatggttatcaggcttaggaatcagaaaaagttagtctgaatctaatctctagtccttagctttaacctgggcaagttattgccatcatctgaaaaatgaagataaaaagaatgatgaacaaatgagatcacatatgcaaaacatacagcacaatatttgaaaatagagaaggtttagtaaatggaagcgatgatgctgaaggagggagaaggaaaaacagagtagaagaagaagaggagaaaattgctaaataatgagtagccatcttgagagacagagagcgtggcccagaggacatgagagattaggaactgctgcgttttatagggaaagggaacacaagggtaggaatgtactggaaattccatccaaagaggactcaaggtaatgcaagtcagaatgggtacttgggagcatgggatgacctcagagccaaggtgatattacatcccactgtcacccacttcacactgtggtcttaatttagctacacgttcatggacaagaagttcagagccagctcacactgcagaactgggttccggttttataagctaacttactgtttgccacagattgtaacctctttcccaaagaacagacataccaggagccagaaagtagcttttaattaatgaatttgtcatctgctgctcagtggtaatgagggaaatcctgtgccatacattcttttaagtgtagattcaggatctggatatgtactagtgaggtcagcaattcagccctttacctctgattgtgggccaaataaatggctgaattactcatgggggtgtggattttgttaagtgtggtgggtaggggttgggaggaagagaagagggtgtgtctttcttggcataggccaaaatgaatgaaaatgctttgaatgttattataatctattctgtgaccatgtccaggtggctttctgccatggctctgggcacacccatatggacttagtccctttctgtagggatttcacagtttctggttggcagagtaaggacccaagcaggaagattttcttccccacccaacacacccctgaatcctgccaaatgtgaggtgtgggagtgataatatcaacgcaataataccaatagtaaccacaataggttcttaagaaactggaaaagggtactgagaagttttttccaccttttttgtatgcctagtttgctacattgctcctaagttcctagacttctgggcagctctgcctatggaatagccattcttttactcctttactttcttaataaacttgctttcacttaaaaaataataagttcctagacttctctttagtgaatactagagctctacctgaaagaacccacattttcaggtcaattcccaaaactcaaatggtagtgtcatggacttgaaagcagtcttagggactgtccattccaacattctgcccatcacagacattccctgggagcacccaaggcaggcggttgtccagcctgtgaatggacacatgcagagacggagagcctgtttcctgagaaggccaagccatgatgggcatctgtagtggctgcaagacagcataatgcgggggaaagagtataggattgggaggcatgggaattggttcagtgcttgttcttccactgaccagctgaacgaccttcgggagaagtcactgcgccttagaatgagtcacttatcaactatgaagctgttggatatgatctcagtcattctagcaataacatggtcatttaaagttgtttttctacgtctagccaaaactggcctcctgtaactgccagctattggtgttagttctaattttgagaaatgtagaggatgggtcttatctcattggtgtggcagctcatcaagtatttaaagatggctgcaatgaccctgtaagttatctcttctttagtataaacatctcaagatactgtaaatcttccttttatgacttggctttcagaaatcttcctcctcctgacagtcctcttccagacagactcaactctttaaattatggtccctagaattggatgcaacatttcacaaccggccaaataagagcccaggaagtactgggactgtaacaacccaaccctccacaactatctctgcctttcatctagaccctgtgctgcttttcacttaagtttgcctttgcgttagttatttcagcctccatcgtcatctcatgccacagactgtgcctgtggttgggtacagccaccaggcccttacacatgacctgctctccagccacttctcccctgttctggacaaacacatagaatgatttcccccttttcactatacaattaatatatatgcatagtaatgtagaaagctgaacaatagctgcccaaattgcagtatccagagataacattgttaacttaggctaataccagtaaattatttttaataacaatgtcagcattcatggttttccttacatactgaggtttatttactccctgtctctgattttttttttttttttttttccgagacagagtttcgctcttgttgcccaggctggcctgcagtggcgcgatctcagctcaccacaacctccgcctcccgggttcaagcgattctcctgcctcagcctcccaagtagctgggattacggggatgtaccaccacacctggctaattttgtatttttagtagagatggggtttctctatgttggttaggctggtctcaaactcccaacctcaggtaatccacctgcctcggccgcccaaagtgctgggattacaggcatgagccaccgtgcccagcctctgatcttatatcattcctcttaccctcagtggaagacctcagtccaagcctggctttcacccctacaccagcccatctttccagccttgtctccaccattgcccagctgttatccatacccaccatggttcagacttccatactccctgtaagctcctagaatcttccctcatctccctcatttgaccttttggaaaacctcctgttcatccttcaagacgtagttcaaatgttacctcttccgtgaagtttacccgacttcctctcccatccgcattccactggaatccccggttcttttatctatatttctgttgatctttgatactactcttttataacacatgagattgtaattaattggatgcacctgaccacaatcaagtcctaccctgggagccacaatatcattgggcaaactttagtctattgtccaaactgtagcatataaaagccgtgtcaaaaaaggaaaagctaaaacatccgctctacctgtgagtgctcttctttgaatgttcacattaattaccctgaacctggaacactttgttttaagacatggatgatcagacggtggaataaaggtcaagatgaaggatagagggaagaaacaaagatatgttctatttagtaggttcagggcaattcgtttcagaaaagtttcttacatttatatactacatgcatgactatatgcatatgatctatttattaaaattgtttttattcagcatgtgtcacatagacccaatttatttttggagagcatagactaacataaaaaataaataaatctggccatggcagctaatttgaatggtatgttttttcttttgtttttttgagatggagtcttgctctgtcaccaggctggagtgcagtgatgccatctcggctcactgcaacctccgcctcctgggttcaagcaattcccatgccacagcctcctgagtagctggggctacaggcacacaccaccatgcccagctaattttttgcattttagtagagatgggatttcaccatttggctggcagtgatgccatctcagctcactgcaacctccgcctcctgggttcaagcaattcgcatgccacagcctcctgagtagctggggctacaggcacacaccaccatgcccagctaattttttgtattttagtagagacgggatttcaccatttggctgggatggtctccatctgacctcgtgatccgcccccgtcggcctcccaaagtactgggattacaggcatgagccaccacccagccggtatgtgttttatttgagtgtgtatagatgacttttccagtgaagaacattcattgtatcccagtcaaatattaaaaataagctgttctcctggcttctataaatcagatttccacgcacacaatcctggaagagtatatctgtgcacatgcctgccctggagctatccgttagaactgtcctcacagtgacgtggaaaactttgcctcatctgtataaggtctcgtctttagagagaggagaaaggattgggaatttcaggcttgaatctctgaaggtgcaaagcttgaaaggttgagatggagagcagagtctgggaactctgtgtctctgccttggtctgtgacagatggggccgggctggtctcaaagccgttgcctagaactcaaccgtgggctggcgttacccttttgaactccccctgcctgctacaattcttctctgctctatcatgggtcccaggacagtttctgctccagactgtctgaggagcttagggaactctgaaaggaaaccttttaagtctgcttttcttgagaatgctaaccctgcaaaacttggccagacatcacattgggtctccctctgtggtgactcagaaatctcaaggagagcaggaaaatctagaggaacactcataatgttgaaagggccagagggcaggagggatgaaatttgtgtttccattgagtgggtgatatttttcatttcaaagcctgatgtaaaatcttgctggtttttagttatctacagattgagaatataaacactgctattaaaatatttcatctctcccaaatgaggccatgcacaaatttccttctatgtgcagagccttcagcaacatccataccaagcacaggcagacatccaaatctactctttttacttgaagggaaacagtgctatctctgtaggagacagaggctgagggaaaggaagagaggggtcttggaaggtcaaggctgagttgggggagagggcaacattcataggtcaggaaaggcaaaccaattataatgatttctttctatcactagcaacatctactctggaaacggttgtctaaggttatgccctttctggtaatattcagacttggagtacttaagcttagttaaaagaatttgctagcactttaaatgttggattgctggcgagaatagaaaagcctgtctcccttcaggcaaggtcctgccctgtgcttttgtgtgtacccctctgccctgagaatagctgggctattggaggttcacacagtcaataaccactgaactgcacccgtgggtagctctccagtgctgcctgctcatttaacaggtccttatggagatgggcctgatacacaagtgctggcgatcttcaggacaaacccaataaaatgagagaacctaagcttggcttctaaccttcctgggaaaaggaagtgtctgtggttttcatagagcattcagatcttttttgtacttctgtctttttccattgaagatggaattgttctaccctctccaaagtcagccctgaaccaaggggttttccatgactttctgtgaccatcaacattcaactgatgcctgtttcctatacacttcagagagagccagagcttcacaagccaattaacacattcctaagaatcaaaacttagtttctgggctgggcgccatggctcacccctgtaatcccagcactttgggaggctgaggcgggtggatcacttaaggccaggagttcaagaccagcctggccaacatggcaaaaccccgtttctactaaaaatacaagaacttagctgggcatgggagcgggcacttgtagtcccaactacttgagaggctgaggctggtgaatcacttgaagccaggaggcagaggttgcagtggccaagattgcaccactgcattccaacctgggtgggcaacagagcaagactccatctcaaaaaaaaaaaaacaaaaaaaaaaccttagtttctgaaacccataatgcaaatacatgttcctccaaaggtctcaatgttcttatctcaaaatacacattttattgcttttgaaatacatgattatcatatccctttggcatgaatttgtatgaatccttagatttaagtatgtaaaatataataaaaacaaaagtgtgtgaataccccctactgcagagttatgcaagcctaatattcaaagcatgacatattaaatattataccttaaagacagaattagaacatgaacacatgtataatgtctttgcctcaacttcaaaaatgcacagttgttgagagcctggaagagacattcaggaacgggctgcaacaagccttgctctggtgtggtcctgcttatccaattgttgctcaataatgtcccttcccggaggcatagaaggcaggcacccatacattcacacccacaaaaatgtcacctcattccccagagattgccagtctgggcattgaccttcacttaagcagggcatcagtgtgatgtggtccccctgctggaagtggaattgtttctaactctgggtgcccacaccatagagggcttgtctacacttggtctcagccatcaccccccaaacacacccagctctttaccacctgattccctcaaggcgactctccttccctctgccagcaccccttggttgtagctttggggaccctggatgtttgaaagtttcatttgtccacaatccaggtataagtcccccttccctggattctagggagggcagcagcggcatgtcgttgtcactcagcttgctaatcaagagagaaccccagaaagagtatttaggagataagaggggtagtatatatttttgtaaatagaaacttgttttctattaataattaaccatttttctgatagcaaaaacatcagcacaggtatactctatccatttatggttggttaacacacagaaccttttctactgagtagggttaataatacttagtatgtgcctagcattcaacactcacaacagccttgcgaaataggactatttttattcccattttacaggtaaggaaacagagaccagaggtgcaataactttcttaaaacgactagagggagcaagtgacagctaggacttgaacacaggctgttggccttcaggatctaggctcctaacacaatgcaccaaagccaagtcagtgccaaagttattccatacaaacggcacttgttctttcaccctttcaatgttcatgttatctctgctcttattttcatcttcattgtacacctccccttacatgtatttgcaagtctctcactttgcaaaatggaactgataagtactaaacctcctcaaaaaaagcacaaacagccccagagtgatgatgcccaaaacttaaatgaccacagcaaccagtgccatgccagtgagttttggagctgagctttggtcttgtccatagaagcttttaagttgaaagcttataaatagagggtttctatattctgtgaatgatagaggtacacagttccaattgtattctgtattacgtgtatgtgccctctttgcataaatgtgcctgacactgtagtggaggccagcttcttgaaagcaaaaaaacacgcatcccattcatctctgtatttccagggctcagcactagtgggtgctcaataaatatactgaatgaatgaataaaagtattactgcaaagatcagtaagtcccatgccaaaaaaagaaaggaagaaaaaagaaagggaaggaaggagtgagcgaggaatgaaaagagaaagagggaaagagggaaggatggtgagcctcttcagaaagacggctgctcatgcttgctctcttgggcatggagtgggtcactggctggacgtttaatgggtttacattattccttaacagtcattgtttcaaaatgaggcatctctgatggctccatgctggcttgtctctttccgcctatgacattctctcaagagtttagagtaggagaggattttagaacatgatagtaacaagtaaaattagtattttttggactccaggtacctgtttgaaattatattgtttagaatataacaataacagtgaaattaaattgttgtcttaaagtgaataactgtaaagccatgtgtgatctgaacccccgagcctgcccttatctatcaaaatcctggtgtctgaagaagtccaaaatggaaacacactctgaacagatttccggcaggagcttccaccaggttttcttcgtggcaagccctagaaatagtctggactacaagcaggtctttttaaaaccatgctcctttatttaatcatgaagatttaaagtttataagtttagaaattcagggataaaaataacccactgagtgtcaggcctgattgctaagtgctgttcaggtgtgatctcacagctctctcagcattttcatcactgccaccacttcacaggtgagaaaagtgaggcagacaacagacaagttactggtctaagtggtagaataaaaatataaccccagctccagagcctctgcactcagccatcatcgtgtactgccccgctgtgaatttcatctaggatatgccaagacctgctgatttttcgtcacttgccttttcttattaatgtctgttccttggcgacaatggcatctgctgagccccacccggcctccccacccacctcgccgcctgttctctccctcaaatccgaaaggtcacgggtacacacccaacttcagatagcatttagttagcttcccctccaacactgaggaaatgttcattaaatgctccagccatttaacaagtctatttaacttcattttcaatttaaccatgtattatttcagtttccttttcctccgtattgtatagccctgggaataagagttggaaatgtgcctatcataagctgagtcacattttatgtgtcccctcctctcaagccactgttttctctctctttttttttttttgcgattaaaaaaaatatatatatcctgtgtaaaataaaacagattcagaaaactgcgtaaaacaattcattatataatttgtatatataatgaatgaaagaaatagaactttctccttgtacttgcctcagaagccatgtgacccaagccagtcacagcccctgccaccttcaaagtcagcattgtattaacttatagtacttacatccttgtggatttttttcattgcagataatttttaacatttttgaggtataattgctatatataagaaagagcacatatttaacgtatgcaatgtaataagttttgacatatgtacatgcccttggaagcattatcacaattaagatagcaaatactggctgagtgcggtggctcatgcgtgtaatcccagcactttgggaggccaaggcaggcggatcactggaggtcaggagtttgagaccagcctggccaacatggtgaaaccctgtctctaccgaaaatacaaaaattagccgagtgtggcggtgcacacctgtagtcccagctacttgaggcactaaggcatgagaattgcgtgaacctgggaggtggaggttgcagtgagccgagatcatgccactgcactccagcctgggaaacagagcaagactgcatctcaaaaaaaaaaaaaaaaaaagatagcaaatacatccatcatcctcaaaaatttcttcctaccccattataatcccttcctcctgccacctgctccctcctggtaaccgctgatctgttttctgtcactatatatttgtcttcattttctaaggttttatataaatggaatctttccgtatatactctttttgtttgatttcttccactcagcagaattactttaaaattcatccatgtcttgttatatgtataatacctcattcctttttattgctaaagagtattttttgtacataaatatgatatctatgcttatagagcatatatatcacaatttattcattcattcagttgttgatatttacatcattttcaattttttactattgggcttttttccaaaatggttatatcgttttacctttccaccatgattgtatgagagttccagtttctccacatcctagtctgcacatggtatcattagtttttcttaattttagccactttaacaggtgtgtagtagaatttcatcgtggttttaatttgcacttccctaatgactgatgatttgagcatcttttcatgtgtttatttgccatctgtatatctaccttggtgaagtgtttgcttaaatctgttgcccattgtttaattggattgcttgttttcttattatcaagtttcttattatagtatttatatattctagatacaagttctttatcagacatgtgctttgcaaatattttctcctactctgtggattttttaaaaatttccttcatagtgatggagcagtttttaattttgatgaagtcaaatttatcaacttctatgtatcatgctttgatatcttattaaagaaattcttgcctaatccaagctcacaaagattttctgctatgttttcttccaggcacacatattatagtttatgttatatgtttagacctatgatctattttaagtcaattttttatatgatatgaggtatgaattgaagctcttttttatttgtttgcatatgcatttgattgttccagcaccatttgttgaaaagactgtcttttcctccactagattgcctttgtaactttgtcaaaattggttgtccatgtatgtgtgagtctgtttctggactctattctgttcaattagtctgtttgtctttatgccagcactgtactgttttgagtactgtagctttacagtacatcttaaaatcagatgatgttagcctctcacctttgttcaatctaaatagaaagttgttttggctactcttggtcctttgcatttctctatagatttttgaatcagcttgtcaatttttaccaaaaagcttgctgggaatttgaatcaaggttattttgaacttatagatcaatttgaggaacgttgacatctcaaaaacattgcatctcatgtctcatgaacaaagtatatctctccatttacttaggtcttcttgaatttctcccagctatgagttttcagtgtaacaggtcttgtacatcttttgttagatttattcctattttatgttcttatgctcttgtgagttcttaaatttcatttctgattatttattcctagtatgtagaaatacagttgacttctatattattgattctataatctgcaaccttaccaaacttattctagtagcatttttatagattccattggatttctacataatagtgttgtttgcaaatacagacagctttgcttcctcctttccaaactagatgcctgctatttatttttcttgccatattgcaatggccaaagccttcagtaaaatgttgaatcaagtggtgagagcagatccttgccttgttccttatattagggagaaagcatgcacccttttactattaagtatgatgttagctgtggttcttcagagatgccctttattagattaaggcagtttccttctattcctagttcacttagaattttttatcaggatgttggatttttgttaaatgcttttctgcctctattgagatgatcatacagttttccaaaattatatctgttgattttcaaatgttaaaccacctctacagtcttgagataagccccatttcatcatgatgtaattacctttattgttgtatttgatttactgaaatcatatttagtttttttatgtgttaaatattcccagtacacttgataatttgggatcccaatctggcttgttatatttagtctctgcactaagctctagctacggtagctacagtttacttaatgaccaaataacaaccttttcttccattttaaattttgtatgactttggctgagggtcattgaaaaatcaaggatgggaatacacacacacagaggcacacacatatacacacacacacacacgccccacagtcttacatggtgaggtcctgactgaagtttattaggaaaactaggagagacaggccacaggacttttcaaccttcctgagtagagctaacaggagactaagcctactcagtgagtctcagtgaaaactgggaaagagggatacggaggagaagcagtaagcactgctgcagttatggcttggaagaatgctgttaatactgctttatcccatcattgctccattgtccagtcttgacacaggacttcctgccgccttagactgaaatagaatcactgccccaagataaatgtgatgggggagacggggtttaggaagtgattatcagacacctgcatgataagagaaaatggaaagcaaaaacaaggagataagaaggaaacaagcccagcatgttcccatgggttttacacatagactcagaatatcagtagcagcagggactgtggcaacccaaggccacaatacccaactaacagataagaacaccaaggctagactagagaggctgttcatctgagagcatactggtttgttttgttttgtttttccctcttcctgatatatccagaaaatacttcctcctcccagccccgtttagcagtaacttacttccttggagaacaatgcctcaacccatattcaggccttaggttggtacagacaatggcactttacatgcgtgggactctccccacccccttcattcaatgctgcctaatgagcactcacttcttgggtctcatcaccagtcctgcactgtaattcagggagccagctgcctctgccaacagtgtaagtaatctcaggctattttataatcagtcctgaagaacccagagggggcaccagactcacctcaacctcagattatgttttggatccacttttcttcgtcttggatgaactttgtgaactttgtgtttgtgggagagcacagtgaaggatgaacaaggaaaaggaaaaaaggggtaggagaaccaaaggcaggacagcttttccttcctcttttctttcctgaatttttttttctagagaagtcttcaaatattccagcctcaacttttgaaaaagaaaaagcagaatgtttttagtaggatctttttgtttctagcttactgggagacagtgggaggatggacacttttgagcagatatgcatcacccaatcaatcatctccagaagaacatctgaatctctaaggaattgatccaaattgttaataatacttgtggtttaagacagatagatgaaacaccttgtataatcactatattcaatgtatttgactcatgtatgggacttagaatataaattttaataaagtagaggcttaagcttgcatctttgcttgtgtgtcgtactatggcgcgtaactgtgatttccttgctgaatccctttagggcaaagctggctttggtcatgatcagatttagggtgtctagcacatagtagatacttaataaatatttacataacaaacctttacatggtactgattatgtaccaagcaccgtgctaaatacctcaaaaatttaagctcatttatgccttacttgcgtaaggaaactgtcattactatctatattttacaaagaaaactgaatccagagagactgagcaccttgtccaaggtcacacaactagtaaagggaagagccagcatttgaacccaagcagtcttgctctttttatttgtttatttaatttttgtacaggcagagtctcactatgtcacccaggctggtctcaaactcctggcctcaagcagtcctcttgctgtagccttccagtgcttcgggattataggcatgagccaccgtcctccgccaaagaggtcctgctctaaacacttgctaagaatacattgacattgaatttttcagtcattaatgttatgatgcttatgaaatcgtgacatgattctgcatgaaaaatggggattatatgatgatttcattgatctaagacagttaactagacatcagaatatatcttcacttcctaagttacccactggttattgattctatgttggttgatctataaggaggcatacatttgttaatgtactccttactcaacattactaattacatttttactttaaaaagcatcagtgcttcttctcttactatatggaaattaaagattctttttgcaattttgtttcttattctttctacattctgtaatgtattagaaacatgaaattactcctttgttcttcaggaactgttcatttgaaactctccaacataaggatgctggggagaaaacattcctatgttttattttgataatgaaatattgtgtagttttaaagcttagacatataaacttcatgtgaacatcatatatatataaaaaatcatatatatataaaatatcatatatatacacacacacatgtgcacacccttgcatctaatttataaattctaagatagtcatgaacatacatttttagattctgtgacttatttggcttttaatgcaccacaaggtaaaactctttatactctgtcatatttttgtattttctacccacttaggggagactacaattatataaaagttgctataacatttttaattaattacttgactccaaataattccctgtaacattctaaatttaatcatttgactctgagtagattcgttcctcatttaatatctttgtcactttcccttcaaattctttctactgttctttactttgggcttacttttgctgtgcctctttttcttcatttctaatctactatacattctttttttttttttctttttgagagaaggtctcactctgttgcactgcagtggcgtgatctcagctcactgcaacctccaccaccggggttcaagcgattctcctgcctcagcctcccgagtagctgggattacaggtgtgtgccaccatgcccgactaattttggtatttttggtagagatggggtttcaccatgttagccaggctggtctcgaactcctgacctcaagtgattcgcccaccttggcctcccaaagtgctgggattataggcgtgggccaccgcacctggtctcactacgttacattcttaatatggttttgttagcactctctgtgccaaaatcctattttcccctcttttcccttaggcagggcatgcacagagcagatctatttcctaccaaccttttttcccatggcacacacagctgccccttggcaataagatgcagtccctgactaatgcagcattgctctctgaagattttaatccagctttcttagtctcacctagctttatgaaaaatgagaggctagatattttgctgtttcttactaagatttgcattgctcatactataggtgccctgtgtaattgctctaacattttctcttcacacaagattatccagtattctctcttatcctgcctcatccttttccttttctgtagccagttgttatgaaaggggtggccatggcagacactgttgcagtgtaatgtcaaatattatatatttaatgtgcatgtgcccgcatgtgtagttttggtttttttgttgttgttgtttgtttttggagacagagtctcactctgtcacccaggctggagtgcagtggcacaatctcggctcactgcagcctctgcctcccaggttctagcgattctcctgcctcagcctcccgagtagctgggactgcaggcacctgccaccacacctggctaatttttgtaattttagtagagacggggtttcgctatgttggccaggctggtcttgaactcttgaccttaggtgatctgcccacttcagcctcccaaagtgctggaattacaggcatgagccactgcacccggccatgtgtagttttcaaaagagccatagataggagtcgacatttgaaaccattcaaaatgaacatttttttaaatgccaacagaatacttccctgaaaaaaagagccacagatacttgttggctttctttctttcaatttttgtgatgacaaagctgttggatttgacttttgagtagtaagtttatcctcagggcctttaataacaccagcatggaatcaaaattaggagaattactggactttggctatgtatacaccaggtttgtgactgttgaacaggatgatgtttgagaagatttactgaggttttgggggtatcttccttccctgcattttggccagtttcaagtcagaagtgggcagagcctagttaattgcaatggaaaagggcaaaccaggagccagcagctggagaaccaccttgagcactggcacatagagcacagttgctcagcatggctggtgtggtggaggggataactatgacatggtgtatggccaggggcagaggccgggaagcctgtcgcagcacagcatgttgcagtgacatgatgacaggaagcctcggagcaaatgctgtttggagatttgagggaggtgaacaggctgtcagcattgaggaaaactgtcagcagaccacagtgatgcaggcgctgggctgtaggtcagaactcttaaggattattaagatcataccactttagtagggctggttacaaggtaggataccaggagaggaatatagaaatgagggacaagacaggcaattcagaacacagctcacagaagcccggaacaagactggaccaaacaagttcaagtacaagctaaaagtcatgccatcattatattgaaaagatgtgatgaaaaagtaatgtacccactgactgattttgccttattgcttgggcatagtgagaaggccctctcttcctatcattgttttgataaaagaaaaaaaaaacaaactaccctggcacccatcagagctaaatgctgtctctacctgccttccccaaccagattcatgcctggtttgcttagggattatctgatgttactagccatgtctcttcttgcctccactggcatggaaaatctgggtaaccacaagcaaacttgaccagactgctaccaatgcctgaaactgaatattatagtacaaccgtgtgacacattcaaagatgctgactgctgtggaacactgaggcgcaacagaacttcacgaaaagaaacttttcagtgcaccctctgttagccaactctttttgagtgtgcttgcaactgtgctgttgatgtagagcgaattatatgtttaattttgatcccaaaccataggtagatgcttaatttttaaaataggcagatagtgtctagaaaattagtagagaaaagtaagtttaagctaaatataaaaacaatgaacagaatgtttcctatttacatgttttgtttactttttgtctaaaccagagatgagcaaatttttctaaaaacaaaaaaccaaataaatattttaggcttagaaggccatatggactctataataggtattttacatagtccttgttgtgtgaagcagcaatagacaatgcatacaagaatggtcatggctttgtgccaataaaactttatttacaggccggtcacggtggctcatgactgtaatcccagcacttgggaggccaaggcaggtggatcacttgaggtcaggagttcgagaccagcgtagccaacatggtgaaatcctgtctttactaaaaaaaaaaataaaaaaattagcttggcatgatgatgtatgcctgtaatcctagtgctttgggaggctgaggcatgagaatcgcttgaacctgggaggtggaggttgcagtgagccgagatcgcaccactgcactccagcctgggcgacagagtgagactctgccttaaaataaaaaacaacaaaaaaaaactttttttacaaaagcaagcagtgggccagatttggactatggaccatagtttgccaacccctagtctaaagaaaacagcatttctactcacaaattttatatatatatgtgtgtgtgtgtgtgtgtgtgtgtgtgtgtgtgtgtgtatagtactgtttctgttgaacagataaaaccatatattcatggtagctgcagaaagcaaaagatacctttaagtgacttcctcctttttaatggataatggcaatatttattattttgatttagttaaatatttattgctgagtaccagttatgttcttattactcagtattaaaggaagattttaaaactcctggcagcctctgatctccaggagctcatagtataagagagctaagcaataatattgcaaagcagtaaaataagcataatacagagagacccatgtgcactgggacagtttggtcttcaggaggaggggtggatctagatgagtcctgagggccagcgcatatttctaaagacgggagagacaggagagcatctaggggagaggtgatgagaccaggaggagcatgaacaaagattatacaatcagagaaaacgaatagttaaaagaaagcaggtaactaggctagccagggcaagatgatcatgctggctgtgcctcttcaccttcatccataagatacggagagtaacagtagcttcctcgtagggctgtcatgaaaatttagaaagttaatatttgtaaaattcctggagttgttcctgacaaagaatatataagtatttgtcaaacaaataaatgctggaggtagaggtggggattggttgataagatatggtaagatggagtcaggttgaggacaagaataattttccaaaaacactttgatgatgtagctgtatagtgagggacctgtagtgtccactaccttcaggacaatagccaaactcccaactaggctttcataattgtcccctgatcccaaatgagtgatcagtaagtgaggaatgtaaaaggtaactcctgaggccaggcactgtggttcacgtctataatcctagcactctgagaggccaaggcaggaggataacttgaggccaggagttcgagaccagcctggccaacaataatgagaccccatctctacagaatattaaaaaaaattttggtctgagagctaggagcaagagcttagggaaaggaggaataagaggaggtagttggctaccaacagacatctgaattcttaaccaatgaagagaaaaaatgtaaaagtggtcccagccgcttgggagaatgaggcaggaggattgcttgagcccaggaattcaaggctgcagtaagctgtgattgtgccactgcacttcagcctgggaaacagagcaagaccctgaaaaaaaaaagagagagagagagaaagaaaagaaaagaaaagagaaaggtaactccagttccagcacacagtgccactgcaggagtgaggaagccacgtgggagaattattttgtgggaaaagctgaggaatgcttttgcacatgttgtattggaggtactggtgcccaagtggagacagcctgaaggcagagggcggcttgagttggggctagagatggacacttgggaaccatgagcacagaagagaccacaaacatgttgagacaagggaagcgggcgggagaaagagcagggcattgagtcttgaacattgctcacaccttcattgatttggaagagacaaactgctgctgtcaacccaagtttggggtaggcggaaaagtggatacagagattctctacctcctcttacttgggaatgtaagtcaaatgtgagtttcatagcaggaagagcgtgaagttgttaagtgcacagtagtccatgagaacagattttcccatcttgagcagactctgcagagccacaaacaatgccgccttatgagctctggtcagtctggtcatgggatacctgtggggatttctttcctgtcggagcagtggcttccgtgagacttggcaaagaggctggtctgaggaatgcttctggttgtgggtacattccagcccagggtggtgtcccagacattttccttttaatgaagccccagcttttttctcccttttgctttttttttttttttttttttttttttttgtaatgaaagggttgttacaagggaaatacaatggggccctggctgtgtttcattaacttttaatttaagctgttagtatggaattagttagcagacttgtgaatcaattagctagccagtgggattccattttaacaaggggagcactgtgcgctctcggatgctagctatgtgtgtgaatgcggagtttaaggagcttcgctgtttgttcgacatccgaaagtgaatcacagtccttgttcctgcctcctctactggttccaagttcactcggctagaacatgctgtgcatcacccaacccttatcttctctacaaatacaaatttggattactgaataaatccagtggaaattcatttttcatgctgatgaactcaaagactttcagagttaaaccaaaacaatgcactcggaactatagtgaaacatttgaacatttaccctttgatccagagtttccccatattctgggaagcagtaactcctgggcaattctgcagtcttctgaaagttctatataagcttaattgtccttcctcatttgcaaaccccaccttgggtttgggaagatctgacagctgctgtctgggtttggcgtacttaccccgttactggttgagaggagacccagttaacaatttcagcctcaaatttaaagtccagtcatctcaaaggaagacagtgacataacagggaggcctagctggctttaaaataaagggagaggggacagagtcagttctaataaactgtagagatatatatatatatatatatatatatatatagcattttaagcccaacttgaagaaagttgctgaattagcatcagaaagccacagaaaaatgcatagagggagagagataggcttgtgattcacattaatattttgggcaatggaatacagtgtgaccaataaaaatgattcaaatagtatgatagaagtatactactgtcggccgggcgcagtggctcatgcctgtaatcccaacactttgagaggccgaggagggcggatcatgtggtcaagagattgagaccagcctggccaacatggtgaaaccccgtctctactaaaaatacaaaaattagctgggcgtggtggtgtgtgcctgtagtcccaggtatttgggaggctaaggcaggagaatcgcttgaacccgggaggtagaagttgcagtgagccgagatcgcaccactgcactccagcctggcaacagagtgagactccgtctcaaagaaaaaaaagaagtatactattttcatagaagtatacttattggcatagaaatatgtttacctgtcaggtatggtagcccatacctgtaatcctagcactttgagaggcctaggccagaagatcgcttgagcccaggagtttgagaccagcctggacaacacaggaaaaccctgtctctacaaaataactttttaaaaaaattatccaggcatggtggttcacacctgtggtcaggaggctgaggtgggaggatagtttgagtgcaggaggtcgaggctgcagtgagccatgattgagccactgcattctagcttgggcaacagagcgagaccctgtctcaaaaaatacatatatgtttatgaatattggaacatttaaaaagcagtaaatatactatgaagtacaattgaattttaatttcagaatattatatgcacacacatatactgtcagcaacaaagaaaaaaactggatagaaaattataacactgttattaattaaaattgttatacaaaatttgagaacaacttgggggttataagaacatgaaaagctgtggtttgcaaccttcatagggtcccaaagcaagatggaaacatcccaatgggaggttaacacttgacaatcttataacaaggtctatatatcaaacttattatctatccatctagctagctagctagctaacttaccttctatccatctgtccagctattatgtatattcatgaaactcatttttaaaacatgggagataatggctctaaatttcaaagaaatgtttacaccttgccaggaaggttttcttttcccaagtcagggagtgaaagatgtctgctaattcattcgtgaacttatttacctattttttccacaagtatttattaagaacctgcccatcagccaggtaatcaggaatcctaagattaaattattagagtatttttcattgttcaagttttctcttttcagtcatattatgtgtgtgcctcctctgagcacaagagatcaagggaaactacttacaatcttgatttataataagtgcggtttatctggaagtagtattgaagttttcttacaattgagcattttttctagaagggtgatggtactgcattggtaagactatctaaacctgtgctgtcagcacagtagccactaaccacatgtggctatttaaatttaagtaaaaattcagtttctctataactgtagccacacttcaattgctgaatacccagatgtggccagtggctgtcatactgaacagtagagatataggacatttatgtcatcacagaaagttctcttggacaatgctggtctaaacctaattgctgagaacacttgtgtataaaaaggcacttttcacattttttctcttcattgcttaagaattcagaagtttgctgatagtcaactactttcttttattcctcctttccctaagctcttgctcctagctctcgaagcaataagcttttcagaatttcattatttgtcagcaccggctcgagagagcaggcatcaaagggccaacattacacacttatgtatgtttatataaatttggttaaatattaatttgaaatggttgtaaatgagatttcaggtttgcaacagcaggaaaaaagtctgtataacttcgctgtaaacatggtcattggcgttaagttgttaaactgtaactaatctggcatctttgttacgtagtcaagttccactgggttttgctgtgtagcatgcgattccaaaaatctcagtgatttttaacaagaaatattgctcactcccatagatagaaggtgaaatgatctcattcctaatttgcatttgagtagcaacctaagtactaaatcacaacccaggaattttccaaagttccttacaagtactttgaactggatctttccttagaaaaatgtgtagaaaaggaaaatacataatgactggttattattctactttctttgtgtttagaggcagcattaattttcaagtagaaattatatatatatttttaatgtgaagccaatctggaaaagctgcatgctgtataattctaaccatatgacattctggaaaaggcaaaactatagagtcagtaaaaggatcagtggttgccaggagttgaggggagcaggagatgaatagggagagcacagaggatttttagggcagtgaaatcgttctgtgtggtactgtgatgggggatccctgtcacgatccattcgtcaatatccatacaatgtacaacaccaagagtgaacgctggtgtaaactgtggactttgggtgataatcatgtgtcatgagggtcatcagttctagccagcgtaccactctggtgagagatgttggtaatgggggatgctgggcatgggtagggacggggaatacatggggaatctctgtacctttagctcatattgctgtgaacctaaaactcttcttaaaactaaaattttaaaattaatgacaataaatgaatttaaaaataaatgaattaaaaaatctattttaaaattaatggcaataaatgaatgagtaaagcatgattaatacatatactaccacccagatcaaaagaatagaaccttgccaccccaacttcatatacttcttcctttttgcaactctccgcaccttgagaggtaaaccagaatcctgactttcgtgataaaatttcttttctttataattgtatgatctatgtgtacatttctaaagcaatataatttagttttcctggtttggaactttatataagaggaatcatgacatacatactctttcgtatcttgattcttttgttaaaatttcatttttgacactctcattcatgtcttttagtgttggtgagcatttctgtaaattttggctctaactagaacattataccatctttaagaggagagctcagatcaatgcatgctactgtgcaatgggaagagttggggcaggaggaaaaatatgaagaaaatgttaaccagtgtatttgatttgttttaaaatacatttattacttctgtaatttttgcaagtgtataattttcctaggttctaatgcagtatatagaaaagacatttagggccgggtgcagtggctcacgcctgtaatcccagcactttgggaggccgaggcaggcggatcacaaggtcaagagattgagaccatcctggccaagatggtgaaaccccatctttactaaaaatacaaaaattagctgggcgtggtggcatgtgcctgtagtcccagctacttgggaggctgaggcaggagaatcgcttgaaccaggaggcagaggttgcagtgagccgagatcgtgccactgcattccagcctggcaacagagcgagactccgtctcaaaaaaaaaaaaaaaaaagtaggaagtaatgctgataacttgaacacaaacactttcgtattttcatttcaggtttaaagtattcatatatcataatttaactcactagcagagtgtacttaccctgcagtcagacaatttcctctctctttaaggaaaaagtataatctaatctggtaggggatttttcttttatttttaacttaacaccgtgaaaaatcaaaacactgtccttgagaaggcataatttttgaaatatgcaaatttaaacggtatcttccttttaagttgtgtaaaaacaagacttttgcctaagtgtaagaccagaattttgcaaaattctggacctgcctctctggcctgcctctctccggttttgtgtagggcagcaggaggcctggcaacgtgaatgtctccaaatcctacttctgctctaaactgagattttgtggtttcttttttttttttttttttcttgaggcagagtcttgctctgtcacccaggctggaatgcaatggcgtaatctcagctcactgcaaccaccacctcccgggttcaagccattctcctgcctcagcctccccagtacctgggactacaggcatgtgccaccatgcctggctaatttttgtacctttagtagagatgggatttcaccatattgtccaggctggtttcaaactcctgacctcatgatctgcccacctcagtctcccaaagtgctgggattacaggcctgagccaccatgcctggcatctttttttttttaatgttagaatttaaaccatctggaatttatattgtcatctaacatgaggtacagattgaaatttatttttccctgcagttcattgaccaatctatgctttctcactgatttgaaatggcacctttatcattctcgaaattattcatgcttatggctctttctgatgttctgttctatgctgttgtcctctatgtcttcactttagccagtgtcatgctgttttaattattgtacctttaaaatctgtcagcatctgctagcagagatactagcatgcatacacacacactgagtattcctctcttttattactgtttattatcagataaacttttgcatatatatgttaatttcagaaaagtattccattgtgattttgagattgatttaaaattaaaatttgattttgtggagatttgacatctttagatcactgactcttaccacccatgaaaatgactctctctccattaattctaaccccttcaataaagttttgccatagtcttcatatagactttgtatattcttattccatatccctatgttataacaggcatcagacctatcatttgacaccaacagctggcatccaagaccacaggaatgatgcccaaagcagtctacacccactccccactagggcccaggaggaagtgtgtttgcagccctgacctaaatccacttgtacctttctctcctctgcacagtgacctctgcctggccaaagccccatggaatgccctaatcacatgtccctctgcagaatagtcctttctccaaaatgatccctcttttattccaccaccaccataagtcaatctctagtttcccctctgggaccctgtattactctgttttcacactgctataaagaactgcccaggactgggtaatttataaaggaaagaggtttaattgactcagtactgcatggctggggaggcctcaggaaacttacaatcatggtggaaggcaaaggggaagcaagtaccttcttcacaaggcagcaggagggagaaaaaagcgcaggaggaactaccacacacttataaagccatcagatctggtgagaactcactatcacaagaacagcatgggggaaacgggccccatgattcaattacctccacctggtctctcccttgacacgtaaggattatggggattacaattcaagatgcgattttgggtggcgacacagccaaaccatatcagatcctgatagattttaagcttggtgttgattatctgattgaaataattctgaagattgttttaagctcctagacaacaaactatgaacaaagctgccttctagagaacaggatcaggaggttgggggaaggatactttagatatttccttactgttttgtgtcactttatgtctccaaataagtacttcttttataacataaaatcttctaaaaaaaagcaaacaaacaaaaaaaactgctttccccctcccaagataagttgttttaaaggaggaactattcaaatgaatacttagtactgaacagtcattcctatcttttgggaccaaggaactcttcaaaaatttgatgaaaatggtagacactttcctctgaagaatgcacatatgtacatagctacaattttgtgtaggatttcagaaaataaaaggctgctgccctcagcagagattcgtacctctgtataattggtttctggtgaggtacacatcactggatcaagattcctgtgggggcttctggagtccccagcttccttgtcacacctcatgtcgcatcacggagcagaggctgactcccaaaagttactcagcccctttttagaataagaatagcctcagaacagggttcctttaaaaaaaaataggagagtaattttacatgacacctaatgagttgaggaaaacagaactaacctagggaatattgccaagtaaaagaagtttgtctttactccgcagcctcccgtgtcccccactctgagtctctctatgactcttctacttcctctcgcctacccaaaatcttggcatccttaaggtgcacctgagtcctctccactccaagaagctttccttcgttcctcaactcaagcctcccactcgtcaaactttcccacaaaagtaacccaaacagaagagagaggtgagcctgtatagcctgggaactctagggacaaagttcaaagtagtcttcgcaatcaaggaattccactccaaaacacatctgtgtgggaggatgctgggtgtgtgaatccagcagataaattctatttaatcttattctttttttttctttttttgttttttttttgagatggagtctcactctgtcacccaggctagagtgcagtggtgcgatcttggctcagggcaacctctgcctcccgggttcaagcgattcttctacctcagcctcccaagtagctgagattacaggcgcaggccaccacgcctggctaatttttgtatttttagtagagacagggtctcaccatgttggccaagctggtctcaaactcctgacctcaaatgatccacacacctcggcctcccaaagtgctgggattacaggagtggggcgtatttttaaatgtgcgtaatacatgtatgtaatttacaagtaaatatacctacatattttatatatgtgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatgtgtgcatatatatcacatatatatacacacacatacatatcacagtaaaaatatagaatggagaccagtgctttacctgaatactagttaaattacttaactctgctttcctgctccctcccacctcaccccaaatcacattgcctcagaaagaagggtagagagtatttaagtgagaccaactgagtttgaatcctggctctgcgactcactagcatgagatgacttaacccttctttaagcatcggtttccccatctgtaaaaagtgggtgacaaagtggggttgctggaaggatgtaatgggtaaagtgatcaatcaacattggacatgtcgaacatcataaagatacgcacaggaagagcacagcccatctttccctcccacagtcgttatctcctaccctgtggttctttctctgcactgggtgaaatcccaagagacctcatagctttctagtagctttcagatagaagtcttcccatcagaaacagatcattctcagtatagtaattaaaatcttgtctggttcagtcatctaaacttgggtctaggcctaggtgaaacctctccccaccctcacactattccaggaaggccacgttctgcctagggtatccaccggggaggcacagggttggcctcctctctggctgtccccagctttctaggggctgtttctcctctaggtgcagtggcacggctcctcccgtcctcagcctcgacggaaccccttttccaggggttctccaggcccgctcctccagctgccctctcagttaggttccctccccctgcaggatggtcctgtggatggagttcctgtgatagtgacccggtaggctccttccaggcccacctggcctgaggcgaaactcctgcatgccctatggcctgtcctcgggcagtgagagtgtcaccctctcccacctgcctgaaattccaagggacttactcaggccctctaaggggtcctcttgaggccctcccacttcactgaaggtgaggggaaagcaatcctctcctcccccagggtggaagacacaacacacatgcgcacacgcatgcgcgcgcacacacatagacatacgcgcagcgcacagacgtacgtgcacacgcacacacacatgcacgcacacacacacgcacacacacacacacacacacacacacacacacccctctggctgcctcaacccctctttcactagctagaggggttatcagtggccaggctagcagaactgatttctggctctgtggacataacctacacgtccgtcttttagcctctcggtatggtggcttagccctttccttcagtgggtagagtgttcagcatctgtcttactgctcacagcctgtggggaatcagccaaaagtgaggctgaaagaattgccatgtaatatctttaaccctgtgcttagtaaatagtaaatgctcaatgaatattagcgatcattagtagtagtggtagtcatagtagtgtgttttcttatggtcttactctgtttgggctgctgaaaccagccattatagactgggtggcttataagtaatagaaatgtatttctgctagttctggaggctgggaagtcccagatctaagcaccagcagattcagtgtttggtgagggttggcttcctgcttcatagaaggctggcctctcactgtgtgctcatgcggtggaagggaccgggagctctggggctaaaactctcatccatgagagttccacccttgtgacctaatcacctcccaaaggtcccacctcctaaaaccatcacgccagcaattaggatttcaacataagaattatagggacacacaaacattcagtctttagcaagatctcacaatgtctgcactatatatagctttaccaccatttgaaaagtacaattcctgtcagtgtttttggtaacccactgttgtgaaatcaatttaaaggttcttgagtggcaatttgaaaatgaaatcgaagagtagaaaaaagaatagaaaaatcaagaatgcataataggtgttgtttggaaaatttgtgatttaagataattaagtatatatatgttgccattttaaatgtatgtattatattggttgctgtcaacaaaatatgaacgctacagcatctgaggttttccagttgtccaccacaatgattaacatgtgagaatcttcctgaaaaagttcaatgattaacatgtgaaaatcttcctgagaaaagttcctatgtggatgagctctaaggaatgaatatagaatgttctattccccacaggtctctgcagtgaatacagttaattgggagctaatcatgaactgctttatatttttccctaattgtctttttttttttttttgagacagggccttgctttatcacccaggctggggtgcagttgtgtgattatagctcactgccacctcacatttctgtgctcaacagaattctcccccctcaaactcccccgtagctgtgaccacaggcaagcaccaccacatctggctattttttgtacttatttttttttatgtttaatgtttgtgggtacatagtaggtgtatatatttatagggtatatgagatgttttgatacaggcatgcaatgtgaaataatcacaatgtgaaatcatggagaatggggtacccgtcccctgaatcatttatcctttgtgttacaaacaatccaattacatgcttttagttatttttaaatgtacaattaagttcctattgactatagtcacccttttgtgcagtcaaatactgggtcttattcattcttctatttttttgtacccatcaaccaccctcacctcccaccttgccccccactgtccttcccagctctaactaatttttttagtatttatggagacagggtctgccatcttgcccaggctggcctaattgtttcttgagaataattgttgtatcccccaaacataaggaggagagaagtcgttttacatttctgatgatgctttctcagagcccagtgcaaaggagaacaccagtcactgctggcgggtgtctgacattcagtttggctgtttcacttgtcctgtgatagctaactgatcttgctgtctcatcatgcattatttgcacgattggcagttattaaggtacaccaggctagaagggagtccatctggctctccgctgggccctgtactcttggcccaggatctgaaccatagcctatgcttaataaatatttgtggaatgagtaagaggttccatctatgagatgaaaaccactggtggctgataagtattcaaatggcatatcttctgtaaatgttacagaacgtcaatgccattaggtgcttgaagagaagtttaaaaatattcatatgcaggaaatgagatcatagaatttctcataaaaatgcagtttgatcaaattgaggggatggatacccacttaccttttcatagtaatagtaaatttgttatagaaaacacattttaccttccttgtctcctaattcgaggtcatgtgaagcttagctagaaggagcaaagtacattttgttctgcctgaactgtctctagtgaatacagttaccctgggctttattatgaatacctggcctgttccacaaaagcaatgaatagtgcttcaaggaagaaattttacttgttttatttcccaagaaactcaccaaattgagttgtctctactttcctttcaaaactataactaagtacagtagtaatgtcaggtcacttatgattttgacctgtgccaatctttgaatatttgaacatttttatctcctgaaaaattacttggcttgagggagacacagttggatgagcaaagaaaaaaagaaacaatcaaatgattttctgatgctttcgaatgttcataggcttgctttgaaatccctctgtctatatcaccccatcctgtttttgacttctaatctcctttaccaaatactatgtagcaatattttgtgagtcatccaaaagttgagtatatttagaccaccgtgacaatcaaacagtataaacagaactactcatctgtctgttcatcatcatcccacgcagggagttaattcctaataaaggagtttatcagatcaccctcaattacatcactttgggataatttcatacccaaggaaatttgaggcatttttgccttggaaaagagcaggtgccttacgaaaaagaaactagatttgtgagaactgggcttatgtttcaaatttatattctcaactttactctgaagagatggcttggaagaagtgacggtaacacagaattgccagtttgcttggcaaggtcaaactattccatatgttaccttgcaagaaaaatatgttaatttaaaaaatatcagagaccaaatgagaagttgaacacacagctgatttagctcagatttttgtttgttgttataccgattgccatattagctccctcttctaccacctcaaccccacccccaccaccatacagctgctcgcttgctcgttacaaagcatatttccccctgtatattaatgtcatattcagcaaatcaggaaattttgcaacttcccttctgatcctaatctggctatttttcttgagttcagtgtcatcaaatcagaaccagacacttttgttaagggtatcacattcaaaattgcacacaaacaagccccaccttatttttatgaaaagtctgcccagttacccgctttgtcccgacactaatagagccaaggctcagggtttgcaatgtaaggaaatgtggagtacattccagcatgctttctatgatgagtagatgtttgatagtacacctcacttatctgtgcctccccagttggggagcctttttcttatctaaaaggccttgccatatcaaaggtaaggatactgtttggtaaattcctctaaataagaatgccactaggagaaatttaaattatatgtaaaggaataaaagttgaaaaataaagggttttttgtttgtttgttttgaaaagttggtttcaaacttaaaaatttgcaagtgtcattttctgaattgtggaaatagagtaaaatttatcatttcttataaagttttaacattagaaaaaaagcttcttatgactaaaactaaggcatttggtaaaattttcttaccgcttctactataatatctatttctctttagatagataaagatacagatttgcagtaacattggaaagtaagtgaaaaacacagaggaaattaaaactttactataacctacctgtgtagaaataatcactgttaattttaatgcataaatataaatttttaaaaagtggaaccgtattgtaaactgatttttatcctactaaaacaaacattaagtatctgctgaaatgttttaaattttttcaaaatatatgtattttctgactcatttgctataatacttaactcattgctgcccatgtaaacttgaactgtctcatttgttaaagcgtgagagaattcatagttaattctttgtacagctaaattgttcagtaggaaatgcagaaagaagtgttaaaagaaaatcttcagccaaatttaatttaatttaaaagagtttaattgagcaatgaacgaatcatgaatcgggcagcccgcagaatcacagcagattcagagagactccgggggtgccttgtggtcagaacaaatttatagacaaaaaataataataataaagtgacgtacaggaatcagaagtgaagtacagaaacagctggattggttacaggtcagtgtttgccttatttgtacacagtttgaatacttggcagtgtgtgagtggttgaggtatggctgctgggattggccaagactcaaccactgttacagatgcaaacttttaggctgtcaatcttgtttacctattaagttaggttgcaattcatccacaaggactcaaatacagaagtatagagtccttctcaggccatatttagtttgttttaacagacgtagaagagaaaacccttgttctttgctttgtccagggtagtcagctgattggaaaggtaaccgaagtctctcaacatcaaaacatttctaatgcaaattctttaagtcgtactgttcctactcaccttgaacttatgagcaaatcccttatcaattgtgctaccttttattcagataatgaatttgggaatagggtttggaattcaagtcccatagcttagaaaagattgagtacctggcaattcagtatagttgtggattgcaataattcctgtgcttgttaagtaaccaagatttttgtgtgtgtgcgaaaagcatgtgtaaaataattgacaatcagcacttctgttggatagatgggttcctgaaagagcatatgtgaataaattttggtgtatctgatgctactttcctgttaagctactatggaaattatcttaaacattatattcttttccctgaggcagaaaatgtaaataatacattcccacaggtaacaactataactatttcctatgtatgttttcaaaaatggttcatgcacttacgagcatttgtgtactgtatgtattcatgcacttatatagggtaccctaagagatgatttttacatgagggcctatcacacttacatattcttacttcttaagggaattcaaaggtagatactttgttgtccctaaaaaaggtacatgaagatctatttccctcttatcagaggcaggcttcatatctgtagtaaaggagaaaaatatagaacatttgctttaaaagttcctctttttataaataatacttgctaacttttatgcttctgttttataaggaatttcttccttgtgctatatacaaaagttgcttccaggtggattaaacaaggcataaaaagataataaaggaaaaatttgataagtagttcaaataaaaaaattctgatcattaaaaggcaccctaaggagtattaaaagacaagtcatagggtggaaagtatttgcaacttatgtagacaacactggaccagaatatgtgggttacaaatggaataaataaagaactcgtacaaatcaatttttaaaagctaccaggcaataaaaaataaataagtgaaaagtagaacagccacttcaccaaagagagaattcaaatggctaataaacatgaaaagatgttcaatctcattaagtaataagaaaaatatgaattaaaacaacagagataccattacacacccatttaattggcaaaaatttaagcctgataataccaagttctggcaaggatgtgaagtaacaggatatttcatatactgccagtgggagtataaattgttaaaaaccacgttggaaaagagtttggcataatttgataaactcaaagttatgcaaactctatgacctagcaaacttcactcttgagtatatttctcaaagaaatgcttacatacgtgcacccagagacacgtaacccaaatgtacatagcagccctgctcataataaccccaaactggaaatattccagaagtccatcaacagtagaacaagtaaggaaattgtggtagagtaattcaattaaatattattcagcaattaaaataaatgaactatagctagacgaaacaacatgataaatcttacacacataatatagaacaaaagcatacagacaaaaagaatacagtcagattccactgatataaagctgaaaaaggagggagaaaccaagtaccttgctcagagatgcataactgaatagtaaagttagaaagaaaatcaaggaaatgataactctgcaagtcaggattgcggttaccctgggaaaacccaggggtatgagggggaggcacacacaggaatcttctgttctatttttttacctgagcagtggttacaatctgggtgtttgctctataactctttgttaaagtgtaaaatttttttgtttgtttgtttgtctgagatggagtctcactctcttgcccaggctggagtgcagtggcacgatcttggctcactgcaacctctgcctcccgggttcaagcgattttcctgcctcagcctcctgagtagctgggattataggcgcatgccaccacacccagctaattttttgtatttttagtagagacagggtttcaccacgttagccaggatgggctcgatctcctgacctcgtgatctgcccgcctcggcctcccaaagtgctgggatcacaagcgtgagccaccacgcccagcctgtaaatatttttttaaaagacgtgcagatagaaattatcttaaataattgcttacaagacaaagagaacgacctgcccccaagtcccccagataaagtaggatatcactaagaatccacacccaagtaaagtaattaaaggggttaagatgtctctccttttgtgattaacaccccgtcgtgcttgcagaggcaccgctgggtgtcagggaacctgcctgctgctcacctgaacaccccataaataacaccagctctaggacatggtccatgtgaacaaatgaagaatctctccttcagccagagggtgagagtggcataggtaacaactagataatgcttggctctgcctttttcttattgatttgtaagagttctaattgcaagataggctgagaaaagtagtctagccatgttccatgaagaagagaacatggaattaggttagtagctagcagcctcagccacaataactttattttgtttgtgcactcatcatttaagaagtatgtgagagcctacaaaattggggagttacttctcgggaatgctccattgagaaaaactgctgcctcttttatctgtgtagtcaatatcatggcctaaattctagaatcttctcacatagccagagtttagtgatcaagcaccacaaaccaagagatattacataacaataggatcgctcaaacaaatctacgtgaactaggaaactgctttttggctcactcagaggtacaaactttacacccactgaaaattgtcccaggattggataaagaaaatgtggtacctatacaccatggaatactatgcagccataaaaaagaaatcacatcctttacagcaacatggatggaactggaggtcataatcctaagtgaattaacacaagaatggaaaatcaaatgttgcatgttctcactttcaagtggaagctaaacattgagcacacatggacataaacatgggaaaaatagacactgcagacgactagagttggtgcggggaggacatgggttgaaaaaatatttttcaaatgtaactactgtttgataaaaaggaactatgctaaatgaccacttctcccagctaaaggcagaccatctacattacatttttttttttttaagacggagtttcactcttgttgcccaggctggagtgcaatggcaccatgtcggctcaccgcaatctctgcctcctgggttcaagcgattctcctgcctcagcctcctgagtagctgagattacaggcatgtgccaccatacccggctaattttatagtagagtagtagagacggggtttctccatgttgctgaggctggtctcgaacccccgacctcaggtgattcacccaccttggcctcccaaagtgctgggattacaggtgtaagccactgtgcccgggctacattacatttttactcagttaagagcaaacaataataggtgaatagcagcctgattctgtatgttaaaaatgattggtgattgaatctcaaatgtattagtccgttctcacactgctataaagaactacctgagactgggtaatttatgaagaagagaggtttaattgactcacagttccacaggctgtacaggaagcatggctgcgtggctgggaggcctcgggaatcatacagtcgtggtggaagtgtgaaggggaagcaagcacatcttaccatggtggagttggagagagagagagcaaagggggaagtgccacacactcttaaacaaccagatcttgtgagaagtcactcactatcatgagaacagcaaggaggatacgtacttgcatatatactccctgaatctaaaataaaagttgaaaaaaattttaaaaagaaaattgttgggaggctgaggtgagaggattgcttgagcccaggaactcgagaccagcctgggcaacatagaaagaccctgtctctaccaataatcaaaaaaattagctgggctttatggcgcacgcctgcagtctcagctacttgggaggctgacatgggaagatggactgagcctgggattctgaggctgcagtgagctacgatggcgtactgcactccagcctgggtgatagagtgagaccctgtctcaaaaaaaaaaaaaagaaaaaaggaaaattgtccaaggaatttaaaaattttcattttggctctctcatgcgcagtaaccgtgagggtttaaaggacagtgccagggccccatgttgttagagagcactctgttgtctttggcatgggagaggacttcagtgcaaaacggtgtatgaagtgtgttgtcagcagaagctaatttacaccctgtgctggacggagggttgcttgtttggagttgtttttcctgtggctaaaggattcctgggaatgctgttcaggcatgtctctgctggtggtatgctgtcatccttttcttttccatttacagtgtagagctgttacagttgtaaacaggcctggctttttacattgttactcactggtgtgggaacaatgtatgttaatgacataagtactgcccttgagagtactgcccaaaacagccccaggttgaaaatgtatcctcacagatttaatttttcttataaaagaaagaggtatgttccttctgtgtagagcgaactagaaatatattaaccctgcaactaacatgcagcacttcacaactcattagtgaggcccctgggatatggctccatatatttgcccacaagttggtataggccagaaaccagctgctttttcacctacgtggtgagagccagaggccagtcaaggaacaaggaactataggagaggaactacaaggagaatcttcagattttcaagcctattattgttcaatacatagtagtttaaaaaactttgacagttgtacttaaagtcccttctcatcctatgagtctctgcctctgccagtatgtgatgtttctggctcatggtgatgacaaattcggatgcaaaagtaaacaaataggcccccatcagcccatcggggcagcagccctaggcagtgacagttaaacagttgcaaagacctattttcagaggcatgtacccacacctgacctactattaagtaagcatggaaattagtatttctgttggctttaattaagtaaatattatagtttgatccacaacaccaaatctttgtcaatgtcctaaaagaaattgttcttttcaccacaagagttatgtattcagagtaaaaatgggtagatgtatattttctctgtgaaggaaaagaactggaaggtgcttattttattccaagagttcccaaagcgaggccgggtgtggtggctcacacctgtaatcccaacagtttgggaggccaaggcgggcagatcacgaggtcaggagttcaagaccagcctggccaacatggtgaaaccccatctctactaaaaatacaaaaattagctgggcttggtgtcaggtgcctataatccagctactcaggaggccgagacaggagaatcgtttaaacccgggagacggaggttgcagtgagccgagattgcgccattacatctcagcctgggtggcagggtgaaactctaaagaaaaaaaaaaagagttcccaaagtgagaccattactcaaaaatttgagatgggaggctaaattgcccctgctgtgtatttagagggttagtattgaataggtcaacaagcatttcctaagtctctaggctgaatttctaatacggtttcttagtaaccattctcttaaagaatgtgagatttgaggtaagctttgctttaagggagggacagatgtgaaccctaatactggttagaaggacataagagaagagagaaagtaaaactatttaaggaatttttttctctcatttaaggcccaaagcagcctttccttttctcggtccaatccgatgcttaaacttgcctgaatttcctctggggttaagttcaaactaattttcactgttctaagcatgcagggctcttgcacaacttcatgcctctgtgcgtgtgtttccaccagttggaatgccctttctcccacccacccctaaactcgtacatgcttatccttgcagagacctcctttgtaaaccaagaagcccccgactcccctgttacagaggtaattgctttggccttacctgttttacctcctggtaagttacagcacttagcaccttgcaattagaggtcatagatttccctgcttctctagaatgtgagattcttaaaggcagggattttatctcatttattagatttgtatcccatgtacctgacctagtatctagcacaacttagtagatatcaattaatgttcattgtatagtcctttgatgatgcggtttggccctgtgtccctacccaaatctcatatcaaattgtaatcctgatgggaggtaattgaatcatgggggcggacgttccctttgctattctcatgatagtgagtgagttctcacaagatctagttgtgtattttattatttatttattttttgagttggagtttcactctgtcacccaggctggaatgcaatggtgcaatctcagctcactgcaacctctgcctcctggttcaagtgattttcctgcctcatcagcctctcaagtagctgggattacaggcttgtgccaccacgcctggctaattttgtatttttagtagagacagggtttcaccacattggtcaggctggtctcaaactcctgacttcagatgatctgcccacctccgtctcccaaagtgctgggattactggtgtgagccagtgagcccagccaagatctcgttgtttaaaagtgtgtggcacttccccctttgctctctttctctctccaactccaccaaggtaagacgtgcttgcttccccttcacccttccaccatgactgtaagtttcccaaggcctcccagccatgcagccgtgcttcctgtacagcctgtggaactctgagtcaattaaacctctcttcttcatacattacccagtctcagatagttctttatagcagtgtgagaacagactaatacatttgagattcaatcacctatcatttttaacatacagaatcaggctgctattcacttattattgtttgctcttaactgagtaaaaatgtaacgtagatggtctgccttcagctgggagaagcggtcgtttagcatagatcctttttatcaagcagtagttacatttgcagagtactttttaaaagcaaaatatttgttcttattttcctggagtttacaacctatttgggctgacaagatgtatagagatgtgtgtgtatatatatatacacatatatgtgtataaacatgtatatgcacacacatttacacacatacatatatgtagtttcacttattctttcaacaaatgcatatggagtgctaaacacgtgcccggagctgtgctgggtgctggcacccgagatgcggactccacggtgcctaaccacaacacttcaatacccagggcgatgagagccagaaacaaaataagtaagataacttcttggtaagcaggaggaaggggaaaagattagaggagggtaaagaaagcaacctaagtaaaagttagaaggtacaaatgggcatggaatttgcaggagtggtgaggagattcatgagactaaaggctttagggagaaatttgggggccaataaaaagctatgagtacacacacacacgcacacacacacacacacacacacagtgaatgatactcagtttaacctaattcaacaagcacttcctgattcctgactgtatagaaagtactgtgcaacatattgagactcattcagagatgtttttctttctttcttttttatgtttttgagacggagtttcactcttgttgcccagactggagtgcaatggcgcgatctgggctcactgcgacctccgcctcgtgggttcgtgcgattctactgcctcggcctcctgaatagctgagattacaggcaagcgccaccatgcctggctaattttgtatttttaatagagacatggtttctccatgttggtcaggctggtctcaaactcctgacctcaggtgatccgcccaccttggcctcccaaagtgctgtgattacaggcgtgagccaccaagcctggcctcgttttttcctttgagatagagtttcactctcgttgcccaggctggagtacaatggtgcaatctcagctcactgcaacttctgcctggcaggttcaagtgattctcctgcctcagcctccagagtaactgggattacaggcatgcgccaccatgcccagctaatttttgtatttttagtagagacagggtttcaccatgttggtcaagctggtctcgaacttctgacctcaggtgatccatcagcatcagcttcccaatgtgctgggattacaggtgtgagccactgtgcctggcccagagattttgttttaagagaagatttagagtgtcaagtgctagcagttcagcgggaaaaacaaaacatatctcatatgtgtaatataagtactacatatcccagtaagcccatgaaaatataagaggaaaatataataatatatatgagaatataagggaaaatatattaatatatataagaatataaggggggccaggcacagtggctcatgcctgtaatcccagcaatttgggaggctgaggtgggcggatcacaaggtcaggagatcgagaccatcctggctaacatggtgaaaccctgtctctactaaaaatacaaaaaattagccaggcatggtgacgtgtacctgtagtcccagctactcaagaggctgaggcaggagaattgcttgaacccgggaggcagaggttgcagtgagccgagattgcaccactgcattccagcctgggcaacagagcgagactccatctcaaaaaaacaaaacaaaacaaaaaaacatatttgtgttgaaaattgagtagatacataagaggaagcacatccagagaagcttaacataaagcattgtattagtctgttttcacattgctgataaagacatacctgaagactgggcaatttacaaaagagatttattggacttacagttccacatgtctggagaggcctcacaatcatggcagaaggtgaaaggcacatctcacatggctgcactgttagagagcatgagagccgatggaaacgagtttcccctcatcaaaccatcagatctcatgagacttattcactactacaataacagtatggaggaaactgcccccatgattcaattatctcccaccggatccctcccacaacatgtgggaattatgggagtacagttcaagatgagatttgggtggggacacagccaaaccatatcaagtatataagcaggccagggattttaagcatttgcagtgggtggactaccatcttttgaaccaggagatgaaaaaatatcctcttatttatttaaacacagtgtcatttttatataccctatgtctaatacatccaatattggaagcatttgtgggtgagtttcttttgctgctgtttctcattcactttacagggaatggtctatgactagcctcttcacctcaggccagccttgggttttgtcttctgtctcttgttttcatgaggccatgaaaactgaagctcattctctagcttctgagaaattccctcagggtaaaacagctttaagtgctctgctttccactctgtgttcccacttttatttaaattttcccttataaatccttcttcttcttcttcttcttctttttttttttggagagacagggtctcaccctgttgcccaggctggagggcaatggttggaaagatatttctggaactcagaagagaggttaagactaaagacatgttttagttatccacctagagagaaacataaggccataagaaagaagaaatgctccagggaaagtcttagactgagaagagaggagggctaaagacagactctggaaaatgtctgtattcaagaaccagacgtggggctgggcactgtggctcatgcctgtaatcccaacactttggaaggccaaggtgggtggatcacttgaggtccagaagttctagaccagcctggtcaacatggtgaagccccatctctactaaaaatacaaaaattatccagacgtggtagcaggtgcctgtaatcctagcttcttgggagactgaggcatgagaactgcttgaacccaggaggtagaagttgcagtgagctgagattgtgccactgcactccagcctgggtgacagagagagactctgtctcaaaaaaaaaaagaaaaaaaaatcagacatggggcaaaatggagctgatgaacacagctaagaaggagtagtcagggaagtgttaatagaaggagggtggagagaacaatgtgggggcaaggagtggaggtcagcctctgaggaagacagggctcattctaaagattaacattctgaagatcttaagggggagcactaggaagaggaattagatttggtgtctcggtggctgctgaggactttctcaggcattttggtataatttgagaggaagaagcaagatcgtaagaggttgagaggaggacgggaaaagagagaagaacaggaaaagagcaagaatgggaaaagagcatatatagaccatgtttttaaaacatttggtgatgaatggaaagagaaagaatgattcttgatcaccaagccaggtcattgaaagatgttcttagcataagagaaatttgtaaggagcccattgacaagaggagatttgaggattgaaaattcaagataggctgagcatggtggctcatgcctgtaatcccagcactttgggaggccaaggctggtggatcacctgaggtcaggagttcgagaccagcctggccaacatggtgaaaccccgtctctactaaaactacaaaaaattagccaagcatggtggcaggcacctgtaatcccagctactcaggaggctgaagcaggagaaggtggtggtggttgcagtgagccgagatcgcaccattgcactccagcctgggcaacaagagcaaaactctgtctcaaaaaaaaaaaaaagaaggccgggcgtggtggctcacgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaagaaaaaaaaagaagaagaagaagaaaattcaggatagccaaagtatgatagttagatgtggaccctggaggagtctggaaggagtgggaccatgaccacaagttggggcttgggtagtatttcaagggaatggaaatacttcccctccaaagtcagaggttaaggacaaaaaaattgagtgctcacaggtaagctgacggagatctcctagatagaacagatgttgaaagacatgagatttggtgacttaaggagaatgggagagaacagcagcatttattacagtgaatcttccaaggaatcaactttgcacccaaaaaactaataagattgtggacaaccgaaagagttagaattgcctggattcgtggttcagccaacatgtaaagtgacatcccaaacatattcttcaggatccactctcagagcgtcttggtgtttttccagtactgccgtcatacctgtgttccctttccttttgttctctactagcacctggctgttttagagtggaattgtgtgtgtgtctgcttggaaggaaagattaatatcttgattctcttttgtcatgagtagataaggaagtgtatttttaatcagtaggtattcaaaaaatgtttactgctggccaggcatgatggcacatgcctgtaatgccagcactttgggaagccaagctgggaggatctcttgagtccaggagtatgagaccaacctggaaaatatagtgagacctcatctacaaaaattgtttaaaaaattagccgggcatagtggcatgtgcctgtagtccccgctactcaagagactgagacaggaggatcacttgagctcagcaagtagaggttgcagtgagccataatcgcaatcataccactgcataacagcctgagtgacagagcaagaccctgtctctctttctctctctctttctctctctctctctctctcacacacacacacacacacacacacacacacacatttattgaattgagagaaacaggaaattttggatattatggtggcttctgttcagcgttggatattaggggtgtcaaatggaagtataaaaaccatatcaaaatattgggtgaaggtgacagtcctaccctcgcctgtttcctgaaggtctgttgagtgagataagaaaggtggttgctatggagctgctttgggacttttgtttgacaatatagaaaaggccaaaagtataaagcaggacatcaaggaaaaaacgtatttccataaaagaagagaacatgaggtgagagtggttatgatgactgatgagaaacatattaataaatggctttataaaactctccttattctcttagattggcaagacaaagactagacttttgtgttagggaaactaaccacaaattgtggcctggagccaattaggattgttcccaacccccttgtccaagcttggcctccttagaaatacggcagtacagacgattagtaaggggtatctaagaatctctgctttctgtttattgcttcatgaaggtggttagcttaatttggtttgtcggggcactgtatacacagaaacatctcccttgggcctcttatgggtaattacagaatctgtcaaatagggctgatctgcctggagagacaaggagcacagcatctatggaacagggagttgggcagaaagtttagcaaagaagcctccaggatggcaatctgagtcatggccagatgtcaggcgagaatgcgtttccagcacatcgctgtgatgatttaagttacacactctctcctgcttgctagtttgcaaagattttccatctcaggagatatttctgcagctcttcctaagagtgaagacattctgagcatgttacattcacaatcaggcctccttgataagtattgagattcagagtcaaagttgggaaagcagccttcaattgtactcattcatgtgaagttttataatgaagagtgtatgtgtgtctctttttgcacttaaacaaaggtagggaagttgatggcaactattttccttctttccccatcaaaacctggagtataaatgtgggcgtggaaattagagggaagcctaaaatttgtactggtccccagcccccgtgtagattcatcagcgagatcccaggctgtttgaaagaatgctgggcctggagctgagggacctccccagaggcaaattgatggttggaatgctgctgcagaagggctcagtgtccctgtggttctttaagtctggaatttttctttcttttgaaaaacgtacttttggggggggcggaaatgaatttgaatctattttctaccacatgtttaatgaccgaggtgatgtattttttcctcaaattattataactcccagtaaaaattcaagcctgtagaaggtaaggaggagattatatgatgaaagtattattgattttagtggaatcatggaatttaacatatcttctttacttccaagttagtgcttttcactctacatcatgcccaacactttcctaggtaaacaagggctataaaagaagggcttttaatgtatctcttcccctgctttggagcaaggcagttacagaacaacaacaacaacaacaaaaataacattatctgattgattggttgattggttggttgattttagagataaggtcttgctctgtcacccaggctggagtgcagtggtgtgatcgtggctcactgcagcctcaaactcctggactcaagcaatccccccacctcagcctcctcagtagctaggactgccggcacatgccaccacacccagctaatttttaaaaaatgttttagagttgggggtctcactgtgttgcccagactggtcttaaactcctggcctcaagtgaccctcctgcctcagcctcaccagtagctgggattacagatgtgagctgctgtatgattctgtctcgcataattggatatattttaaatggtaaacttgatctgtataatatttggacctccctcaaaaaacaaatcattcatgaagctttggaaaggctattataaccaaataatgtgtgcataaggaaccttctccccacatctctgagccccttttcattatggaacctcacagcatccctcaggatatccctgagcccaggggaagatgagagtgggaggaatttcagtgatgggaaatagaatcaagttaaagtaaactctgaattcgatagagacagtgtgggatgaagcaacaacaaaaaaatgtattaagacgctatcaataatacattttgccagcatttttgagacgttccaaaccagtctcagaaagtttgagactgatcccaagaaaacaatgagaaaggttgagtctaagcctaaaattttggctgaatttggaaattatcagtgtgaaggctacacaccaaaaatataagaaccaactgtcctgaaagtttgggagttaagatttggggaaattatttgaaatcatttcaatctaccaattcctgatttttttgcactaagaattgaaattctgaatcccttaatttatgtatcaaatatatctaccagcagtgcagggacaatgagggtggaaatgcattaactaatagattatatggactgccttaagcaactgtataatttctgttaggatgaaaccgaaccatgttgggaattctgatttaaaatgaggtctgtactttatagatgtggaaaataaggttcataggacgaaattacttcctcaaaagcgacataactgcgttgcagcaaaaacggcaggagagtgcaggtctctaagccaagtcttggactaggttcttgattccaacagttctccagtgatgcttctgaagacactgggctgaaagtgaacagtgaccctctttcccgaatgtctataattttctcaatttaaaatttttctcctaaaagacaatggctattttaatcttttctgtttgtttgtttgttttgagacacagtctcgctctgtcacccaggctgtagtgcagtgacgcgacctcggctcactgcaacctccacctcctgggttcaagcaattctcctgcctcagcctcccaagtagctgggattacagttgtgtaccaccatgccttgctaatttttgtatttttagtagagacggggtttcaccatgttggccaggctggtcttgaactcctgacctcaaatgatccacctgcctcggcctcccaaagcgctgggattataggcatgagccattgtgcccggcgaatattttaatcttttagtgacctctgccatttttcttttcaagaacaagatgaatgagcaaatgtaaacattttaaaattaacttggaagggctttgacagatttcatttctcatggacatatgcttgtgactgtttcaatattgcaggcatacactagcatcattttcttttagcagaattgcttggtgctcctgtaatagaatgaagtgtaatagtgtgcaaacattcacaacttccatgtgctctaaaacctaaacaagtttgaacccacaagtcactttgtaaggcacatccaggctcgttgagattctaactggtggaaatagttgaaagtatatttgtcacttacaccttgcctatatccaagaaggatttgagtcttcctccaacaagaatgcatccaagccagtctaaaactgtcctccataaaatagggaaatacactttgggaatttcataagctaaacactatttccacattggtcaccatggtgaacacaaatatgcaaaatcgactgaatggtaacaaggcagggagagaacgtgcttcctataggatttgatctgctgcttattctgatcaaagtggaaactataaaggttggttggagcggatagcccaatgcctgcccagtaacagggctgcaggaattaacacggtggacgagggaaggtacagaccattttcggtggctaaatgagaaataatactaagcgataggatatcctgtatgtttagattacttgcctctgaaaacgagctccaattctttttcagaacaagtattgggaacaaactgtggatatttaatcacttaagggtactttcttctgggaaaatcgctcactcttaatttttcagttgagttagacaagggctaattgcaagaggattaaaaccttgaaaactgctttgttcagcttattgtttcaggtttccctttggagtgtggatgatgtgtttatttgacataatgaataccaccatccgctttgttccgggaaccaaaaggctatgtgcttgcccaaggaatttctcagttgtttatatgtaaggaaacactgctctgtgttattggatgggaccattacagctctttcttaaatagggaatgcagagagccgtgctttcctcactcacatctgagcagagaaaccagaaaatagccttcagcactccaaatgcctgcttgttttcaacacaagagagcaaagggaacatttattgaaaatgtgtgttcttcgcttaggaacccagagctttactttgtgttattggcacatctacttagacctatgttatatgtgtatgtgtgtatatatatatatatatatatatattttttttaagtattagattggagtgcttggcatgaatcatagattagagaacattgacaactaaccagatagtgaactctgcctctatcagccaaatctaactgccaaaacactgaggaataaagtaaccactaattaagcagcctggagttttgtttttgggttttttttggtggtggttgtttttaatacataccctgccataggatgagggcaattgtgtgaaatacatgctttgcggtgacttccagtgatgcaacatagcagtctttttaaacagctgaaaactctctggtcctttatggtttccaaaaggtactccttaaatgggcataactgatgggggattggctagtgagctacagagaaggctgagtcagagtgacctgttggagctagccccgtgtgtgtgtgtgtgtgtgtgtgtgtgtgtgtgtgtgtgtgtgtgtgtgtgtgtgtagaaaagggggagccgtgggcaaggggcgggggtgaagggaggctgcaagcttggcagaatgtttgaacaagacaaagagcagttccagcgaccaaataaggaagtgagtgctgaagtatttcagaatagaagtgtgtcagggactcaaggcaattgcggagagtaaaaataggcaaagaagaaagggcaaaggatttttgttttacttgttccacaaaataaacagggaaagaagtatctctggtctttcagctggagtgagaaaaacagatcgtatctatccctttctgttggctttttatagacatgtgtctgaagagatgtttagaagctctttcagtggcaatggcaataataagcatgcttttgttaaagacagaaaaacgcaagttgtgcattagacgcaccatcacattccctttatgtgtaatgcatgaaacttttagcccaagatgatggaagtttccaagaaccaacagaaatatctggaaacccattttcagacatgtcctgaacactgaattataactgtatcctttgagaaaaatcttacctcttaacaagccagttaaatgtccattagatacagtgtctaacttaaatatgttgatagttactgaaaaagatgtcaaaagaggcaaattacgcaaagaaactgtcagtacttgttttaatcttctcaataccatctccccaactctccagagtggccaataatatgtcactgatcctatggataaatgctgctcttattttgatactttttttgcagtacgggtggaagagaacaaagatttggaaggagaatttcagatactcctaaacataatttgaaacaacctttttttgtcctacaaaaccaacattgagaaattatttctattaaccaagaaatcaatttacttatgtctgcaactaggaataaatagaagacattcatcctgggtaagacttttgaaagccctcaataactaaattgttggcaactctaggattggcaattgaacaaatctatccttctgttctcatgcaaaatacaaaattggacagcccacacttgaatcagaaactaccagaacctgcccagaagagtttgggtagagagctaaactggagtgcaaaatagggaacacacaaagattgaccacggcatgtagatgatcttacaatgtagtgtattctggctccaaaaataacctgccccccacttaaactgaaatataaactctattgaataagctaccttgatcatgcttcaagaaaatgttaggcttatgacaaaatgtttattatcacaaacaaagaaaaaattaaaatgagacacagtgttatgcccacgaatagtcattttaatgaccaagctccatcctaccaatgcttcactagttgacttttttttttttaagcaatttaacaatagatgtcaagagcagggaaaaaaggctgggtgtgctggctcacgcctgtaatcccagcactttgggaggctgaggcaggaggatcacttgagcccaggagttggagaccaggctgggcaatataatgggactccatctctacaaaaaaatatttcgaaaaagccagacgtggcggtgcacacctgtagtcttatctgcttgagaggatggcttgggcccaggaggtcaagactgtgtgagccatgattataccatgtactccagcctggacaacagagtgagaccctgtctcaaataaataaataaatagtggtaaaaagagtatttgacttcaaaatcatacttctcagtatttgccctgaggaagtaactcaaaatgggaaaagaaatgtataagcctgaagatgtttagtatagcatattttttataatttcaaaacaaaaaatttagaagtcaaatacacagaatattctcttatctcaacaatgcaatattatgcagcaattaaaactggtaatgattaagcctatgaaggcaaaaaatgtttatgataaatgatacaataatgacgaaaagttaccttgtaaaattacacactatctgtatagctatgttttgaggactagaaaagaacatggtgaaatagtgctagtgtgttatacatacatagaggtagattttttgtcatctttattttgtgtttttcaataataaatgcctttcaaaaaaagatgatgatgaacaagcttacaggcaagaggcaggattccagagtcagaaagaactgaggcttcagagtttacctatccagcaaatataagtcacaaagttttgtgtagctagttagtgatgttgtaatagactttgccatttacagaactgttttacttactgatttgacttgtcaattatttaaaaatagcaaagctagcaaaaatagcaaaatgtcaattatttaaaaatagcaagtgtaattcttttgtgagaaaaacaatcacccacaaaaatgtaactgcagaggctccgagaccatttgtgtgtgtgtgtgtgtgtgtgtgtgtgtgtgtgtgattcctccggtatagctgtgaataatgtgaggtaaccagagactggcagagtcagcccaggattaaacaccgtcatcagcagcaccccagtttaaagagaagattcagagcacctgcatcaggatctccttctaaagccctgaatggcaattgggagccaatcctgacattgagatcacataataaactgttctcacaaagagcagttcatttaatctttccatgcttttgttttggtgaccccgctactgctgggagtaattataaagaactccaaatgattagaaagcattttgcataaatcagcttgtttgaattattgcatttccagggaaaattaattgcgacttagaacaatgcagaaattatttacacacccaggtgtcaaaaagcagaggagaagcaaagaagtaaatatatatttatagaatttcctgtgatggcttataataactattgagtaatcatagaatgttaaatgtaatctcatccaaccctctatagtggagatttgaaaatggagacacaggactcgaagtgaatcgtgcagggtctcataaagagttaatgccagagccaactcctttgttgaaaatagtagttaaatccttaatggctgttctctagagctctacttgctgcctttgccttcttgcccctctcctgtggcgaacttaaacagtacttccatcagtcttacttcgaaagacttaagagtttgaaggagctctagacaatttatagtcttgtcttaggcaaggtgattctgcttcatctagttacttatttagaatgttaactccttagtggcagaagtcatgtttctcagtaataactaaacttattggcagcaatgccatgtgcgccgtgccaaatgctttccaaagtctcgttgaatccttgcagcaattaatcaggtgtgcagtgctattattctcattttactagaggaggaaactgaggcacagagaggttaaataacttccccaaagccttacacctagcaatggaatattacgcagcaattaaaactagtaacaattaagcctatgaaggcaagaatgtttatgataaatgataaaataatagttaccttgtgaaactgcaagctatttgtatagctatgctttgaggactagaaaagaacatggagaaatagtgccagttatgcgtatggatacatatgcatcacaagtgcgtatgttgagatttagacaaagtatcagccttgggatttacacccaaagcatgagctcttaagcatgaacttgcattacttcagtaggtgttcagtgaaagtttttgaaaatacacctaaagtatcccaagcagatgacaattctcttgactatgaccaaaggtatgaggaagaacttctactttgagtaaataaaatgatgggcttccagaagccaggtatccaggtgataatttttctatttgaatatgagaatgatagttacacagataactccaaaaattacctgcatcagtgaaaatttggaggacagacatatataaattttgcaatgttgtatgtcataccagtgaaggaatctaatgatactattatttattaagtgaggatcgcaataagagttattgagtaatcaatgtctctgtatttctttgggttatgattcctgtcacatcagtatggaaaaagatttagcaagtcgcatgctttgcttgtccacaacatccaagctccaaatgtcgcagacataaagatatgcccagagtaatctactctgtaactcacagtgagggtatttagttgaatctccatataaaggaatgatttgaaggaattatctttacctaatccatcctcctccccaaagtagtggaaaatagactcaattatttcacctgaagttaaatttgcatgtgtgaaagtgtatgtttatgaaacaaatagtgctaagcatgacattagaaatggaaatcctaagtcctctgcaaaacattatctgatgagttgattacgtatttgttctctacttatttcatcttaccttaaaaccatgggatactaaggtattttttttttcatcattcatcccctttggtaaaatatcaagtatatgtatgtgtgtgtatgcagatatgggtatatatatgtatgtacaaatatatacatgtttaatgtattattacacatacagatatacacaaagagagaaaaatttgaagaattagatgaatatacgtataaagagaagttttaggccaggtgcagtagctcacggctgtaatcctagcactttgggaggccaaggctggtggatcacctgaggtcaggagttcgagaccagcctggccaaaatggtgaaacctcgtctctactaaaaaaaaatacaaaaactagccgggcatggtggcgcgtgcctgtattcccagctactcagaaggctgaggcaggagaatcacttgaactcgagaggtggaggttgcagtgagccgacatcgtgccatcacactccagcctgggcaacagagcaaaacgctgtctcaaaaaaaaaaaaaaaaaaaaaagttttagtattttttttctcatctctcaatagactgttgttgaagcccactgctctgtataataccccaacacccatttgaagagttgctgaaagttctgtgccaggccatggtgggctggcctgaggcctgatcccagaaccctccagctgaaaggaatgttagagctcagccatccagcccctccgcagaacacatggggaaactaagagagtatgagaattttgtctcaagacctcatttccaagaggactcaggacctgatgaggtctttgttatatttaaagtctaaatagctgtgtgataataatgaacctagcttaggaattgttttacatactagagcttttgtttggttttagatttttttctttttggggagggggtggggtggggaggggaggcaggtagcaaagtactcttcaccacaaagaagttgaaattgaaaaggaaatctgtaggcacttaaatgaaaagcagggcattttgctgatgaggtcaaatgatactgatcaatgggaagctctgggagaggtggctgtgtaaaggagagactgggtgacccagggaagtgtccggagctgaatgagaagttggaatcacatattcctatgttgcagccttcaacctgatactaactcattcttcagacacggagtccaacttccaagtgcttcagggatttttgttaagccttttaagggtatccaaatgaattaactattgtgtttcaccaacgctctagtaattcactttcagtgggcggttttattttcccagatgtgcagattgttcaccatggagctatgagtaattaactcataaaagaaatgtccagatgaatgaacaactgcaaagcacctgttgtcaacagctgatttttgtctccgcgctttgattatgaagagcttgagaatactggaggttgttttcttcttctaaaaccttgtgacacctgctgatttaggttcacatagaatacaatggtaaatagagaataggtggtagagcttgtctttatatctaatgaaagaaaagtgtcaaagtttcagatgaatgtcagatacccaaggatagggctgcattatgactttcatgggccttaggcacttttgcctttgtgggtccgtttctccattaaaaaaaatagaattatattttatagttgtattggtataacgatgaatgtaacccaggctggattcattattatatggtcatcattgttatatttatttatgttcactttttccttctgggtttattaaaattaaaattttttcttgggttgcccaaagtgtcagccctgcccactgaacctaatgaataaattggccctgcctaagattatggacaaagagacttcacggaaccatagctggccccatcgatttttactgtcactgtaacagagaacactgctaggcccatttcttctatttttcctgatgttgtctctgaacaatgagcagctcaagaatcagaaatccctttctcggcaaggtagttcacgcctagagtcccagcactttaagaggccaaggcaggtggatggatcacttgagctcaagagtttgagaccagactgggcaacgtggtgagaccctgtctctacaaaaaatagaaaaaaattagccacggggtggtgcacgcttgcagtcccagctactcgggaggctgaggtgggaggatggcttgatcccagaagatggagactgcaataagctgagatcataccacggcactccatcctgggcaacagagcaggacccatttcaaaaaaaaagaaatccctttctccttatgtaacactacttggcctagaaaagccagtatttgtgtccactgtgctctgccagggctgcttatgtaggggccttcgttcataatatgacaacgaagcaggtgactgaatcaaaaattaattcctccatgatgctaaaagactgtgtctgtgttctccaaaatggagtcagtttgtgaagagaatttttgtcagaccagtttattcattgctacacaaagctttcttaagtgacatgcagtgggcaaacaagggaacaatgacaccaaagttatgtcaagcttgtacttgtaccacccacaaatgaagatggaataataatgttgccacctataagctaatgaacaaaatgcaacaatgggcccaaacatgcatatacccattgccaataaattaatctctaatgagacttttgctaaaattgaggtaatgatttacagaaggcctggcttttaaagaggcctgaatttagtctttatttatggttgccgtattttcttttcacttgcattgaaaactttactttcaaaatcttactttgtcaactttgtccagaaatacatttttttatttttttatttttttaccaatcctcttaagtgaatactttttaaatgatattctaaactcttatttctctcagtgcagtcttctctctgaactcttttcatgagccatatcttattaaaatccattatatattgtaaaagaaatagccattggaaaatattcataggccaccagttcctttgaacatagcagattgaaccaaagtttaatttgaaacatcttttgataaatcttataaattgaccaaattttctcaaaatcattgaactttttctaaagttactaaaaacagacaaatatcatatactaatacaagaataatgatcttacttctttggagcaatggaattattttttacatttacgactatggaaatcttgggtaaaaaaaaaatcttaattttttttccttgaaatctagtacttcattgtatcagcagtgacctagtataactcacttaaggggcctgtaacaggcaatatcaatattattgtcaattgttttaactgtcaattatataaactatatatcagataaattcttttttttttttttttttttttgagacaagttatcactctgacacccaggctggagtgcagtggcacgatcttggctcactgcaacctccacctcccaggctcaagcgattctcccacctcagcctcccaagtagctgggactacagacgcacaccaccacacctggcttctattttttgtagagatggagttttgccatgttgcccaggctggtctccaactcctgggctcaagtgatcctcccaccttggcctcccaaagtgctgggattataggcgtgagccactgtgcctggccaaattcatttctttaattgccaatgttaccaaatattctctcctatggagcttatggtctatattcagagaattttctaattttaaatacatttattacatttttatatttaaagaaagtttaattggaatatttgacttctccttattctctctcttctctctctcttctcattccatttccatattggagtctaggtttgtacattttattttgttaaagatatatactgcaaaataatctcaatgattctcttagtagttggatatctttgttagaaaacctttaacttcagcactgaagcaaatcattatgtatttgcctaatgagaaaaataaagtacttcagataacataatcccgtttatttgacgcagaagattcgtgtattgatccagaagaatggatattcaagtttaagatgtgaagtgctgggtagaaggaggtttcagagatgacaggttaatcagagttagggaaatagacccaattccctccttcttgtgatagtcccctatgtatagcctgtcggagtccatggtttcctttgaattgacttcattcttctgaaaacggcgctgcaacaccctaagcagctccattgctgagagagttttacttcctgtatttctgcgagcaacaatggaatcatggctgatctgggtgttttctaagcaccctggaaatctacatgaaatgcgacacaagattccttgttatggtgtcaccagaggtaatattaatagtattaaaagaacaagctgaggactttatgcatgatcttacccatgacttcatgaattgccactgggattaacgtaaaatctgtaatcctcgcctaaataggccatctttgtctattatccatcactatatatataagatacaacttaaggtttttcttatgtaggataagttcaaatatttagtccactgataacggtatttcaccacttattcaggagaatcacataaacaggcaaattctcactatgcctctttagtaatccacatggaatctgtggatgattccttcagagccagcataactcatttgatttggaaaagggtgctcaatagtgagtcagattctactgtggatcaagcaggacatgtttagaagctgccttaactatttcagatcaagcagacctgactatgcgcaataaaacttggcaataatcaattgctccattggtaaaatggagatcttagggacggtgaatggatggtgaatgcactttccataaatatgtattttttactccaaacatatatattccttggagcttggactctggagttaaggatttacatctccgctcctccccttaccagctccgtgcccttgggtaagttacctaacctctctgtgctcactgtccctgggatgatagttatagtgatacttcttcatggtttctatagtcagataaacaggagaatgcatgtgacatgattggcataatgccagcccaaagtaaagttcagattattttttttactctgttttttaattatctgaaactaaatactgtgttttgcaaaaacaaaattaaaaggcaaaaacaaacaaacaaaaaccagctccccacctgctacataccaaacagtatgttaggtactgcaatggcagcatcgcactgtgtcttttcaacagcagtccagggtaaataccttaacctccacttcacaaatgagaaaacaaaacctttgtgatttcaaggtcatggaaacagtggaactgaccccactctgtccagctccaaaggccatgctcttttcaggacatgccttcactagatgatctcttcagccccctcccgactctgattttgagtcctctggaattgtctcggatgttcaaggcttacctcactctcataagctcagcctgttttttgtttatcgtagcgtggcctttctttacattccaactgcagacctggttgtcattctccctgtgacatagcatttgatgtccactgggttctagttatgtctatataagtacaaacagtcccatttcttttttcccgatccattctcccttatcttaataaaaagttgtgaacaaaccaaagagccataaagttatctttaccaataggatagatgaatttgttttcatgttcaaagtatgagttgtcctcggaggggtgccctttccctcctcccctactagtctgtcttcatgatcagataatgcatgaggctgagcctctttagaatacccacattttggttttttaaagtttctcacttttgttaaaataattactagttgttgatatggagacaaatgtgttttgtataaaatgttacacttaattacagagtccaaattcaaaatagtccaagattgttaaaagttgcttattcttaaaaatgaatggactaaaagctgatcttaagcattctactctcagaaacattttcccaaacataacattactatgaagcaatatcaggtaaaatctataattaatctgttatttccttagtcttgttcttgtttgataaatgtagttgggagcccttgcaaaggtagcaagtacaatagaagaaacaggccattcaggcaagattctgtgactctaaaaaatatagtaagagctaaatcaagtttttaaaaataacatcaaaggccaggcgcggtggctcatgcctgtaatcccagcactttgggaggccgaagaggcagatcacaagatcagaagttcgagaccagtctggcccacatagtgaaaccctgtctctatttaaaatacaaaaaattagctgggtgtgatggtgcacgcctgtaatcccaggtactcgggaggctgaggcaggagaatcgcgtgaacccgggaggcggaggttgcagtgagccgagatcacgccattgcactccagcccgggtaacactgcaggactccgtctcaaaacaacaacaacaaacatcaaaacaccagaagtgaatggaacaagatcctgatgctgacctgattatcagaacatctgttatagacaacattgatcactctgaggaaatacatagcaaaagcctccttgtagaaaatgtgccaatccagaagccaggaatcttctaggaaaatctcaagttttggtaattttcattaaaatattaagcaaaatgccggaagatatattaatattcctttgctgctacatggaaataaaataaatgaaaatatagattttgggctttaattcttaagttagaaaagcgtgattgaacaatgtcgatttgtggtagcagtaaaaagacatttacttggtttgctaatcatatctactttataaaatattatcatgttacctatgctgagcattttgagctagatagtgtgcaatacccgtcagtagttagatagatcaatcagtcgattgataaatagatagatctgtgatttggtttcactgccaatatcttctttctttagtgaatactgttggtttttagtgtctttcgttttagtgttttagtttttaaccacctatgtttcactattttcattgtgagaaaaatatgaaaaggaatgatttgaaggttactttcaccctttccacttttctccccaaatacttggcgaattgagcccaatgtttcatctcaaagtaaatttgcatgtttgaagccttaggcctctgagccaaagcctgtgaaggtaaagccagagatgcacggcctaaagcagagactctggcagatacagccagcgaagctggagggagttccttgagtgtcactcctgacgaaataaaagttcattgtgtatttattctctgcccctttcatcttatctcaaatccacagagcgctaagttttagtcaaggaagaatgaaataaaagtaatagaaggagaagacttgatcagaatcttcagtgttcagaggaggatggaatattctttttcaaacttggcagaaattctcatcagtgcttctactgatactagttttagcaattctgaggcttgttcaaagtgatggccaagatgtatccacacctcccacggttcgtgtgtaaaaccttcaaagttgcaaacattggaatattcagtgttttgcatcagtgccttaaatcttcatggatttcggcactgaaaagtgaaaactggtccacgtgtacgcatctttccgggcacctgtagttggaataaggcagacacacagagatgacagatctaatggatcatccttcttttgctgtctcctcagagtaaaggaagtgcgtatgtcttctcacagccaatcaactctccaagtctattctaccccacagtcccttccatggccggtaaacactacaggtggtaatatcagacatctgttttattctttctgctctttatgttgtgaaaggactcctaaatcataaaatcataaaatttaagaagcgtaacttaaaaatccatcagattaatcccattattgtggaaataaggaagcttcagagtcccacagttaatggcacagatcacacgtcctaactctcatctggtggcactctttagtcagtgtcccatcacagcctgcaagaaaaccctgctgcaggccacgtgatgtcattgctgcagccctaagggccctttgacatgggcgtaaacaagctgagaattcaaagaaaggtgaagctaaacagggaaatactgttagaaatattagaataggcaaagtgattttcactctttaaagtttgtgttccaggacaatgaattgttggtctatcaccctctcaaaaatgcaagagatgataatgctttgtattatccccagaaagatgactatggtcagtatattattaggttaaaaaaaataggttacaggccaggtgcagtgggtcatgcctataatcccagcactttgggaggccaaggcaggcggatcacttgaggtcaggagttcaagagcagcttggccaacatggtgaaaccccatctctacaaaaactacaaaaattagctgggtgtggtggcaggcgcctgttatcccagctacttgggaggctgaggcaggagaatcgcttgaacccaggaggtggaggttgcagtgagccgagatcacgccactgcactccagcttgggtgacagagtgagactttgtctcaaaaaaaaaaaaaaaaaaaaaagttataggctgagtgcggtggtcacgcctgggaggccgaggtgggaggatcacttgagatcaggagtttgagaccagcctggacaacatagcgagacgttgtcttgaacaaaaaaaaatgttttaaattagctgggtatgatggcacgtgcctgtagccctagttactcaggaggctgaggtgggaggatcacttgagcctgggaggtcaaaactgcagtaagccatgactgcaccactgcacttcagcctgggcaacagagtgagaccctgtctcaaaaaaaaaaaagttacaaaattgtatggaaacaattatctaagctattttaagtgtgtgtttaaatacacatccaaaagcctggaggactatattttaggcagctaacaatttatctctgggagtaaaatcacagggacattcaattttggtttattgtttaaagaacaatatttggtttttaatattttacagacatcgttattcatttaaaagtcaataaagatatttccgagagaggaatagactacctggctgaagacagtgaacctagcaatgctagtgttagatatcagtaatgacggcaggatacagttacagtactaaaccctttaaacaagtggtctactggctattcaaaactagttagcatttattggcagttactgagtgaccacgttaccgaaacagcctggcacaacagtaagttcagtaaatggtagatattaccattcattcattcattcattcatgcattcattttgttaacagcttattgtgtgtgaaagatttggtcccagtggccaaggagcacactctggaaggagaaagaagacagaaattgttgtgacatggtgtgccaacccagctactggaggattatacacagagccaggggtgtccttagctgatctggtgaaagaaaagttggtgatctggatttagggctaagcccacaatctgtcacaaattttgcatagaatattaattctggaacgaatgagtccagttcctctttgaaaacacttctacagaagttcctgtgtagatgagcgttaaaataagtgactcagggcctccagtagtttatgagctaagaggatcacaggataggatagggaccgggttcctcagatgttgctagatcaaatgctttactcttctcaccctaagggctcctgaatttagctttttattacacagaacccagtaaactaattaatggaaatctaaaaattatccttcctcttcttagaaaagaaatatactgcatgatgatttgtgcttttcgatttaatgtcacacaatcgtttttacactgtatgtgctttccctccccacagccccagtcccagccccagtctcgcagttccattccttcagggcagcttccattctaccgtgagtttttattgctttcccctaaaacgctgccctggagtcgcgtttattggacactctttagtctgtaaaggaaaaaaacacaaacaccggaggagaatcatcctaacaagccgacaacatatctatgggcctaaaaaacttaaattctttcccgttattagcacttctcgatcgttccaggaaagcccgatttgtagcttggctgccccaggaaggggcctgcgaccagaaagatgcaaagggcgggacaaggttacgagtgggtgcggggaagcctccctaacctgggggccgcgtcccagagctgcgagccacgcctcctctctcccgcccgccgcgccgccggactcttattttgaagggcggcgggtgaaggctcggagcctcctgagtcacccggcgggcgaggtataaagcccgatacctgccccgcgcccggtccgcggagcccgctgcagctcccgctcgctccggacgcggaatcgggcagcagcgggaggcggcccggagagccgaggtaggcgcggggaatcggccctgaggctggtggaagaaatgtgtgaattaaagggagtgcagcgtgcagggtgggccgcgagtcgggagtgcagggctcgggacagggtgggggcggggaggacaagagactcgtcagcgcactttccacccggccggttccttcccgagccctctccctcccccggcccgcgggagcacagatccctgaaagcggagctccagataggaatgtctgcatcatcttggcagggcccagacgggagaagatgctctgctgccacggacgatccctcccgctctcctaactcttctctgaacacctcgcacccccacggccccccgcccctctcttaatcttggccacgctccctgaggggtcagacctggggtgggagagcagagaaagcggggctggcagagacaggggtgagggccgggagaggcgatgacatcattccctggcagctggcggggagagggtggggacggaggggtccccccgacctgagccgagccctcccttcccaagcccatcctcctttctttgggatggttcaccccacctgggcgccattcaaaggaagtttgcgcgtaactcggggcgtcctttccccggccgggtgctgtgcccggcccgcagtcggtgtttcttctgggcctgggggcggcgtggagccggcggctcagtcccctcagtcccaggccttggcagccgctttgttcacgccgggcgcgggccgaacccgaacctcagctgcagcactggcagcgcgcaccggccacgcgtgggttcccggccacggccgggccaacaagggagggtcccgtgagcagccaggctggccctccccgggcctgggtgagctcccaaagctggagcgcagggctctaggccggccccgccccggggctgggggcttcccgcccgtttgtctcattttaacttttgggggcagctctgtcccgaatggtgagtggtccagactctagaaaggggtttggtcgcttgagcccggattgaggcttgggacctttgctctcttgctggggacggaagggggcgcgctgggcaggagagggggcgtctcggtcgggtctccctgggctcgggcatcttcccaccctgcggagccgggtcttgcgctgcgtgccccgaacaggcccgggcacaccgagtcccgttactggtcttcaggcgaaattccaggacgggtgtgcattcatcaacctgggagtctctaggagccagagatgactggctctacattttaatgcgtaatcacagagaaactagcacgagaaaaggacagagggaccgacccaagcttcagagacatggaataatatgatcctggttcataagccttgaaaagctcccctccgccaggttaaggaatggtgtcaccagccttggctgtgaggataatttcttgatttgtgttatgcaggctcctgtcaggactgtctccttaactcccactacctaaggaaaagatagccagagaattgtccagggatttgggtttgggttgcttctagaaagacagcatctttcttgctattttttttttcacatccccccaaaacaatttttttcccccttcagacttggcagactttgatttagataagaggtttgagttaatttgattttccccatgtctgtttagatcaatggatataggagatagtttgaagctaatgtacccctatgcctttgtgtgagtgtaagatttataacttgagggaggcagttaataaatagcacatccttgaaccataaacatacgagatagacaagagctagataataaacagtttttcccccaatccctaagctttacttattttttttactgattcttgtactttgtcattagaaaaaggagtggggttggtttcccagtgaccgcattcattaagaaactgggcatgtacagcaagtagcaaaatatgccaacatccacaccatctctggctatgtgaaaacttggtgccctgtgtgaggagcatgggggatggttggaaataatgcagctttatttttattgtgattgttggaattcatgaatcataaaattctgatagctgggatggtgtggtagctcacctgctttaaataatgtaataacgacaggcccagtctgtcccaggtgaggaccactgacttagtaaacaataaacaggtgtcctactcatagtagccttagtgttgcttcagtagatccttatgagctctagatagtttttagttgacttttaatatttttaaaggtaacaataggccgggcatagagactcacacctgtaatcctagcactttgggaggccgaggcgggcagatcacgaggtcaggagttcgagaccagcctgaccaacgtggtgaaacccggtctctactaaaaatacaaaaattagccaggtgtggtggtgtgtgcctataaccccagctactcaggaggctgaggcaggagaatcacttgaacccagcaggtggaagttgcagtgagccaagattacaccactgcactccagcctgggtgtcagagcgagactccatctaaaaataaaaaaaaaattaaatgtcaccaccttgcattgtacttgatcttcagaattttactctattgtcttaagcctttaaaactttgctcatgaactatattatttggactacctttgagggtagttgcatttttgcatttttgcaaaatattattttccctaggttacagtaaacctttgactctgttatatttgaagcaactaattattcctgaaacatataaagcatttcctggcaatgttggtggagttcatactgctcaaggtgctgaagtcattatttcaaggggaaattattagcgtgttccaacagttcttaattgtccaaacaattgttgatttcccccctttccagatttctttcacaatcattgggaactataaaaaggtgtattcgacattttcttttgtgtatattttccacttcaacaattttgtatcaaaacgtatggcactttttcagcacttatttcaagagatccggataaactctgagtaatcacaattcactatacttcaaaaattgcctcccattcagtattttacaaataatcttctacaagtaaatggggaaaatagacactaaccatatactttttaaaaataatacattaaaagagcactaaagcgttctttgaaagtgctcctggtactatatacgtattggctcattctagcaatgttcttttgagacaccatacaagaaatggaactcgaccagatttgagaaaaagctgcagagaaggtgaggatttgttccagggccatacagagaggaaattgagacactcatttcttcttagttcagtctcccaggtgtttagccctagatctctttgagattgcacgaatttaagggattttttttaaaaaacagggaagctctgttatcaaattttaagagaggataaagaattagagatggtagatgagaaatgtttcatccaaagagttttttgtttgttttgttgtttttttgagacatagtctcgctctgtcacccaggctggagtgcagtggcatgatctgggctcactgcagcctctgcctcccaggttcaagcgattctcgtgcctcagcctcctgagtagcttggattataggcgtgagccactgtgcctggctcaaagagttttaatgaatagaaaacagtgacccattcttgtagaaaagacatggagataaaatgaaataaggagagcctgaggtgtcagggaaggagaaagagcattttgaaactggtggcaggtacaattctctgcctaactccgtggactacttagggcacagatttcttcctgctcagtcagtgttagctgccttcctggttatgtgctttagggttgaccgtaattggtaacataagccattccagttaggtgagcctctcttccttgtgtattttggataatgactacgaggaaacaagatggaaatgtgggatggttagctaatgtcagtgccgagtctccctgctcaatgcgcgttagcccaactgccaaagctctgccactatggtaagtgaagatggtgattttcagtttggcagagactgttggaaggcgtaatggcttatttgatggaaaagatttcctgctgcgggagaagctgccatttgcagacaaggtgtgtcagccagaagaaatgagcaataaccgttttctggtttctactggcaaaagctttgtatttttttcatatagaagtgttaaaaatagattcataagaaaatgcatgaaaccaagtaaaaagtacagacactgaaatttcaccaatgaatgggagagaagagagctaacctttgttgaatagttattgctaaccaggtgcttcagttctcacaaaattgtgtgaggtaggcccgccacattagagaacggggatcaggcaaacagagatgaagtactgctggagcgccacgcaggagactcttaagcttggcgttgacgtctatgacattcggatgcctttgtgaggctgtcaaacctactgcgaagtaggcggccctcagctttcagatgggttgtgttctgattgtgggtttgtaaaactcattgctgggaaccctgaacacactttttcactgaaactatgtcatatttagtggtttcccaggccagcccagaaatcatagctgaagtattctgtcttattaatagtaccatagaaccaaaccactatatataacatggtttttgtgggaaaatgcactcagagctccaacttgagttttttaaggtttttaattccagttacaatggcaaaagggactccaccttctctctttttccatttaagccctggagggaaaataaaggtacacagagatacatttcctttcacgtttcctcatgctaacagagaccccaccctggactgcagagcgatggggaggggggatcctggcagtagctggctttgtgacaacagaggaaagagaagagggggaagagagcacaggtagcggaagaagtgaggtctagatgtcatcacctatgggaccaattttggatggcttatcaatatgagctgcaggctgactgacatcgtttccttactaaacatcatttttactgagaacttagtaacctagacctagacattaatgttacttagttgtatgttcagtattttttaagtgaaggttagtttttaaatagtcttcagtagtagaaggaaagcacatatgtagacatcttatttttctttttcatgccagtctactgaatgtccaaaccagcacctatcggtagctgaatacactcaaggtaaacctggatgctaatggatatgattcgaattaatcatagaatatataccgttcgttgagtacttcaaaccagaaaatgtgctaaaatgttgaacacattttatgtcatttaatcctcaccacaatcccacgtagtgagtactatcagcactcccatcttaaaaatgatgaaagtgagattttaagagggtaagtaatttgtcaagatcacacagatcagaaatggcaagtctgggacctcattaattcaacaaatatttttggagcaagtcctgtggcccaggctctgtgttagactctgggagtaaagcagtgaatgaaatggacaaatatgccgaaatccttgccctcgtggagcttatatgccagtggaaagagatgaacagtaagcaaaacaaactaaacagctagtgcctcagatacagttatgtgctatgtggtaaaatagatctagggagcatgaggaatgccaggttggggttgcagttcaggcaagtagagaatacaggctgaaggacagctgtgagataacaaaatcagtccaggagtacatacgctattgtttctcgcagcaacccattttatgtcgtaacaccaaatgttgagtacatgtcaccctcatcagtcactgcttctactgcagcaagtgactggggaggtatccaagaatgactggtgaagggcttggccttttctatcccaaggtcaggaaagatgaggacagttgctggagggatgtcctagagcggctggggttttgtgcacaagcagagggcttgacctcagccaagagcacagagctgattctcctgtagccccagaaaacaggcggaatctgggggcacagatgagggctgggtggaaggagcaatggaagctcgtggaagttctgtgttgcttctgttttcttagtggaatggggagtgtggtcatcagtggggagcgagggtcggggagggagtgcggggccgggggtgcagtttgaggagagagatgtgaaacagtcacctggcagaaagggagcctgaatttagctggtgaaatgtacactcaggatctgcccatggtcaaattctgactcttaacatccttccacagtatattggagatcagaattctctagttcacttcttgaggagagagattatcttctaactccttttttttttttttttttttttttttgctgtgtcatttacttggagcagagtcctgcacttactatgtgtatggttaatgcttgttgagtgactgctacaggaaacctacacacttgtccagaaatttcatttaagcttttcgtcctaattgtcacattgttctctcccttttctgaaatgctgtgatgttcctagttcccaaaacagtacttgtatagcaattactgttaattatttcattgagttaatctcattcccataacggattaagttttagactaagaaataattttttttgtttgagacatgaactcactaccttcacccaggctggagtgcagtggcatgatcatggctcgatgcagccctgacatcctgggctcaagtgatcctcccacctcagtctcccaaatagctgggactacaggcatgcgccaccacgcccagctaattttttgtatttttaatagagatgaggtcttgccatgttgctcaggctggtcttgaactcttgagctcaagtgatctgacctctcagcctcccaaagtggtggcattacaggtgtgagccaccgcgactggctaaaaattcttaattgtatactcttttgtagtattctcttgggaccacctaagtcaagcctcattcccaccagatggtgcccctgttgggggcagtgaagaagccttctatgtctgtttcatgactccttcttggctggcacactgttgtgggcgctctgtaggtagtcaatgggaaacgggaaagctacttgcggttagaataatacgagaactagatattggtaatctcagctgagcgaatggcaaaggaactgatgaagcaggtggattccaaggctagttaggagaaggaattgactacaagtggtgttggtgggatgggaggggtgagggaggggggatgggaggggtaagggacgggggtgcatcagaggttactcccagggctctgccagaccctgggtagatggagccgccgttttacagaggtaaggacaagagtttagttttgaacattccaagtggagatgtccaggacacaattatatacctaggctgccattctgggaggagatctgagtgggagaccatgatttgggaattatcaccacagatggtaatttaagccttgggagaggatgagtttgcccccaaagagagcataaagtaagaaaattgggctctccgtgtttcaaggttgactaaagatcctgtcatttgactaggctctgctatagtctgcaaaatctgcccagggacagaatattgaagtaaataaagtgtattccagtgaaacctcaaatagattgattcaaaactggagttagaaaaacttgtggtttttcttggtaaagcttcattttctatttgtcttcataactataaatggatgtatttgtgtggaagatgtagattttttttaaaaaaaatctatttttggctctattaagagacaaaatgaatccaaatgtattccatacttctctcacattgcaccattttgttatgtaacagagaacgtttgagtacatactgtccacaccagcaactataaatctgtcctggcaagtgactgtaagatacccaggaacaagagataaggagctcgcctctccagggagaagcttttatttgcaagagagagagtgatatacaagaacttgcaaatgtctttgaagggcagaaaaaatcagctagggctaataaggcagctgtccaagttcatgattccttggcccttctttatacacaaccaccaagagttgtcagtttgcaaacctagaaaagtataccattgtaatatcagttcatctcccgcttttccagagctactcagaagcgtggtggatgcttagtgaaacgaccagaggtgtgaagctgccagacctttacccagatcaacttctttgactcagggtacaaatgaacaacgtagtctgacagctcacctaaaagttatttggaatgattttatattgagagatttttttaaagcctaaatttagattcatcagagcatatcaaggttgagatatgtgaaaggcagtgctatatgggagggtcaagttccattcgtttaaaaataccaggacatttgctgctgtttagtaggggagttgggtagggtagatatcctcacctccactatacagatttatttatttatttattttttgagaccaagtttcgctctgttgcccaggctggagtgcattggtgtaatctcggctcactgcaacctctgcctcccagggtcaagcaattcttctgcctcagcctcctgagtagctgggattacaggtgcgtgccaccacgcctggctactttttgtatttttagtagagatggagttttaccatgttggtcaggctggtctcaaactcctgacctcgtgatcctcctgcctcggtctcccaaagtgctgagattacaggtgtgagcctctgcgcccggcccactatataaatgtttaagaattaacatgtataaaggttgggactttcccaaggtgagctgttggacctggatctcctgaggccaactgtgtttttcttctcagcacagcaagcatcctttgagatgcagagtgatcttaccacttgaaaatgtgcatcaagggcaactgcagaattttccaaaagcttaagcacagatggcaaatctggcaaagtcaaattgagaacactgactacatgttcaggaggaaagtttttaagggtaaatgcttaaaaatcctgaagaccagtttatttgggaaagcaattccaatggaaaagtgcggttggcttactgagggaaccacacagtggcagtttctacaacttggccagctgccctgggctggcagttgaggagaaaatgcagcagtggggttgagtagacacctcagccacggagtgacagtcattgtgttctaggtaccacctgaccgctctctgtctgctccttctgtggctctataatatctgagctcctgggtaagctccatgcagcctctacaactctgcttggagctcagttttcctatgtgtttattttgattttgtctacttattaagttaaatacaaatctgaaaatgaaagaataatcaccttggactcctgaatgtttgctcaatgtcatttagctcccattgtttcctgtcaccatagcagtctactgaaatctctcagcatatatttcagaattactctgatagtgaaagatttcctatcctatgtagtccaacaattattggtttattatgtgaaaaataaagcaagtatgtagcatttacagagtaatccagctccactgttaatactgtcatttgaagagttagcaaggaatgtgatgaagactgaatatcttgaaacaaagtttggttgtgcagttgctctgctatgaattatgggtctgattcccctctttatatgtggcttttggattttcttctgcccttgaggtaatctgctcctcctttcattcaccgtgcttttaggtttggtttcagatacagcatcccttctgctacattctttaaagttaaaaaaagaaaaacaatttcacttttattggtgatgggcattcaactgaaattacaaatcgggaaaacatgacattccagctcacagcagtctgattaaaggtggaactcttatgaaaccacaggatctgactgaacatatggatcatcttctggcaagcttaacagacacctgatgttttccttggccatccagaaatctgcatcctggtgtagatatcatgagttaatgatggagtcaagtgtagaaatgtgtctgggacttgcagacctcttgctttgtgatactttcttttattttcttaactggctgagaaaatggctgtcactccaagtctatcttctgatgggctggtagctctcattcaggccatccacagccagctgcctttccccagacaacctacattgccttgagtcttctcttaaagcaaaaagactagaggagaggagtgctactttcttctcagccttgctgtccctgtcatgtaaggaggtacttaaaaagcattcctatccagttctctctatctgctccgtcttctctccatgccctcatggagtacttggtaaaaacatttaagtagatgactttatggaatatgattccccggttttggagaaataaaaagatgaatctcagacatcagtaagggccacattctagttcaaattataagcctgtacataatcagtaaaactatattagaaataaaagcttctcaaaaatcccaagtgctcgttacccaaaaaatgatgatagacgggggtcccacaaatgtgtagttgtgtatatgtcatagtatacgaaggccagggaaatacatagtgccacctgacctaaccagctgttaagcataattactgtggttttgccagaaaggaattctaaatgcaggaaggtttgccattagtgggccacagaacatgaaagacttccctgcaaaccttttagaaaatttatgctagtttatatttcaggaggtaatacccattggatatactctaatttgggaaacatgggatgattaatgaattgatacaacctctagaccaggggaacagaagaaagtttggcttgcaaaatcacaggctccacctggtcagcgcttatcttccttgtttagctcaagttaggtaagtttacctaatactccttaaaaggagtattttaaatttatgtttgacatttaatgatttcagatagttcttggacatcaggataaacaaattcagtgtagcacatacgtagtataagaattctgttgatataatgccgcagtcatagttgtagcccattattccaggtaataatgatgctacaattagaaagttttccaattgtagttttgatttgcacagtagtaattgctgtttctattttcataggcaaggagaatccacacatgaattagaggctttccatattaggctttttggagacatagacatggtggtgatcgcatggggtgtttgagaaaatggagactaattgaatgcaaagtattctgtggggcaagcagagtaaagaatccagtcaaatgatgtcagccaaggatggcaagcccatgcccgaaaaactggcagcagctcacccataccaagccacctgagacatttcctgggctggaaacaacgttacggaaattgaacttccgtgccaaatttaccacacctcgccaaagcctgggcacctctcttattcatgggtgcctcaggagtaattacagctttatagcatatctactaagaactttagtgaaagtgaaaaggagtcggtaaccttgaattttagcaaactagagaaggaagatgtgggtgtcctttcctcacgcgttaacaaggatgctgttaggttgtctatctactctgaatccctacttaggaggaaagtcacgtatctggttgtgcaaatcaaagagctttgacagtttgttttttgtttgtttttatttgggtgcaatttttctagaagactaaataacctgtaaaagattaaaaaccatgattgagtgtgcctagaaataaagaccacccttgactgggctttttctacccaagtccaagtgaactgctttatccatttagtcaatacatattcagtgatgctggttatttacaaagtattttatctacattctgtattaattctcaacagtcctgtgagatcattgtttattcttgttaatacacatatacgcacacagaagagagaagtggggaaccccacaagccttgagaatttcaagaatttgtggatttcagaatggttgagcagctcatagcttttctaacactgaacttttctctctccaagtcccagtcgctcgtcaaaaactgtgccatcagcgcaagaccctgtgatttctgtggtattctaattttatctgagatttattagaatatatgaggtggaaaaaaaagttgtgcaacaggagattggactctggcatcccacagcgtatcttccctgccaacttcctaataaagggtgaactccaaatattaaaaagttattaacgtgcttgaaagtctttccaaatgcttcaaaaagctagcagacacatccagtatcatttattcagcaaacatgtactgagtttgttttgtgctcagcattcccgactaagtaggacattgaccaggccatcatgggttaggctcggaagggaggggcccagatgcagaatgaattgattagttctgtgggtgaaacagattcagtgtcctctgaggagggactgaccagctctgcctgggggagtaaggagaagcttcaggagagaaccaagagctgagagtggagagtttgggagaaggctgaagctgggtagagaagctggaggggggagggctgtgtgtccggaggatggcaggtgactggtgtggctagagaggcaccggagcagaggaggtgagggaggctttaccagctgtggaaggccttgctttccacacccaaagtgccatggaaaacatgaaaatgtgctttctatcaagggatacggtcagaaatcgaacaaaatatttcctacctgtctatatcattggagaaattgttctaggtcctttaaggaattttaggacccttactaacacctttcttcttttccaatagcatcatctgtcttagataatagttggccctctggatccctgggttccacattcatggatttaaccaaccacagatcaaaaatatttggaaaaacaaaacaaaaacagtaatacaacaatagaaataatacaagaaaaaaagcaatatagcatgacagctatttatatagcctttacattaggtattataagtaatctagagatgatttaaaatatacaggaggatgtatgtaggtgatgtgcaaatgctaggacatttttttatcagggacttgagcatgtgtggattttggtatccgaagggttcctggaaccagtccccctcaaataccgagggacaactgtactcacgagacaggttgttagagtttaagagattcctaaatcataaaacctcttgtaaaaaggaagacttatacatacaaagaactcagctagtcaagactaagaaagtaccagtgggaagtaaagccacggttttaaatagtaatgtaatgaatgcttcccaagggcttgaaagtcgtttgtcttaagcagcacttttgccaattgttatactactgatttatttgacaagccccctttttagttgttagtgaaaatctcagaggtatcacagatttcaaattaatgtggtctcaatcagtgaggcttcctcttgcaataatctgagatggcaagtagctgttctaggatacctctttttgctactcttctgtcccttaactgaatgtcatttcaataccaagtcctcttctctaatatgcattcaaccatgcatgtacaaatattgacttgtccctttgctcaaccctaagcccactgcacgctttactattttcattcttacataaaagatctagaacagaaaatagattggaagtactatatagatccactacatacagtcaaggggaagtctcaagttttctcatgtttccttttataacgtggacaactgaaagttaaatatgtccgtttgatatgggtaatttaagcagctataggtacttggtgattattgtaaacctaagaccttaaataatacataaggaatcaatttcaacactaataacatctgatcaacaaagagttccttttataagatgagaacggcatggaattatttctagttgccttaaatgaattttaaacacccgttatgcgagggagagtaggtatggtctgtaagaggaactccaggaagcccatgtggaattttgcagtttcctctttacaggtgacctgttaaacagcctgcatgtcatggtagtgagatgtaacagaaaagctatgttaattaaggtgactgattaccattcaaatacatgtaaatcacagtctacccagaggaagataggagtcctctaactgcaggcttcttccgaagaattaaagggctttctgaaaagctgaggctctcaaagtgtgggtatggtacccacactggtggtgtcagcatcaccatcactgggtacatgtccatggcatccagtgggtaccaggacatccatttcttacccactactagaaataagcaattcgcttacggttagcaatattaccatgaaaaaatgttaatttgacaatattgagaccaaagcaaaacagaattttgatatttgctaaaaaagaaaaggcctgaaattagtgggctggttgaaaggggactggaattgcaagctgctcccatctgccattccagcttttaaggcttcttaattgaattggaagctcagttgaaaaaagaaaaggatcatctattctttcctctgttttcagataaagtcctaagaacttttttgagggcaatttatacccattaaaatgtcaaattcacatatcctttgacccaataatctcatttctagacatgtttgccacagaaaactcaaaacaagtatacagtacaaattagttgtacaggcagctttattgctacactatttgcactaatgagtacttgaagagagcatgtctatcattaataaagaatggtttatactatggaatactatgaggccattcaaaagcatgaaataaaccttcatgtaccaacatggaaggatacccatgatacatcgttgaaagatacaagatcactgagggaaaatgtgcatatgcttcatccaacttttgtgaacaaaaacccaaacatgtaaacatatgggtgttgtaagtatttatatttgtatagtaaaggttctggaaagatagcaccaagattttattggtgttttgccctgtggagtggaattgtatgaggattggtggttatgtgggaaattctttacatttactttattatcgtactactttcactttattttttaattaatattttatctttaatttttgtgggtacataggtgtgtatatgggctatttggatatggacatgcaatgcgtaataatcacatcagggtaaatggggtatccatcacctcaagcacttatcctttgtattacaaacaatccagttatactcttatactttctgatacttcagtttctcacaatgaatattccttttctaaaaaagaaaaaaaaaggaagaaactaagtcccaggcatattaagagagagctaattagctgtagaactaattctgacactctatttcccaatcagtattattcagaattattttttacttccctgtaatagttactcaattttagagccagaatttagcctaatctactcatttaacctctaagaaaactgagcccagggggtgctaagttcctggagagtggtcctcaggtggtgactgaggactgagttagcctcctccggcaaccctacccccgtcccaccccaccccaccccaccccacccctgggcaaagtgaaagtgaagcaaactgagaggaactcctccactgtcccttctgcttactcagcagatgggagccagccactttgttttgtcctggggcctgtccttgatggcttctaagactaaaaatcaaagctgtaaatttgtgtaatttagagattgaaggtactgatcgttgttgtcagtgactggaaaccaggcctattgagcaagagccattgttcagtgcctgtcagcccagagagtgtgccgaatgcactggccatcttagacacagatctacttggtggtgttctgtgttttttctcctaaaagaaggcttctcacaccaccactgatgagaaaacaattcgaggaaaacgtaggcacactcagtacatgaagggagacactattaaaagcaaaaagagggttattgtcaaacttagaacgatgctaatttgagttctgagctctaaaactggtagaattcaaacattaaatgtagaatgtactagtattctatgccttaaacagttgaaaggaaaggcttacattggcaaaatgtatttcacaccaaataatgatcctaaatcagtcttttgcaacgtcataagatgcagctttgtaagtatactttatttctaaactttaccaatctcaaaggctacctggagctcttatttctgaaataatttcaagatgttcattctctacagttttgtggtatgattaacttcgaagtccactgcagacacaaatgaactttccctaaaatgcaacacgagagtactaactacagtcagtaaagatgagagggggttattttgtagctcttcctgcaggctgtgagaatttttttcgttaaaaaattcgttaaaaaagcaggatatactgcttcagtccttaccatgagagccactcccatcggaacataaattagtcttagtatatttcaggttctcccacatgttcacattccaactgggtgcaacagttgacttttgtctttaactttccttggcaaaccgatagcatcagaggaagagataagctgccccttagggagctgattgtaatgcgttccagacgtctgcacgcccctggtgcaagcaccagctttctgttaaagactcagggttatgttgtttggatgttttgttgtttgctttttgaaaaagccagatcagatttttgtcattgtataaactccagtaggagaagagggatgcgtttttaaggtgatttctagaatgctctggccgacttagctgcagaagaaaaaggagaaaggaagagacagtgtatattttggcactgaaacttctttagtaacaatgcattcattcacaaatctggagagaactgaatgtctgctttttaaagtctgaattgaattctcgactagactttgagaccctgagaaggttttcaatccaaaccatgcttaatattcacgttttatcattattgatggaaagtgaaagaaaatttgaattcttggtagccagatttgacattagacttttacatttataacctcacttaaactttacaagaaatctcattacaggtattattatccccatttttaaagcaaaaaaaaaaaaacactgacccttggaaagaagaactggcactattgagattcacaccacgtgtggctggctgcatcagggggctcataaagaattcagagctggcccccagcttatcttccccattccctcttctcacccccaagctacctccattaaaagagatgccaggctatatttattttattatgtatacttacgaatgcatttgctcatctttggtgtcataaaatacaatgaataaactcctatccagtttttcagtgtatttccttaatttttaaagcaataaactcctttaatcctcccttatactcaatactaaaaaatgaaagatctgattttaagcaggaaaagttttgtcttagcatatagccaggaaacttcatctgcctaggtcctgaaatgtaagtgatctgccagaaccaagcgtgggggtagctcgcgaggcctcagccctcctgctcctgtgtgagagtgctttcttctgcaacctggctcctggaaggaatgaatgctcccccttcagcccctactccccaccaagaatttaaaagataagagggaaacatttccctgactctaaaatggtttgtttttaatatggtatgtccaggcctgcactactaaaatccttcataaaagtcctctagaagataacgattgttcacattgcaaacctgtttgaaaagcctggaaaaaatgcggtatactgtagggaaagtcagtctccttttctcacttatataatttgtaagtctgtcatttcttttttttttttttttttttttttttttgagatggagttttgcttttgttgcccaggctggagtgcaatggtgcgatcttggctcaccacctccacctcccaggttcaagctattctcctgcctcagcctcctgagtagctaggattacaggcgtgcaccaccacacctggctaatttttttatttttagtggagacggggtttctccatgttggtaaggctggtcttgaattcctgacctcaggtgatccgcccgcctcggcctcccaaaatgctggaattacaggcatgagccaccgcgcccagcctaagtctgtcatttctaatatgctctcctagttttagctcagtagtagctgagtattatacaaaataagctctttttactgctgcttagcatgtgtctgcgaaccctagctcagtacctggcattccatgggcaggcaagaaaagtttgcagaatgaattaatctggcccaagtgtgactgagaggccagaggaggtcagtgggtgccgtctcccaggccagcagcacacacacagcttcctacagtctcccttcttgtctttgtctctttacatcctcttcccttcctcccatgtgtctctaacctgccaattgcaccaacatttattccctgctgcagagcctgtggacccacagtctggcttacctttattttctccatctccagaatatgtctctcctccatacccccataaattaaaagtgacttaaatatataaaatggaagagagaggcaggataaaactgtttgataacttaatagtacaactggccagtctctcgtagattttttgcattcattccaaacctgttttttgttttgttttgtttttgagacggagtctggctgtttcacccaggctggagtgcaatggcgcaatctcggctcactgcaacctctgcctcccgggttcaagcaattctcatgcttcggcctccctagtagttgggactacaggcgagcaccacctcgcccagctaatttttgtatttttaatagagacggggtttcaccatgctggccaggctggtctcgaactcctgacctcaagtgatccaccctccttggcctcccaaagtgctgggattacaggcataagccccacgcctggctgaaacctgtttctattaaaagacttataccttggaactttaataagtaatttattaaagaaccgttaatattagacattaaaataattatgactcccttacccctatttgataagcatataggtgacgttacactaaatactatccctgtctgccaaaataatctaatgttgaagcagtccaccgcatttcaggtctcctggaaatgtgctgcgattttctgaaaattagaggcaacaacttgctgttgaggacaggaaaaaaagaggaggctaagacgcaaggtcctctgaagcttctgccagctctctcaccagaacctaactcttgataccagtggagtgaatctggaagtctcctgccttcctgagtgagttggagacgtagacactacctggacaggctggagaaatgagggacttaaaacgtagcacaccccttgccccatgccacctgactagaaatgcctgccaaaggtatatggacatgcaaggctggcacagatgtaaagctcaatatattaaactagatagcaaagaaatatacaccaagcccagcaatacaaagcaccctgccttcatgcagttaaacattcttctgttttaggccacactgtacttgctggcttcatgtggcttcatgaaggcaagtgctgtgtctgttttgatcactactagatttctggcacccaacatgtagtaaaagctcaatcagtatttgttaaattcattgagagagctgggaaagaaggtagaatgaaaagaaaagaaaagaaacaaacaaaaacacaagcctgggcaacatagctagactatctctacaaaaattagccgggtgcagtaactcacacctgtagtgccagctactcgggaggctgaggcaggaggattgcttgagcccaggaagtcaaggctgcagtgagccgtgactatgccactgcacactccagcctgggcaacagagtgagaccctgtctcaaaaggaaagaaccatccacaaagttagtagtgcctacaagagtgtagttgctctttaagcttgaatttttggttattttgcaagaggtattatttgccttaagccatggtaattagatttattctgctttgtgggcttttagatgagttaatcggctacaatttctcttaattccctctaatgctttctaggtgtggatatcaagaaacctacatgttgtgtttagaatattttatgtatcacagatatcagtgggtagtagactttgcactggaattgcccttttccctgcctcagttgtttttggtaatattaactctttatttactgttaaactttacaaaaaatgtcaagtttactttttaggactaataaattagttttcataattttagccatttaggaaaaacagaagaaaccacattgcagtgtaaagggagaaaagtcacacatagctaattattgataggaaaatgagaagtgagatagcaacatctgagaggacttcatatatgagcatctcacagagtaactttttcttttagccagcataattactagcttttcccatgtgtgtacagacatttttttccttagaaattttggccttaaaagtcaaatacaggttgttttacagatgatcaatggtccttctagaagaagtccacagaagctctcagatgccctctagaccagcctttactcactcctctgtcagcatcctccctcccagctcgcattttaccaaagctagaaaagaccctcaagggcctgggtgcgtggaattattagagaccagataaaagacatgtaaggagtgctggtgtggcagatgctgcgaaaaaaatgtgccacaacctctgagggcaggaaactgaaagacctcgtgtggtttggaggcctgaggaaagagcctcaggaagtgatgtttgacctgacatctgaaggctaaatgggagacagagacaggtgtgcagtcaggaggaatcgcacattgaagggaagggctgagactctgagaatgggggtgggagggagaaaagaagaggctacagggggcgaccaggcctggtgggccaggtgaaggaatttggagttgatcccaagagcaagcgaaagtcactggggacagggaagtcaagagtcacaggattccatgtggtttttgaaactggctgcatggaagagaacagcgtgtgggagaagtgtaggagagggaaaggcaggactcatgatggttgagatgagacggatggagacaggcagctctgacttctgcggttctgacttgtgaaacaggatcagggatggtgccactgactaaagaggaagagaggattccagtaacaactaagcactattctcttttaatctctgcaacagccctactctgtgggttctattattaccccattacatagatgagaaaacagaggtacgaaagattaaatttgtctagagtctcctggtaagtgttcagtaaatgtttgctactactgcctctgtttactcatggagtcattcattcattcattcattcattcattcatggatggtatgctgtatctaagataatacattgttgaacagaatagatgtgaactctgctcttgagaaagactggtagtgggagaaaaagacaataaacaagcagttatcttgcttggacaagctggtcagggatggtaggacggtctaggtttcttagactggaatgttacaattctagctcttgcataaatcttggatggatatacagaggaaaaatacgtattgacaaagccaaaaaaatgtttcccagatgttctctgaggttccacaggcatccccaatgagttagatcagaagtaggccctgtgccgattttgtaggtgggaagctgaagatgcaagaagagaacagccgtgcagctgtgctgaggtctcaaagagcaagggttccaggtgccgccgctcctgctgtccagcaggttcagctgcctttgggcccaccaaggtaggaaatggcccatatctgactgcctctgtacaggtcaaatcacagctccctgttctctactatatatagtaacgaccttacataagagtgctattaaaaaaggacgacagagaggaaaagagaatgccagctgaattttttccactaaagctcatttttaacagatgtgttttctctgtttccacaatgacagtgtaccaggggactgttctccaggtcaggagggaagcaacccaggtacttgtaggactgtaattgggtccgtctgtgctgagcacaacaataaaattacttgtacttccctttttatttaatgttactctcctcatcagttcccattttcctgatatttgtgggaaggaggccatgaagaaggatgaaaacactgtaaaaataatttaaactaaactttacaatatatttgggataatgctgagaaggaatgttcttttttttttttttttttttgagacggagtctcactctgttgccaggctggagtgcagtggcgcgatcttggctcactgcaagctccgcctcccgggttcaagcgattctcctgcctcagcctccaaagtagctgggattacaggcacatgccatcacgcccagctaatttttgtatttttagtagagacaaggtttcaccatgttgaccaggatggtctcgatctcttgacctcgtgatccacccgcctcggcctcccagagtgctgggattacaggtgtgagccacctcgcccagcctgaaaaggaatgttctaagttcagcaaaatgagtgattaacatgtaagtggtacgtctatcttaaatgctttaaattataattcatgattttttaattaaggctttcttattccatctgatctcttatacactctagtacccagtgatacacaaattttgttaattttggtaagtcagtctgtctgtgcagtgtgtgaccttgacattatgtaatatgaatgggatggctacgtgttcccttttccccaggacagtcaatctgccagttgtctagagttctatatagttcagcctttgtcccagattaaagggcccacatttggacactgaattatttacatgaccgtcctgaatactaatagctcacatttatcaaaggcatgcttgaacattgctcaaaatacttcacatgtactaccacatttcatcttcacagtctaggagggaagtgctatcatgacccccattttatttattttagattcactggttacatgggcaggtttgttacaagggtatattcatgatgctaaggtttgggtttccattgatcctctcacccaggtggtgcacacagtacccaagaggatgtttttcagcccctccccacctccttctctccccacttttggagtacccagtgtctgtcgttcccatcttcatgtttgtgtgtacacagtgtttagctcccacttatcaggaggtatttggttttctgttcctgcattaatttgtttaggataatggcctcgagctgcatccatgttgctacaaaggacatgattttgctctttgttgtagctgtatagtattccatggtgtgtatgtaccacattgtctttatccaatccaccattgatggcatctaggttggttccacgtctttgctgttgtgaacagtgctatgaggagcaagtgtacatgtaccatgtggggttttttggtagaatgatttattttcctttaggtatatacccaatactgggattgctgagtctaatggtagttctatttttagaactttgagaaatttccaaactgctttccacagtggcctaatttacattcccaccaacaatgtataagcattcccttttctccacatcctggccagcagctgttgttttgacgttgtagtaatagccattctgactggtgtgagatggtatctcatcgtggttttggtttgcatttctctgatgattagtgatgctgagcattttttcatgtttgtcagctgcttttatatcttcctttgagaaatatatgacccccattttaaagatgaagaagcaggttcagaaaaattaagtgatcaaagaaactcagccagtaaataatagagtctaaaatttaaacacaggcagtctaactccagagcctacatggctaagaagtacagcattacctttcattcctaaaccagttaagaagtatatgaataaaactcctagaggatggaagggtcctttggaactgggaagttcttggagtccttgaatagaaatgctttcccaatttgccagtgcaggggccctttatgggaaacagtgaggaccatccaacagtccaattaactgagcacaaagcacaaggcatatttgtttttctttcttttgaaaacataaatgttagaaaagttcagaaatgaagagatttagaagtataaacttataactgttggaaccatcctcgtattttctagaccagtcttccttctctcgacaacccttctctcatggccattcctcgccctccatgttttcatgaacagtgtgattgactactctgattttgttagctagccaaagtggaaaatgagaactcggtgagtgggctggtgtatgctgcctgccagaggcagcgctctgtaagacgacttcattgtttgcttaccctaatgctccattacatctcaggatttatttataaattatttgttttaggatatggtactagcttcatgaaccccattgtagacttcacatttagaagtgttttttccaactcttttttacttaattttcatgagaatagtccttacgtcaagatgaaagaaaggtgaaacaccaggtagaatcagcaaactgataagcagccctgtttaaatccatggaaaggtaatgtttaaagaagacatttgttttaattgatttttattttacgtgtacacattaacttcataaatcttacctttcataccaagaagcctagatcagctagcgtgttaatatgctgacggctgagagcaaaaatagataacctaaagttgtctaacaaattagacatcacttaagaggaaactcaagtgtgtttcagggagcagtggcagatctgccttagatttttaaccactgcatcatcctgttaatcaagatcaatcagatacaaaaatctttggtcagaaccagtattacaaaagaacctaagaatttctgctttctcatctttctgtttaccataacacaggcatatatccaaaaatatatagaaagcaaaaatttggagagaatgacatgcgctttcctaaatgcaccttaatgctttccctggtgttactattactactgttggaagcatcactgttgaaatgagcctgtacgtcacacacattgctccccacacagcaacacttctgatgagggcagccccctgccttgttattcattgagaaatagaaactctgattatttagagcaaaatttcagatttgaagaagttttcctaataaggaagaatgatgtaattttcatggaggggggccaggttcccttcatttgttttatttatattagctgaattccaggggaaaatgggctatgaagcatgagggctgctaactatatttagccacacaaagttagtacatcaggggtcattttttctttaagttatacactcataaatgggctggaagatatttttcccggcatcttgtttttataaagtttgatcaagcataaatacttttattaagatgctatcttttatttcgagtgtgaagaaagtatccattgtaatctctttaatttggcatgtttctctgagatactggtttttgggtcaaaagatggataactaataacaataccttggttcagaagattgtattaactttccagagtgctcacgcctgtcatcccagcactttgggaggccaactcaggagaattgcttgagcttaggaattggagaccagcttgggcaacacagggagaccccatctctacaaaagtaaaaaaattagctgggcacggtggcacatacctgcggttccagctacttgggaggctaaggtggaaggatcacttgggcctgggaggtcgaggctgcagtgagccgtgatagtgccaccgcactccaaccagggcaacagaatgagacccagtctcaaaaaaaataaaaattaaaaaaaaaaatccagagtgggctttaagaaggaagcaatagtagtttcttggaagaaagataatgtgtgtttaagagtcccgttctgcccattgtctggcactattcaatctggattcactcccatccccctcaccttactctaaatataaaaatagtcggtgcgtcttaagacagtagactatcatttttgtacttttgcattaagacttttatttaaatgtatttataaactggagaaaaatttgtagcatttaaacataaaacctcagcgttataattggtcattccttcctcttgtcaacgtgttacaacatttttgctttgctctgttacatgactcggggcttacctgcatttcacgtgagagaaaagtcaaattcatctccaccccacagcctgctatcttctgccttttaccctaaatctttggaggcgacagcttcctccccatgactgatagttatccatgctcacagctgctggcaggactgactcctttacaactgtggccttgtagttgatctgaacaggatgatcctgtctatggaagcggagtcttctctcactgcctgaaggagaaggctctgctggagatggagggctctcatctgtcaatgggtagcaccgacggtgccccagacatgctgaccatgtgtggatgtcttagaagagtggaaaggcttgagaaatgcaagcttagaatcatttctaatattacttgatgggaagtcagcaaataggaaacttgtaaaaaattggaggacaactttttgccactatcatggacaaatctatcaccactaccccaaatatcggtccctcagagaccaagtccttagattctgaggctctgctgtataattcctgttcagtagagcatctggcgaacctctagtaggacaaacagacagtaacccttgtgagaagtgagggaacttttagaactaggcctcaaggagcactgtacagtagaaacagaatgtgaaccaccacaatgaagaccacatatgcagtttgttttctagtagtcacattaaaaaggaaaaagaaattaattttaatagtacatgttgtttaacccaatatattcaaaatattattttaacatgtaaataatataaaaattgtcataagatcattttccaatatctttttaaactaaattttttaaatctgctgtgtacttgacacttacaacacgtctcaattctgactaaccactgttcaagcacttaatagctacatgtggctaatggctaccatagtgggacagtgcaggtctggaggatgtgaaatcgggtgaacacacaacctttacacccgaaacagtgctgcagaattgatgataattactctaaatgctcatctcttatcttttcgcgtctgaaaactgctgctgagtgtacaaaccaggtaacagtaataagggccaatcccagtggtagaaatggagttgatatggtggagaaggatctgttgacaccagaccctcaaccacagccatgcacagctggacagaagccccctcggactcccaggtctggagtcggggcagaggcagaaagtctaaaaagaaatacatcagtgtagtcatttcagtaataaatgctgtgaagtaaataaaacaagatagtaaaagagagatgggagtactcttcttgctcactccaatagttgagtgagtcatctgggaagtaagttgtgctgtggagtgtgaaaggtgattttaattcagcctgagagccaggcgcagtggctactgcctgtaatcctgcactctgggaggccgaggtgggcagatcacttgaagtcaggagtttgaggccagcctggccaacatggtgaaaccctgtctctactaaaatacaaaaattatctgtgcctggtggtgcacgtctgtaatcccggttatttgggaggctgaggcacaagaatcacttgaacccaggaggcggaggttgcagtgagctgagatcgtgccactgcactccagtctgggatgacagagtctcaaaaaacaaaaaattcagcctgaggaaaatacttcctctagtcctcaacgtgactaaagagatcctcatttttctttaagagagaatttcattatttgaaaacacaatgcccaaagaaatggaagaaattgaagaagctggtttctatgtacttcaaataatattttggtgtgaggccccacatgacaacatctttcccccaggataccacagctgacatagctaaaatatgaagtatggcctaaataatacacagtgagctgataacttaggaaatattttttgtttgttttagccaaggcaaacgaattaaaaattttaatgttttgtttccatatttgcttaagtaaacttcaaaactaattacttgcaaagaattttgcctcggctacatggatgaccagtgaatgcttttgggagtgtaggactacactgaataatcgaataaatctattgaatatggaattaaaaaaaaaaaactaagtaaaaaagcattagaaccaccatacagcttatatctatatgcttattatgtatgggctggcttaggagggaacttgagaaatggtaacagtatttggttgatgctggagagggaaattggactgggaagaaaaagtaagagatgaagatgtactttcagtgttctctttatatcttttgcattttgaagagcagaggtttttaattttgatgaagtcccagttcatcaattttttttctcttatggatcacccttttgttgtcttatctaagaaatctttacctaacttatggtcacaaagattttctcctatgattccttcttgaaatgttatagttttagattcacatttatgttgaagattttttttaatttttttttatttttttagagatggggtctcgctctgtcccccaggctagagtgttgtggctgcaagatcatgacctcctgagcccagttgatcctcccatctcagcctcccgagtagctgggactacaggcatgcatcaccatgcccagctaattttttagttttctgtagagacagggtctcactttgttgccaatgctggtctcaaccttctggactcaagtgatcctcccccttcggcctcccaaagtgctgggattacaggcatgagccaccatccctggcctgttgaagactgatattagttaacttttgtataaggtatcagttgtgagctgaggttggaaatccaatagggtttggaggggttttttgtttgtatttaatcatgtgtattctttaaaaaataggatttaatttcaagagattaaaaagaaatattgtatagaaatgtctgcagttataataagtagttcaattttaaaaagaaaaagttgttttgtttgctttgttttgagacaggatcttgttctgtcatccagtctggagtgtagtggcatgatcatggctccctgcagccttgttctcctgggctcaagcaagtagctgggactacagactcacaccatcacacctggctaatttttttttttattttagcatagacgaggtttcactgtgttgcctaggctggtctcaagatctgggctcaagtgatcctcccacctcaacctcccaaagtgctgagattacaggcatgcaacactgtgcccagccaagaaaaaagttttattatgactactgtactgattttcaggaacagtcattgtgctttaattctctaagccaaaaatgtccaattctgttgggcaaaaagactatgttgttgattgcgctctctcatatggtcccttgccttcagccattttcataatcaaaacttgatggcagtattttgttacagggtaagaaactaaaaatggtaaaagccatttgtcagggtaaatctgaactaattatttagatcagctgaaataaaaagggttacaaagacaagttttctgtcttcaggaggggatgtggatactaaaacttcaatggaaatgaaaagatatggataaatttgcatctgccagatctgcttagggaaagcatatacatgaagtggaggaagtcttcccatatcccttacataaggattgagatctgctgccagagacacatgttgcaatatcaatagaaggtcgtcaaattgccttccatgagggagtgggtctgtttaatgctatcattttgtgacattgagaacacgtgaggccacccacaccttctctgcccttcaccagagctggggccagcctcttccgataaatgctaaataatgactatcgctttgaaggtgcacttattagcaagggagtccatgtgtctagggttcttttacgccattacagtgtatgaataatgtacatttgacgggggatgatcctctcaccctactcaagtttggaaccatttgacagataaactgaggagtcagaaagagatccaagcaccagatttgtactggggagaactcagagaagaaaggggatgcactgctgggcctcatgagttggcttatacttcaccttgagctaagcatactaatacccagtccaggcagcattgaacagctccgcgcagatctcaccctccaaaaaacaggaagaaaaagccctctcactgcaagcaagatccaaagagagaagagcaagggaggggctgatgtgagcatgcccagatccatcccccacccatattcgccaccaagggcggagacaggcaaagagggcccctgtcctggaaatccctccatgaggaagcagtgaaggatgcagggcccactctgtcagtgtctagtgttccactgatcctacatagtaattttgaaagacgatagcatgatgttcctgaaaggaaaaaaaaagtttcctctatgaggtcattaacatatatcttgagtgactttattgtcttctggttcattttgacatttttgtaaattctatagatcttttatttactcctgtgatatattttaaagatcaacaaatgtccacaccaaagaaaaaaatcaccagtaagttcgtaacttttatatttctatacttttaactgttacattaatcctgtcttattcaaaaggtattcaccacaaaaatacttactaatcttggtttcctggtatgaactccttgtgcttctgagattagagatacgcttttctttacgggtggccacaatcaagagataagatcatgcctaaaaggacaagttaggaacagaagtgtgattaagtatattctgtattagttttaattaggactatagtcctttaacaatttcatcatatttaagcttgaaaatatacatgattgctgataccactatagtcatatacatgtatatatgcacacatacacatgagagatgagactgtgttactcagacatagaaccacgggacagtcagctacacattacttctaggcaatggttcatcttctctcttcagggaaaaagtaacccttgttggaacctgacagattttgaacatatcttttctttgttctttgtaatgtttatctgtattcttgttagaaacgactttctggttcagttatttaaaagattaagccttttagtgaaagaagttctcaccttggtgtcatcacttgagaggctaagagtgaagcaacctagttactactctgggctctgttggtggcctcctgtgtggcactgcaccaaacgtacttattactcagctggatgagatgatcccggttccttccatccacatgttccatgctttcctgtgtatctcggcgcacagatactatacatacttcagtggctttttccgttgtttaaatcttaaaaagaaaaggcatattctggtgtatatactacttccctaaatgaagggccatctactatataagtcttacagtataatcatgaaatccagatgtggtgtgcaacaaacttcattatttacatgttttggaaaagattaataaagtacagcaaaataagctcaatactacagctgtacacactatactataaagtattcttcttttgaaaagcatttcaagattttgcagcatttttattgtattggaaacagtcacagataccatattatagaaaactctgtttgacagaacgccagatgaataactgttgactatacacagtcatatataaccacattggaaacttcatgtagctatgataaatttctctcattttttccttaggagtaattacattagataattgaactgtttcatctaagaatttattttcgtggttttagtcatttctcagggagggagcctcatttattacagttctccccaagacacactggatagacttcatccactgctggaaggactggtgctgccccctgaggggaaatggctaggcagcactgtcttcactgcatcttatcctttggcctctaaggaatgtcaaggtcagctggtcaaaagctaagaagggccaaagccatttaaaatttacagttcttttccacggtcacaagtctcttaattcatgctgctaggctgcatctcttgtgcttgccaaaacgcatttttgagctttttcaagaactttctccttcttcagaggagaggttgggaagggagtctggtgatcaggcaagccctgcattcacaccacggaccctttggcttgtatatcttggccattagcatttaaactatcaatggtagacttgtaagaggaaataaattgctctgagtatccagatccaactgtgcattcctcacattgattgcaagaccaaaatatgtagaaaatgttattggcaacattatttattcaaaaatgtttagttcttcagttataggcctatgttaatagaaatttgaaaagtcgtctttatagtgttgttcaccatatgatataatgtttctaaattgtatcacatttagtgatacagtatctcaagagatggaacagcataacagatgagtaatattagtgatattcagatgttcaaatgtacaatcttgaaagactaaagaatgaatttattagcatgggcacattttaaaaatatttaaaggggactatttaaaaataatcctactatactgcaaagatatgaaagaaagaccgagaatgatttagtgaaggccacacagaaaattggtggcacagtcacttctacccgggaaagtactaagtagcccagtggcagcagatgctaaaaaagggctgtcggtgatttaaaaacaaagctatttaggccatgtgtggtggctcacacctgtaatcccagcacttggggaggccaaggtgggaggactgcttgagcctgggcaacatagtaagaccctgtctctactaaaaaaaaaaaaaaaattccactgggtgtggtggcacacaccagtagttccagctgctcatgaggctgaggcagaaggatcagttgagcccaggagtttgaggctgcagtgagccaagatgacaccactttactccagcctgggtgacagagcaagaccctgtgtcattcatgaacaaacacataagtaaataccaaactatttttaagaattcaaatccaattattttggaaatgattctttttgtatttatttttttctaccacaaacgtgttcaaaaaagagagtgaaggacagaaccataagtatgtaggaacttccataccatgaaattctatggtagtatttattgcccttatgtgatatatgtctcttgatttttctcagaaatttgaattaatactatacttggaaaatgtgaagtaagaacctttatcaattggtttcatcttcctgttcacattttggatatacaatatttagctgtaaacacatgatgtttgtttagtagagaccaaccattcattagtttctcaatataatgaacgctagttgatggtacttacactgaagtaagaaattctggaagcaaatttaatttcttagtttcaaagtcagctcctccaggttgctttgtacattcttatagtttttccaagaaatgtttttaagtctagcatatgagacataactacctaacattatatgcatggaatgtgttcaggacatagcccagctgtctctatagctgttttgggtgccattgcaatatctgtatctcaataacaaagaaatagggcataggaggggcagacttagagccatagtcttgagtggagcccaaatcagaaaggtcctctgtgtctgaggaagtcgcattgcacatggtaaatataagataagtcgtggtgctttggttagagacatggtaacgtcatggtcatgagccagagctcctcagtttaaatcccgtctccacttctttccagctgcataatcttggacaacttactatatatctttgtgcctcaatttcttcatctgtaaaatggagataataaaagtggcctctctcctcgggtttttgtaaaaattaaatgagtttagagggaaaagtgcttaaaatggtgtttggtacatagtaagtgctctatagcagttagctctcatcactagatgtggtgacgctgttggtgctggcagtagtagtagcaatagtcatgcttgatgaaattatttggaaaaggcctcccctggtggctttaaacacaggaaatggatgaatggatacccttctcaggcctccaggatattttgttactgtctaaggcctccttttaagttacaaacttatggagttttatgttttaagagtctttttaaccactatactttttatatgcacatagttaaaaacagtcaaatagtatagaagagtataaaatgcaaaaataaaagatgtcccccctccacctcattctagtcttactttccagaggtgaacactttagactatttgtttttagcccttctggtggtttctttcacaagtttatgaacaatatatgaattcatccatttattgattcatcaactgccgatagtgctattagattaatttttatattgttcgtaccagcaagatgttcttgttgggcctttggtaccaaccagctgataacagcaatttcttgatctccctgtgtctccatctacatatcataaaataaggatattggacttgttggtttccaaggccactttctaaaaagtgttaagagaccatttgaactaatttaagtgaagagaaaaaaaaaaaaagaaaaaaaaaattctgagataaaactggtctgagggttatctggatccagcggctaaaatagtattccaattttaactgcgtctctccctttttcttttatataaggaattggctgctttttatgtactggcttcctttttgtagacccttccatgatggccaggaactctaggtgattctatgcttctagacacatttcccttccatcttcagtacgaaaagtcccagggaaaggccctgcttggcctggcctgacctggattatatacttatccttggataatttgctgaagccatataccagttgactagtcctggatcacatgctcaccctgcaaccaagggcaagaggattgtgactggcagacccacaaggaatagggtagaagcgtatctgtaaagggagggaggagtgctattaccagatgaaagaagaatggtagagaataaaaacagatgtctgccacacttggagtttcaggaaattgactttaagaagaaactcattcaattctccacctactagtgagtcattacttgcttgtaagaatgcttactgccacacattcaaccattggcctcattctccttccagaaataaagcatgaactccacctacacattctttaacttagtatcagccataagcgattcctggcagtacttcacaacacttgaaaaatgaatacagacatcagtgtgatgttccaggcagacatcagtgctttagcttctagcctcaacacaggcactcaatgcggccttgttagaaacactctgtccggtcttttatgacttgctacactacacaatggacacacaagggaactgtttcctctctctgtatagggaccaactttgttatctcaggatacagtctatgttttgaaaaagtggctgtagaacagtgcagggatgggaagaatgggtcctatcaaagaaaagaactgcctagagatgactgaagttctcaccaagtactgaaaatatccccaaggcacttctcttcaaggtaaacataaacttattgcgtttttgactgataaccaaatcaaatggaaaatgggcactggtacaggctgccactgcctggaacatgatggagcgcctcacagatgccagattaggagctgcattaccaggttcacaaacgttctcattcgggtttgggagtttcacattttggatactaacaagccagaaatatataagtactgttacttataagagctctgatacatatatatctcctttattagaagatgcgtttccctttcctgtattccacacaaaaggatgcctggcaatcttttgacaggtagtaagtgacatctatgtgcaaaacactgtaataatcaagaagatagaacacatctggctctgggcgatctgggctggtgtgtgagatgataatgccactgccaaactgacagtgccatgccagccttgtgggctggagtagtatggaggagggagtaagaactgctagatgttactagggagagcttcaagaagaaatgggcattgaaatgggcacagaaggatgaagacagtggatggagagaagttggtgggggtggccctccaaaagagagcagtgcatgagaagaggccaacaggaaggaaaactcaaaatgggtttggggaacaataagagtaacaaacttagaagaatgaaaaggtagagatacagcagcattagttggagataagattgttaggactgtttgaggccaaattatgggtatcttaaatatcagatattattttagggagacaagttagatcagggtgagaggagctctgtctagacataagtttgaagtgaagtagcacatttatgttacatggaagtggatagtggaattcaggactgagggctgggttagagagatcagggagtgagagtgatgcagctgactgactccttgtgcaaagaggagtgtaaagtttagatcttggtaaggtacccatatttagagagatggagaaccagtgaaggaagtaaggcacagtcccagaagtaagagaacaaggagagttgttagtgatgtcaagggagaagagtgcttcaagaaagatggagtgggtgagcccactgtcagaggctgcagagataccaagaatgaaggcagagaaaagccatgggactgctgagcatagcacaaccctatcttcatatttgaatgaaatgtcaaagccaaaacatccaaaagagtagtggcagaaagaggggaaagggttattaacagaaccttggccacttaccactgaaatagtttccatgtttcctttaagggaaagcattatagcagaaccacatccaactctagccccatagaaactattttgagacacacaaaacctaaaagctatttttgtcttgatctgggtagaatttatctataggtatatctgtcttaagaaaaaaatgcaattgacgttagctagttagttgacagaatattcacagaacagattattcacagaatattcttccttttgtaagatttaccatggaattgtttttatctgcctctcgaatgcctttaaaatcttcttctgttttccaaaaactgatatatacgtttttcaaaaacagtttaaataggtgtgaaaacagcatatgcataaggttaatatatgcacacacacaaataagtaccatacttggacttgtttagttgtccaagtttaccagtgtctttgaaatcaggttctttataatatttaaatcttacagggctaaagaggacaggtcataaaatctaaaagtttattaggaccttaaagttgaaaaactaccccagaaaggataaataaaatatccaaagtcataaacagaacgtggcagagcaggagccacactatttgaacgtttctctactgggctgactccatgtttttacttgtaaataacctgcatgatagtggctttatttctaagaatactctcttaggaaaatgcaattgtgtgttgctgaatgccatagagcttgatggaacagggagttttacattgtatagaaatctagggatttgacttcaacagatatttattgagtggcttccctgtgagtaaagaggaagatactgaaaatggagggctcagcgaagtgggaggattgctactttttgtaaagccatttggggagtagataatggttatttgtttggaaagagatgacactctgcccttagtagtaatcgactcttataaatactgactgcataccactgttttggatgtattcaacccagcaagcataagctatgatgggactgacacaagggatggcaccagccattgtgtgatgaatgaaaatgaaaagttggggaaacattaaccatatgaaaccttaaaatatgccaaattcgtcatttcattggaagacagaaagtgaaatatctgtctgtcctttcttccctaattcttcaaaatctcagagaaattttatacttaagaccttaaagtttctcaacatctgtctcacagggagcttttccttggtgtttcaattagaaatgagatcactgattttgcttcaagcattgaaaaaaaaaaggttgaaaaacagattttttcttcaaaaatgtactttgtctatgttaagaattgaaaccaaacattttctattaggaacagtcggtattaattcattttaatgtccactaaattagcatagtttttataagaatcaactaatatcttcctgctgttttcactggccttcgcatcagtagaaatgaaaatcattttgggcatttaactgtgatgcagagtcaactcttttagaagctgacttcggattcctcccccaaaaagaggctgggactgaagcgccagcattctgtgttagattcctcaggcacatcacaactgcaggcactggcaaagcctgtcccttatcatatgcaatttatgtcaggctacaaatcctgctcttctggtggggctataaattctttggaccacatcctgcagccctctcagagccaaagtgaccatttaccccacagagagttggatctccacagacctcctagatgagacatctcaacatctggaagccagcggcaggagtcaacttatgagaaacagttcacattgctactgacccttgaagagcaccatctcccctacctctcattcctattcttcatgttacatgagagactcagccatcctttgatattccagagaagttcccaggaggattaggaattggtcatcagttgctccttctctctctctctatcggtacgtggaatgacttcaaatagagatcaactttatgcattaagacatacaaagctactgtttttctgtggcagagccaaatatggctcttattctaagtacaaaggaaaagtctctctaaaagagactcaagtcatgtgctgatttcactcaggtcacttctcccttgagccctcctccataattgtgttcagttctggctttgtttggaaagtcagcacaatttacaaaaggttcagaatgcattaaaggtcaaaaaatagggctttgtaaagaaacctatgtccttttgcaatacattttaaacttatacataatcccaagcagtaatcaattttaattctagcatttttttgtttatggtactttgtagaaaatccagatttttatccctgccttctcccccaaccttaggggaatgtatttgaattatttttgcactcacaacctcccataagcccagtgcaatacattctcatttgtcttttattaatccttactgtgtaaataaatgatcattcttaagattgggatttatataccttttcctaaggggcaatcataagttagtgctaaacaaatcaagttgttagatattgaccttcatgcagtggacctagcttctgtgatatgaagatatcaattgagctctgagtaatagaattttaaaagacaattgaagcattactataataaagttatagatggaactgaatcggtactacctgagtgggaagcccttgtaggagttttattttctattttatacattcccagaattgatacattgaagtctcatgcatatgatactgagctaatcttagccagatgggaatatattgtggaaacacctagcagcttacccctaattcacttacctaccttcatttgaaaattcttaagatttcccagtccaatatgggaccctcctagtataggaatgtcctactgaatatgcctgatgaacccaatggggtacagaattgcagtaagaaatttatatcattgttgtcattgacagtgatgagtccaccatgtttagtgtttggccaggtgctgtgaggatgccgaaagttaccctccttacttttaaagtgcttataaatatcaggaccagaggagcttatggttcagagggtgcagtcttgcaactcttcatacaatggcttctgtcatacaatcaaatattaaagaaagcatataaaccaacagcatatttattcatagatcacaaatgtttttcagctttgtgatctcaagagtttttctagacaattacgaataccccatctttattatgagcaggggataaattacttgcaatccagatattgctccagagagacatatcaggaatttccaatttacataaaagttgttttccagaagtttactttcacatcatttattttaaacttgggttgcagtttcccagagaaaaagtggtatgtagtaataatagccaacattttaacaaacgttttttgtttactgagcactctatagagaatgatgtggcaccaggctttctgagccagccagcacttcacatccaggttctgcccttggacacattacttgacctcactaactgatggtgaattttttaaatggggataaccatccctgcctcctagggttggtgtgtgtctccagtgctaggcacgtgataagtgccctatggcttcgtgatgaggagaaggcggaggagcagtgctaaaaccagccatcttagctggtctcatgacagccccatctccagttccccatttgcccacctgccactgctgttcccctgccagccacttgcaatggacataggtgaagagaaacatcccctgcaataagtaaaacattgttcttgttttaaaagttctggtttgtaaagtaaccagaattgatttgattttattctgctatgaaagataatttattgagctcatactctgaaccaggcactgtgcccatttaattctcacaatgaccccacaagctagtagccggctgagctggggttccaagccagttcgatctaactgtgactctagccctttttgtcatgtaccattctgccacttgggacagtgtttttagtgtggttaactttttctgaacttgctttaatctagtggtaggagagatgactgaattagaaaataaattaggtcatacacctctccttatctctgtcaaatctaaatctttgccccatccaaccatctgtaaaattattcttgttgaaagctttctgcaaaccactggggtagaggagttattttctataatgtatgaggggaatctattgagttagcatgaaatcaagtttgaagtcagatattcttaaatatattcttaaatatgtatttaaaaccttaactgatgattcagatcctaaaggccctggatgttacagctgcagtaaggtataaaagtgaataaagtcctcagaaggaaaatatagccacagatttttttttttaagtcacattgaaggtcagggtccttttatgtgttacatgcctgaagtagtgtaaagagcagggacagacacaggttctaacctggctctgcaggtaacttgctctgtggccttgagtgttacttaaaaccagtcttcccatgtgtaagtggactgtgccaggtctagacggtcccctttccttcagtatcaaaacttttagaattgaaggatgggcaagagtggggaatcgcttagattttttgaattaggggtatggaggagagcggggaaaaaagaagctgggagaaatttgatggattacttgtgtaagaccaaagatttaaacacatgacactcaaagtacatttgcaactagggctatctagaacgcttaacttgtcatactatttggaaatacatagtatttccaaaatactatggaaatacatactatttggaaatacatagtatttccaaaatactatggaaatacatactagttggaaatacatagtatttccaaaaagttcagtttcatgttttcagagaaaagacagcagaaaaaaaaacggagaaactaaagaagtaatgaatttcttatgacaaataacttctaagtaatttccaaaagctataggcaaccttgcctttctggtacctttcattctttcggcctttttatctctgtgaaaatcaacttttctaaaaatagcttaatgaggaagaagaaaatggtaaaattgtgcatttcatcacatcacagtccagatatgaaatccatttaactcaagtatttaaaagattatcatttgcacagaaataaagtcagacactttaaaattcgaaataaatgtttttgcgctccttttccccacccctccagtccctgcatattatattcttgatgcctcactgaaccacttaaaaatggtgaagtcaaaacgctagtaaagttcttcactacagtatatactagcagccaaatcactagaatgcccattcatttcttgtgaaatgctacgttaataatttcttaaactgtcacttcatactaaagttagcgcttccacagctttaagcccacttgggttagcaaacatgatggttctttttaatgcccgaatgaataagctgacccatggagaagttgagaaccaatatagtcctggtctgggctttcctgccctggtttctgtgaatactggctctcaagagtcactccctaattctggggccagggaatcctcacatcaggtacagagcgtgatatgatgtctgtagctacttcagcagagccaccacacacagcaatttgctgatgccaggccaagccttaaatacttaaaacacagctgtggctttggccattgtgagcccaggtggggacagagtaggggagcagcgcctttgaggagagccacacagatggcttctaatccagatgcagaggtcagctgaagggtgtggaagagtgttgataaacatcctgggactgggatgcatgctgccctattgaggaaatgtaagagagacagcaaaggcagggagatgaagcatttggggactcggaatggagagtgctggataatggattttagagctagtgggtggtttttatgagttctattcctgggccagttctaaatgcatgaatgccagagcacatgtgctggacagtctacccaaaccacacagacatctggaacttcagggcagtggtgaatcccagcagtgacatgcctacttttaaaacactcaagttcaataggaccccacaaagttctttgctgttcaagtatttgatgctctgtacatattaagaacatagaaccatctcctcattacacctttcagttcccaagaaagtgtgtctttgtcttctcatggacttaagtgtaatcactttactggataattatagaagggaacagaagacacaggacagagtttagaacttgctgatgttcccacagctcatgatacttgagaaaagacctagatattttttcactttttattggccacttcaattctttgtattgctgagtctctgaaggcttgatttttgcctatggataagaaagttttggggtctgatttttagttttaaaacgtttattgtctattcatagataacttgttttatctgcttgttacagtgccgccttctgttgaagtttcttttgacagctattggtccctatgtttacctcatgtgaataaaggaaaacatcctggatgtacagcaaagtttttgagtaaaagagtgagatattagatcattgctagctgcttactcttatttcagaaataaaaatttgaactatctcttctcaatggtaaatatttggggaattaaatatacatcattacaaaatttttgctattgtttattgaacacctacctgttatagaagtcacttgtttacatgtgtttgaaataacatacaatatcaatgtgtattaaggtttgtgtaagaaattcgcaattcagtttactactaaaattttgcataaagactttcttaggggacaaatgtagagattaaagtaaattttttaaaaaatccacctgtggtatttattgaatgtagagttgacagcactgaaataggcaaattggactaacgtaaatctgccaaatataacttcaaccaagtgtttttttgcttttaactttctcatttgatagaattcttttaccaaaaattggctacgaatgagaggactgagaattgatgtcgaaacgtttttctcttaatatttcttgatccgttaaaaacaaattatggctcctggaagtcagacaaaatttccatcaggatttgtaaactggttgggatcaccttatgtgaaacttaaatgagagtgaaatgggcgagcatacttcactgacttagcgcttggtccagaatgaactgctggccccacacttgggcctgctaacgtgtgcccgttccctgggtgttctctgcagctggcctaagtgccaagcgatgtccacaagctgagctcactcctggaatacacgttcctggccgttccatctctgaaggtgtcacttctctttttccccccagggaccctctgaagctccagcaactccagaaccaaatccgactggagcaggaggccggcgctcggcagcctccgccagccccgcgcagcgcgccgccctcgccccccttcccgccgccgcccgccttccccgagctcgcggcctgcacgccgcccgcgtccccggagcccatgagcgcgctggcctcccgctccgcccccgccatgcagtcctccggctccttcaactacgcgcgccccaagcagttcatcgccgcgcagaacctcgggcccgcgtcgggccacggcacgccggcctccagccccagctcgtccagcctcccgtcgcccatgtccccgacgccgaggcagttcggccgcgcccccgtgccgcccttcgcgcagcccttcggcgctgagcccgaggccccgtggggctcctcctcgccgtcgcccccgcccccgccacccccggtcttcagccccacggctgccttcccggtgcccgacgtgttcccactgccgccgccaccaccgccgctcccgagcccgggacaggcgtcccactgctcgtcgcctgccacccgcttcggccacagccagacgcccgcggccttcctcagcgctctgctgccctcgcagccgccgccggcggccgtcaacgccctggggctgcccaagggtgtcacccccgcgtgagtaaccgccgcggtcctccacttccctgcccctccgcctcgggtcgccctgggactcccacatctccatacacgcgctcccatcagcctgcaacccagagcgccccagtaacatttcacacatttctctccgtgcgatgtaaaaattcttaacggcaatttgactcagtgattcttgcgtagccacttaacattatcaaaatcagaactttttcctctgaattaatatgagattctcatcaggaactattcaaaatctatgcagtgccctctcttaatcattatgggggggggggtgcttagctatcatttattgagcactgtgctaagcaactcacatgtattatttcatttgatacaacattcctaagaggtagcattgccccagttaaagtactgaggagtctaggagttaaataaattgcccagggtcacatagccactaaaccgagacacgaatccatgctctcaccaccaaactatgtgttttattataatatttcatgccagcattacaatggatgtgaaggagtttggttattaagtatatacttagtgtttttgaaaaaccttaattaacagatttaagaaataagcctttgtgtaaatctagtgattgactggaagggggcaaaagcatgtaaatgtctttatgttttgatgtagataaatgagggtgtatgcaacctagtggagaaattatgatgccagttttgtccctggcctgtgacctcgagatacattacatgcctcctctatctctttctgtttgcaggtgatctaatatgtctctctttacatcacagtgatgatgtggcagccctatgaggtctttaaaatggaaaatctttgaggataaataacacctacagaagtacagtaaaatcctcaaaaaaatacagtacaggtgttaggcatgtttggttgaagagtaaaatgagtaaatgctagtacttactcattttactgaagatttcaaaaatgaggaagtgctcacaaaggttaagccagcacccatatctcaactcttccttctgaaatcctacttcagagtttgccagaagcatactattgttcagagagaaaaagaaggaactctactaaacagtaaaaaggagaagatcttagaattcaagttattttcattcatctataaaagtgttccattgctaggatacactaatgccaccttaaaggcaagcattgctatgtcgggcctcgacaaaggtgtaccaggcagcttcagttagcaatgcttcttttgttgggcacttcctaaatgttgattacattaatttgaaatgtggcttcttctcaaatccttattgggtgaaacacagtccaatgaatatataaagaaacaagtccaaaaaaggagccaaatatagtaatgatgtgataatggacttctgttgaaagttgtcagtcaacttgtctgaggagaacctttgtccttctcccttgttttttctctttgagcttttatttagctgttagaaaaggaagtgtattatcttggtacaaagaagctgttagagagacccaaagagccagagtttgttgcatgacactttttcatcctctctcattaaaagggtaccaagtcttgcttcccaggaagaggagtactgtgtaaataatctgttctaatatttctcttatagaatttgatcaaagattcgtttttcaaaggtggtgatgattgtgccatttatcatttgtagtagaaacagcagtttgtgctgatcagtgactttgaaaccttcttaagataagcaagttttaatggcttacctcaagtaacaggagcacttgcttcttgtcagcatctatcacagtgactcattttatggagtcaaaatagcttataattgttaccacaagagtccagtcgttcctgccatttcttaaaaattaatggagaagtcgtgccgattttgtggccatggaaaactgtacccaaagatagtgaagtgctgtgacatcaaagtggcaataccagactacagatttttagctccatgcctgctcagtaagccattattatgtggttaccgttttgtcctcaaggaattttcctgttgctaaatcacgcatacttgaagaattcattattttggtttgataaatgtgtcttttgaaacatgtttttcctctggcatactatgggatctgtcatttgcattctgaattaaaaacaaaaatgttactatttttgtttaccataataatccaaataatttgccaaagattgagtgtccctatcagggctgccatgactttggcatcctggaacttgcaggaactgccaagttatcataagatgtatatattcagtttcacttataagtgttatttctttagctggatagttttgccatatatatcaagtaccaacaaattggttgattatatgtaacacaatgaagtagaaattcattaggtttttttcacttgccttgttttaccaaaatcttaaatgtaaatttccaatatcttagttttcttttcttttcttttctttttttctgagacagtcttgttctgttgtccaggctggaatgcagtggtgcaattgcagctcactgccacctccgcctctgggttccaacaattcatgcctcagccacctaaatagctgggattacaggtgtgggccatcacgtccgtctagtttttgtatttttagtagagatggggtttcaccatgatggccaggctggtttcaaacttctgacctcaggtgatccgcctgccttggcctctcaaagtgctgggattacaggcctgagccactgtgtccagtctctcttagtttgcttaatcatacttgtatacttgctgttttattctgtttgtttcacactgttcttattttcatctgtagacaggaaggttagtaagtactaagtttctaaacagtctgtggagataaggttctgtttttcatatgtttgggtagcagaggtcaaagcagggaacaaaggtcatggatgtcagtgataaaccacaaagccgaggcaaaagacagtaaatctggggaagaaaggcatttgaggaactgtatgtatagaagttccccagaccgcagtcaaccaactgcatgctgttctgtgagccggagagaggttgactgcggtctggggaacttctatacatacagttcctcaaatgcctttcttcctttatgctacatcttccccaaatttactggggtcactggcaaaatattgccctgcacaaagctgtcaacagatacaaatattaagttgacaaactcttttagatggaggcagtaaggagagcatgccttagagagaaatctgtttgcacttttataaaattaatgtattctattcccctcactattgctggtaagttggtgttacagcctccattgctgtaaccatgtttctccacatagtaaatcagccctaagacacagaagaaacccagaagatttggcagtgccgacaggcatagtgtggcagttctgctctgctggtctctgagtggccatactaagtctgaagggtgaatcagatcagacccatccctggaaccagactggcactgtttcttttgccatcttcacattcttggaatctgtgctcataagggagtgccacatagccacagtgccacaatgttgtatgctcttaactacctcttttatataagcagggctttggtttgaaatgttgccccatgtttgtcacaaagaagagcatgtgtcaataagagcttttatacagatgtattaatgacagcttttattatataggcccacagctccttatggacattatctcattgtcgctctctttctccctcataggaaacgggtaggtggggacactatcatcgttactcaagaggtgacgggatttcccagggttctggaagaaatgcctgagcaaggagagcatagcgtgacttaggttcatctcaaataactctaatgtctaacatttcttgattaaagaaagctgttgtagaagcagcaaatcagaatccccgagtcaaggaaaactttgtaacaaatttaactgtactttaagattcatgacacagggcattttcaccagttttcaagtcaagactgtggttagatagtaaccagtgaaaaagaatccaacagatacaagccgcaatgtactttgcagacatctcatctacctatctttctcctatttttcaggaaacagatagtggggggcttttcattctctgacctgaaggggttggaggtgttattactgggctcattagggtccagtatcttatcaagttgtatccaatcctggacaagtatttaccaacaaattagtaggcaaggcctccaggatctgctgcgactgggttattctgttgaaatgtctctgcccctggggcagctcaaaatcagacctgtacggctgtgtaccaagttgtacagaatgaatgaacagaagtaacccgaagccagtggatcacgaggtcaggagatcgagatcatcctggccaacatggtgaaacaccatctctactaaaatacaaaaaattagccgggcatggtggtgtgcacctgtagtcccagctacttgggagggctgaggcaggggaatcgcttgaacacagtgggtgaggttgcagtgagctgagattgcgccattgcattccagcctggtgacagagcaaaactctgtctcaaaaaaaaaaaaaaaagtaacccacgtgcctttgtcattttcttttttaaagaacccaaaatataatatgaggagaatttgatattacaataaagttatctattttcctttaaatatgagcttaagttacccattttttgtactttaacagcctttgctttaccgtaaaattcagtaaaaggaaaacagaattgatatacaaaagctcagtttgtatatcttgggctcttttatatattaatacattacattcttgaatataagtgatatttaaatgccaacatgttaatgagtttgctcactctgaaattttgtggaatttagttaccatcagatttcactgaatgtgagaagagtagaataagaggacttgtaatagttaaattctctggttgattctggtaccttatctctttaatcaatattgtgctctggaaatttgagtttctgaaatctgctcacagaattgacctgcaatagcatatcaagggaaggatgctttcaagattattcagtagccaaaaaaagagacctcttgggatttggtggtgattgaatctggaaaattttaccttccagatgcttgtgtatatgtttgagatgtttttatcccaaccacatgaatattgtttttaaatgacaaatgacttactgttaaagccagagtaaacagatcagtaatgttttttgtacagttgggctgagtgtgtatacaatgaagtatttagtgcaggaggcctgttacaaattgtttattggttaaggtttgcctctgagtatggatttttgtgaagagttctggttttggtaactactaactttgaatactattttatttttttttaattgtgcaaaccatcaaaaaaaaaaaggagatcatgtctttgtcaccactctttttatttcctaatgagttgctactcttcatttatcaaaagaaggtgccacttcagggagcagaactacaaccatcttacattaaactctaacatagcattagttttataggaaaacaaactcagttgccaaatttttgcctcaaaacttataactgcttttctttcctcatgcctcccctttcaaaatactccacttttatttctaactctcaccttgcatgctacccctaaaccctgtcctcaacttttaatttcgtaaagtgtttctgaattacgttagtccagtgagatgctctgaaaaagagaagaggttccatattagaataagtgtgagaaaactgtattccatacctctttcctcagggttcacagtgcccatccgttggccctgccaggctggttctggtcacaggacctctgcactgccaagctctccctgtaggtctcacatagccagccacttcctatggtttaggccaccactgtagagtcacctcctcagaagtctgatggaccacactgtctgatacagtcatctgctcatacttctgtcctttcattgcgtttaccacctcctgatatgtcttgccttccattcttttctcttatctctttctgccatatccaccataaaaatacaatttttctaactattgtgacctagttcaacattgtatttctagcacctagaacagagttgaacactgagaaggcaatcagtaagggttatttgcacattcttgtaaattctggtcaagaattcttggcatctttttaaactccttcccctcttccattctgtttatctcagccaatcttgtctctgtgacttacttccatgctgaatattttctgtttgccacttcagatccactcttactacaccaggcgctgttctaagtgtttagtacacattagttcatgtagtttacccagtgatcgcatcagatacgagctgttaatacccacattttacaaaggaggaaactgagacatatggtcattaggtcactagcccaaaccacacagcttttaagtggttaaaacaaaacaaacaaacaaaaaaacaggttatcacgtctgtttctttattcacgctgactctgaatttcttcttcttctccactctacttgtctacatccttgtcatctttcaagggcttataacttgcctctttcatggagtcttctgcagtcattctagccagcactgttttctgtttcttttttattcccattgcatctagaattggtaccacatggtttgctccttaacttattccccaacttggttattagcctttgtgatcaaggaccatcctttaggatgtgggggggtctttgccatctcacttaaataatgttgagtgcttgctttggcagtgtgaatactaaaattgcaatgatacagagaagattagcatggcctctgtgcaaggatgacacacaaagtcatgaagtactctgtatttttaaaccatatagcctctatgaaactgccatttttgtaagttaaaaatgttcaaatattaatcgttgtaaataattgcccactggaatgttttcttattccccctcaagtttcaatttcaagcactgactgctaagattggcatgtctccagccacgtacatttgcaaaaagtcagatttgcaatgtaatatgtcatggagctcatgcttgttgaagagaatctttgataggctggacacattcattttagtaggaggcagaggtggcctaacagcaaactctaggttcaggatctaattttcatagccttcaaggatgaatgcaatataaactgtgtagtagattgtgatgctcattccaactagggaggcaagcatttgtacctgctatctacaaggcaccaaataatgcatgtgtcaccattgctataaattgtcctcttccaggacctaactatttgggtaaagaacctacagttcccatcaccacctatgtatgtatgtacaaacataaattagtccaaattctaattttctcttatttttctttgtggaaaaacagataagaaagctcagtaaaggaagatataagcaattaatgttacagttcttcaatataataatttgaattaaatgtactaagaagcaaaaactattagtgttgagactatcatgatgaagcttttggtttttttaatatattttcatttttatgcataaaatcttaatacatagaattccatgatgtcatcaggcattaacaatcacttaccttagaaaccaactctttttttctaggcttaacagggtttgtattaatgtattggcctagcactgggccctgctagatgctcaataaatatttgtctaatcactattagacattttaaaatatcttttggctgggaacagtggctcacacctgtaattccagctctttgaaaggccaaagcaggaagatcccttgagcccaggagtttgagaccagcctgggcaacatagggagaacctgtccctacaaaaaatggaaatttagccaggcacagtggtatgcacttatggtccctgctacttggaggatgactcaggaggattgcttgagcctcctaggatgtcaaggctgcagggagctgtgatcacaccactgcattccagcctgggtgacagagcaaaacccagtctataaaaagaaaaaacatatttcagtttatttttatttctgtgttaattgtttagaaccaagaaaatatgagtaccttaaattctgtaagtaaagaggaaaatgtctttaacattgtaggaaattaggaattaagtaactgcccttcatactggtaatcttgatatgttgaaggaagtgacttgttataagatagaggccaggtatggtggctcatgcctgtaatcccagcactttgggaggccgaggcgggcggatcacgaggtcaggagttcgagaccagcctgaccaacatggtgaaaccccatctctactaaaaatacaaaaattagccaggcgtggtggctcatgcctgtaatcctagctactcaggaggctgaggcaggagaactgcttgaacctgggaggcagaggttgcagtgagccgagatggtgccactgcactccagcctaggcaacagagtgagactctgtctcaaaaaaaaaaaaaaaagaaaaagaaaaagtagaataatcagtttttacttgagccaaagactaattgtaattataccctttgaaaggataaattacccttgtggcagggacacaaaccaaggtgacaactctatggaatgttccagagcagttgttctaagtccctttaagagtcaaatatactgagaaatgcttcccaaggaacaggacttattctacagtgaatagacaggtattttcttgtccaagggaacttgtggctgacttttaaaaaccagttctccgctcctccgattgagatgacctgttctgaccttgatggtctccctgtctcccctttctttttcatttgtgctgagaacacagctcttagtgtagtctacctgcagaaacacagtggtgccttctgtcattgaaggctgctcatcagcacatagttgttctatggtctacatcgcacaggcttagagtaataatgggaatgtgtgtgttcccagtccttgctgatgtaacagagagctggctgccttcagtttacctttaagatgacttcaaaacctagctcttctagttctcagatgtaaggctgtagtgaaatgcagagaacttcacttccaaaattgtataatttttacttgtcctgggcctgactttttacatagggtctgatttcacatggctctggcacaagttttcttgactgaggaagggaggggagagagaaatcagaagtagagatggacagtacatccattcactcatttcagaaatattatttgagtgtctgttaacagcactgtgattaacaaaggagccatggtaagggagagacaatatgaaaaaatagtagagtgatagatgctatcaggaaaacaactaatgggacaagcttagtcagggacatcctttccaaggagtcattaagctgaagactgatgataacaaccccagataaaggagtaggaggggagagaggttccaggcttgggaaaactagcaaactatgcacgtgtttgttaaaggattccatggtactagaaattgaagttataaataattcctatggttcttactgtctcagggtctccttaaatatcaaaatgagtttgtaaagtctagtgttaccttatttgaacttcagggcaaatgactaaaagggacaaacctagaatagcaggttttaatcagttagcatattttccactgtaggtatcagaagactcaactacaaggagattcgatgcacagggtttactgacttatgaaacaagtctggggtagggtagttccatggtaggttaagacagtgcccccaaaacattatcagggcccaggtattctccatcttttcagtctatcatcattggcacatatgggttctcctcttacagttatggagtgaacaatgccgcttttgacattgcatttctgacacagtgatatccagtgaaagaagaggggcatttcttccttctgtttcttttcagagatgagagaattttaactagagcacctccaccctctgactaccccccactcctccagtctcattggcccaggctatatcgcatgcctttggccaaactaatcactctcgaggggattgagaccatttaaattggcgtacattaattaccccctgagtctggggagggggatcacatttctataagcacattgaagggtgaacactcagcaaaattaggaaaaaattcagcaaggaaacaaaggggagtggccaagaggaaagaacagctgttgggaagaccaggagcacaggcctcaggagtgcatggcatcatgacttaggagggacggtggcagagtctttacaggatcctcagagtttctgctgcatacttagtgactgttttgttcccagcactggtgggtgaaaccgtgaacccagtgtttaggtacattcttagccttacttgtgctttctactgtatcagtgaagtgacatgaggcacacagtgccttgacgctttggcagtaaagttttgtttgtttgctttattttgtgtgtgtgtgtgtgtgtgtgtgtgtggtttttttttttttttagacggagtcttgctctgtcgcccaggctggagtgcagtggtgcgacctcggctcactgcaacctctgcctccagtgttcaagcaattctcataccccaacctcccaagtagctgggactacaggcgcccaccaccacacccagctaatttttgtatttttagtagagacggggttttaccatgttggccaagctggtctccaactcctgacctcaggggattcacccaccttggtctcccaaagtgctgggaatacaggcgtgagccaccacacccggcctgcagtcaactttttaaactttgaaatatcttatcatgaactatgtaatataaataaggaagtatatacaatttatacgtatacctcaataaaatgaaattcttatccatttctagtacctttgaagcccccatttgaccctccccaattgcatccactactctccctgagaggtaactgctaccctgaatttctgagttaatgattctcttctcttcatggttttaccatgtatgtatgctcccctcagtttctttctaaaacttttgcatgtaacacctagagaacttgttaaaacacagattgctgggccccaactctgaatttgtgattcagtaggtctggagtgatgccaaaaatctgcatttctaacaacttcaggtcatgctaatgctgctggtccagggaccacaccttgagaaccactgctgtagcagggggctgttttgcttttgcctgtttataaatacaagtatatcatatatattcttctgtgacttgctttttttcaccggaactttgtttttgaagttcagctttgttgatatgggtagcgataggtcaattcatttccccattgcttagtattctatttctcattaatttttgtccactgccctatgagggaagaggaagaaaaataggaagcaacttgcttaaggcaccaacagaagtgattctgtacccctcaagcatccagcaccaatgacccttggctcacacagctcaggtcattgttgctgcctttggaaggaaagaggcagtgagatatcacctgtcctaagagccctggcctcaccagaagttcaggaggctttgagacaccaggcacagcaggacctgcagacctcccagagccctcttgtataaaatagacctcaaataacattggcctaccctaatcaaatcaggatataaggggatggaagggaaggtaacaaacttaatattgatttcaaatgggctaggcactattgttgaataatgattacaaagcactagaagactgaataaaagtatgataaaaatacgttctctttcaacctctcaacattcatatgtggtatatatttttttaaaacttgcccaaggtcacaaacttaatacgagatagagtcagattttaaacctagctctacttataaatcatatcattctttcactttatgctgccgcctcgctaagacttaaatgtaggccttccccatccttggcatctacctacccactaaggcatactcccctaatgtatgtgaaccttctctgaaacctggatccaattagtgttacctgaaccagctttcatggttctttccatcatagttgcaacagatgtagcataaaaaatagtgggagtgacatgctgataccttgcactgtctttgttggacttgaacgtttgacttggatttatatgcctgacaactaactatactgccttgtgtttttatcctgcagaggatttccaaagaaggccagtagaactgctagaatagcctccgatgaggaaattcaaggcacaaaggatgctgttattcaagacctggaacgaaaacttcgcttcaaggaggacctcctgaacaatggccagccggtactgatagatttgggacctggacttggaatgttagctacccacatacctttcttcctttctctaagacttaggttcttgatatttgtccacaacatcatcattattattattattatttttgagacagggtcacactttgtcacccatgctggagtgcaatggtgtcatcacagctcactgcatccttgacctcccaggctcaaacaatcctgtgacctcaacctcctgggtagctggaaccacaggcacatgccaccatgcctggctaattttttatttttgtaaagacagagtctccctatgttgcttaggctggtttcaaactccagagctcaggcgatctgcccgccttggcctcccaaagtgctggaattacagatgtgagccactgcacacagccacattattttattacccttgaatctcaacatttctcttgatattaggatttgaatccaaagacaaaagagaaaacgaaaggccttccttctattcagtcttcactgctttctcctatgcaaaaaacctttctaagagtgaagagagtaagtgggaaagaaaggaagaaggaagggcagatatctggttgggagaggaacaaatgagcaatgccaatggtattaaaaaaaaaaaaaaaggaacacagggattccattctggctgatagggttggggagggatggagaaggtgcgctttggaatggtttgtatctacccagaaacagcgaactgcaatgaaagtatcaaaaagagaatttgttttccatggtatgtactacttacacacgcacacaaatctactagagaaaccattggggaagttctgttcttttctcccagactactactagatattaattcagcatctgaaagagtaaaggctgttccaaaatcttgttctggtttgttagagcaagataactaaactgtaggaaaaaataattattttacagctgcagaactgtagagtacctaaatagatttggtaaaatatatagataagatgttttctccactggatttaagtctttcctcatcagtttttgtttgttttttcatctcttttgttgatgctatccttttaaaatactcttttctttttaaaatactatttccagaatattttaaggggatgggaaaagcaaatctagaaaataagacttaccaggtaaaggagaggaaccttctgtagctttattaaggaattgtcactggaaaaatttgcctggctcttaagtacaagacaaggatctttttgtataaaatctccctttcagacacctttttcagagtagaaagctctctataattatgttttctgagaattttaattatcaaacattgataagtaaaactgtgagaacagaccacacttgaaagctggagagcagaggaggggtgctgaatgctgattttagtttattagggtatcttaatctgattaagaaagattaaaatttcaatgaagttttgtgttagttactcatttcactgagtatagaagattttcacaagaggaaaatattttctccctgaaataagtgattgcatgtgtaaatgtacatactctggaagttttccctggctctgtcaactaaatcttttaaaagattaaaataaatacatatgggaactttttcaagccaggtaaggcatcactccagcttttttttttttctttttggctgtctatgtcaatgttccttatgaactaagattctcttggttaaggtaagacttccttaagctattggtcaacccacattatatatattgtatgtatatttatattcatctgtttagcagtgaataacattcacagtaagttccacaggtatccacacttgagagcttaaaatgacaagtaaggtttccctttttagaaaatgggattctcaaccaactttttcctaatattatatatcattctctttcttatctttggtgtctgtagacacgggcttttatagccagatggcatagtgacttagaaaaaaaactgtgaagtatatttggcttctagtggtagcaggtgcattctggtgaaggaatagatatgaaattgatatttctgcttataaggaacagagtgaaaatcactccaggcctgcctttgatgtgttacaattctccgtgaaaagattagggaagctttttaagagatcaggtatttaagactctctttgaaaattgaattcactgattttttaataggtgtgagaaaattaatttaataacatagtggactcagatgcttcatgccgccctcagactcctacctctgcctcttcttgtcctctgacctttctttattaagtgaaataatttgaactgcaggactatttgtcatttggcacttgacttgtttcacttcccggtttcagctgggattgagatcagcaattactggaaattgtaaatttacccaacatattttcctgattagagagcttccaatcaaatttgcatttatatttagaagtttggaagtttatctgaaataatttctgtacattttttagattctgccttaccaattattctctatttctaatcaaacacttgcttataaaatgctcccgatgaggcaggtggtatctgaaagttccttccaaacctgtaagtctaaggcactttagaatgagtattcaagagcaggtatcaccccaacagtcacacaaaaatgccggcatttcttatgtataagaatggcataggtaaaacggtttgggccaattccaaagtgctagctgcgagatgcaagaacactaccactttctttgcctgatgggcaagcagtctgcttctgggtcaagtcaattgaggctgttagctttggcaagtgtcttgtgtaatcctgttgctaattcagccatgtgcatcattctctgtggattataatagttgccgccaatcccctacattacacagcagcctgggaaatgctcttagaggtaagaaccccatcactgccagctcatccacatcttcctttagctaaacatttactgagcacatactgttaaatgactgatagaattatttccattagcgatacctgttctttttttagtcagtttattctccttttgagtatctttgttttttctttcagtcagtattagagctgacttgggtgttctgaagctgatggatggctataaaaataacatttcttttaaattgtattttgctgtttaaatatctttttttccatgtttttcattaaggacatgacaaatcttttctgtgtggtttcttccttgtcgcttattgctcactttaaatttgtgctgtaccaattggtggctctctggattaggccattagtactagaaagggaggtaaaaaggtagaacaactgaagcaagaaaaagaaatatgcaggtatctgaagctggagagagaacacttacagaaaatcatgaaagtgtgttgttttttactctttttcatagggcagtacatatttgtgatttttttctaattttgtattttttgtgacttacgttgtttagaggttaacatacgaagaaagaatggctcgtcgactgctaggtgctgacagtgcaactgtctttaatattcaggagccagaagaggaaacagctaatcaggtaccatgttgctctggacttcttagggtaacatttattctgtcccccttttccatcttccttatggatactgttcttgggatgagttctgtggaaagtagagggcaagtcacagaaaagcagtattaatatcatcagtcaacctcacagctaatttttattgagcacatactatgttaagtgactgacagaattctttccatcagtgatacctgttctttttattcttcttcttgattattctcctttccagtacatttccattttcctatcctaagttttatgcaaaataattttgtgtggagaaacacattttcgccgacattgtctgaaataactagtgaatatttcccattagagttggaccttgaacaacacgggagttagggggaccaaccccaagcacagttaaaaacccacatatggccgggcacagtggctcatgcctgtaattgtagcactttgggaggctgaggtgggtggatcacgaggtcaggagatcgagaccatcgtggccaacatggtgaaaccccgtctctactaaaaatacaaaaattagccaggtgtggtgacgcacacctgtagtcccagctactcgggaagctgaggcaggagaattgcttgaacccgggaggtggaggttgcagtgagctgaggttgtaccactgcactccagcctggcagcagagtgagacttcgtctccaaaacaaaacaaaactaaaaacacatatacgacttttgactcttcaaaaacttaactaacagcctactgttgaccagaagccttactgataacaaagagttgattaacacgtattctgtatgttatatgtattatagactgtagtcttaaagtaagctagagaaaagaaaatgttacaaagaacatcttaaggaatagaagatacatttacaattcattaagtggaagtgggtcatcataaaggtcttcatcctcattgtcttaaattagagtggtctgaagagaagaagacaaggggttggtcttgcttatctcaggggttgcagaagcggaagaaaatccatatataagtggacccatgcagttcaaacctgtgttgttcaaagatcaactgtttagtcttaatatctagtcaaaataaaatagaaaatattatctctttatcttctttcacatatatacagatgttcttcaacttagtatggggttatgtcctgataaactcattataagttgaaaatattgtaagttgaaagtgcatttaaggcggggcgcagtggcttacgcctgtgatcccagcactttgggaggccaagaccgggtggattacctgaggtcaggagttcaagaccagcctgaccaacatggtgaaaccccgtctctactgaaaatacaaaaattagccgggtgtggtggcgtgcgcctgtagtcccagctacgcgggaggctgagacatgagaatcgcttgaacccaggagacagaggttacagtgagccaagatcgtgccactgcactccagccaggtgacagagcgagactccatctcaaaaaaaaaaaaaaaagtgcatttaatacacctaacctactgaacatcttaggttagcctagtctatcttaaatgtgctcacaacacttacattagcttacagttgggcaaaatcatctaacacaaagcctatttaaaataaagtattgaatatctcatgtgatttatggagtcctgtaccaaaagtgagaagcagaatggttgtgtgagtactcacagcaccgttactaccaaacgcatattgctagcacaaaagtttcacttaaggaaaattagaaatcttgctgcattcttattatttctattattagtcttcacatctttttttctaccattacaggacattggttctcctcatgcttctgtagggagtcctctggatggtcaaaaggttaagcttttcacctttcttctccttccagtctttctctgtgtctgttttcttctgttcttcctgttttacgtgtgtttctatcttttctgccatatattaattataaatgctatgaccagtgtctgtttcatttaatatcagatacacaaaattactgcaacatgagttttcttgtcatgtatttaccagcttgaatttatttatttatttttactttatgtatttatttatttatttatttattttgagatggagtttcgctcttgttgcccaggctggagtgcaatggtgtgatcttggctcactgcaacctctgtctcctgggttcaagcgattctcctgcctcagcctcccaagtagctgggattacaagtgcatgccaacatgcctggctaattttgtatttttagcagagatggggtttcaccatgttggtcaggctggtctcgaacttctgacctcaggtgatccacccgccttggcttcccaaagcgctgggaatacggcatgagccacagtgcctggcctctgacttgaatttaattctgtcattagtggatactctgaacattaaatcaagaaaaatttttcatttgttatatatacctttctatggggaacaaaagtgctaattcttcaagggattaatttgatagtaattagatgaagcaaaacaacttgtggtataactcttgcagttttattcatactgttgtatttcttccctcaaaccaacaaacttgttttttaaacactgagtaacttctttaagagaaaacatagttaaagttatctttcatttaatattaaatagggaatatttacatagactcccttgtcttcattgcacttttttgttttggagacagggtctcactcttttgcccaggcttgagtgcagtggcacaatcacggcccactgcagcctcgacttcccaggctcaagtgatcctcccacctcagcctcccaagtagctgggacaacaggcatgtaccaccatgcccagctactgttctttttaaattttttgtagagatggggtctcactttgttgcccaagctggtctcaaactcctggccagaagcaatcctcccacctcggccttccaaagtgttgggaattacaggcatgagccactgtacctggcctttaatgcactttgtaggcaaggaaattgtaggatccaccgtaatcaccacaggaatgttgatgggttgttttttttttttaaagcaaaattttggctagactgtcagtcctattttttcttctaaagatggtgggttcctaacagctgcagagctgaggaggcggcccttgcaaggcagggattgttagaggtgggggaaaaaaaacaaacatttttttttttctattattcttttactattttttctattaccattttttctagtaccattttttctattattcttttactataattgtatataatatggcagctgcttgccacatgtactatgtggagagatgtaccaccctgcatcagcttttaccctacagaaggaaatcagcgttccattatattttattgttatcaacagtttaggaatacatagctttgcttttgcctttttctttccttccccttgtttcccctcgcctcagagaaaagaaggaaaaaaaaattcatctttcctacccccctctttttggatgataggacttgaagacaatctgaaataccacataaactcacttccagatgttttttgtttcatatgcaattgaattgggctcagactgtgtttttaagctgtatggtaaaaatatcactgtcttctagggccttattggggggcagggagagacgtgacactttgtcagaagggattgagtctgctaacttaaactttccttgattcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaaggtgagctgggagatggaggctttttaagagtcattctctgaggaaaggtttagcttccaaaacatagcatgccagtaggagaaagagatacaaatgatctttctcaatacccacgatataaagggttttaaatattcttaagttctgggccatcttcaggaggcattagaaaccaaaaaaggtggtggggggagtggagtttgggtttgaagaatagagaataactaacagggagctcttcacacacctatatcatttattcctcgttgttattcccaaatcacaaataactaaactgagttctgtgaagtgagtttccaaggtcagagagctggtgagtggccaggcctgcatatgaacccagtgctctgtaccatacagacaagtaatgctcaccactggttgtaaaaacttccaatctttaatcaaaaaaccaaggctgcttatattaatatttacagagggaggtggggtgaagaatattgtttagaacggataatgacaaattctgataccatgcaggactaggatgacctggatgggagctctctccatacaaacatatggaaatgctggataaggagctgccctatctttaaaggaaggactagaataactgtttactagcccagcaaggcagtaaacaggagtacacttttccctagagcttgagtgaaaagaataaaaaaaagggaaaaaattaaaacccctaaactacactatcacatgatagggagccaaaagctgagaaatgtgaaatttagtgctggatgattaaaattcttagaagcaagcaaaaagttgccttatataaaggtaataatatgtgaagaaataaccatgaggagagttgtgttaggccgtttttgcataaagggattcctgagactgggtaatttataaagaaaataggttttattggccaagcatggtggctcacgcctgtaatcccagcattttgcgaggccgagatgggtggatcacctgagctcaggagttcgagaccagcctggccaacatggtgaaaccccatctctactaaaaatacaaaaattagctgggcatggtggtgggcgcctgtaatctcagctacttgggaggctgaggcaggagaattgctggaacccaggaggtggaggttgcagtgaccaagatcgcgccattgcactccagctcagggcaacaacagtgagactccgtctcaaaaaaaaaaaaaagaaaagaaaataggctttactggctcacagttctgcatggtatacagaagtgtagtaccagaatcttctcctggtgcggcctcaggaagcttacaatcatggtgaaggcgaaggcgaaaaaggtgaatcacacagcaagagtaggagcaacagagagaagtggtggaggtcccagacttttaaacaaccagatctcatgtgaactaattgagcaagaactcacttaccaccaaggggatggtgctaaaccattcatgagggatccaccccatgatcccgtcacctcccgccaggccccacctccaacactgggagtcccatttcagcatgagatttggaggggacagacatccaaaccatattaagagtcatagtacaagaaacagaaaaacagaaggccaagtattgcacaatattgaacaatcttaagtaacctctaaaataactttaaaaagattgaaacaattttaaaaagaatggaaactataatgaaagaacaagatagtaccaaaaaatacaaatttataaaataagcatagagcaatgtactcaatgaaataaaaagcttaatagtggcataaaatgaaagagggaaaagtgataaaaaaatacctgacacttttaggtgttaatttcctatagctccatggcattgttttgttttcccaccatggcaagttttaccatcatgttcttttcttaaaactgaatcgcaacgccaaagtcaaagatcaaagaaaagagccttgaattttcaaaccctatatacttcctaataaaatgggatttttaaaataaactccattgttatagaaaactttttacaatattcttggcataatctgcattaacaactgtgtattcacaacatgttatcaaacgcatgtattaaaaataaatttgtagtttatgaacgaaattcaataaggaattatatcttgaacttccaagatattcacaagaagattccatattactttcaaaccttacacaaggcttaagatcactgatcaaattctaagattattgattcttatagaatactacattaacatgaaagatgggcttttgtttttaatatgactgtacttttttcctaatataaatttaaatgtttcacagctagaagggacttaattgtttaaacttttcattgttaaatgttattctttcatccctccttcctctccctcaaccttcattctccttctcattgttttcttccctctctcatttattaaaggtctactttggcatatgccatataaattacattaggattgttaaagtatggaatattcatgtttaaagaaatacatgtttttttaggcttatgttttaaaaatattttattcctcccttgacatgcttgttctagttgagccataggaagactgaaaataatttctgatttaccctgttctcgtgcttgtgccctcccgaatttctccctccattagtacgcttggtaaaattttggaaatatttcttagatcttatttgaaagttgtatgccaagtataatggaggtgaaaaatatgattaaagaaataactcaagaactggcattgtggcaagaatgcaaaagggaagaaattgtatacttattacagcttcttttttccatcagaaatagtcaaccatagccaggcacagtggctcacacctggaatcccagcactttgggaggctgaggcaggcagatctcttgaggtcaggagtttaagaacagcctggccaatattgtgaaaccccatctctactaaaaatacaaacattagctgagcatggaggcgcacacctgtaatcccagctactcaggaggctgaggcaagagattcacttgaacccgggaggcagaaattgcagtgagccaagatcacaccactgcactctctagcctgggggacagagctagactcatctaaaaaaagaaagtcaactactaaaaagtaaaataattatgaagtatgatactttacataatttaagttttacaactcaaagttattagtctagttggtgattactttttagattctagagtttaatacgtaatatagtttctgtaaatttggagctacctgaaaaatacgagtttgaaaagttagagcagtcatatcctgataattcatccatttatttagtgctatatatttctggtcttttcctttcttagaatgcaggtttcaaaaagatttttcagattcaaatactttgacagacagttgaatttgaatgtcagtttatgttaccaatttacatactgatttatattaaggaagaagtttgttttaacaactaaagggtctaaagtatatttgttttgttaggaatcaggaatacttttggctgcaaggaacaaaaaatgacaacaaataacttgctgtggcttaaaaaaggaaaggtttatttgcttatctagtaagtctgcaggtggggtgatgtagctattaattcagcatctcagccatgttagggctgttggcactgtgattcattatgatgggcctatctttcaactgtgttgttcataacttaaatcgaaaataataatgaacttagccaggcatggtggctcacacttgtaatcccagctactctggaggctgaggcacgagaattgtttgaacctgggaggcggaggttacagtgagccaagactgcaccaccgcactctgcactccagcctgggcaacggagcgagaccctgtctccaaaacaaaacaaaaccttagaactcggacatccatggacaactggttttgtttaaaagtgagggaaggaaggaggaccctttggactacttaaaaatattgtatttaatcaaaatttacttttattttttacattgtttcttttgagacagggcctcagtcacctaggctggagtgcaatggcatgatcatggctcactacagcctcaacctcctgggctcaagcaatcctcctgactcagccttccaaatagctagggctatagacatgcaccaccacacccagataatttttttattttttgggtcttactatgttgcccaggctggtcttgaattcctgggcttgagcaatcctcctcagcctcccaaagtgctgggattataggtaggcatgagccactgtacctggcccacatttaattttttatcaacccaagttacatatctgaaaattattatacttttcaatactactgtgttttctttaacataatggggataggtgacaaacatttaacctttgatcatatgcttcctggcccagaaataaagcagtagtattccacccatcaccaacccttagtcatcacctccctccctaccaacctcttttatttgtcaaacacaattcagtgaaatgattagagtttggggtctgcttttgttctccaaaacaacctttttacctttattttataaacaatacattttaattgctggtacatttgaaaaaagaaaaatggccttcatagaaggccacttcatagaaataatggcattctatgaatgccatgaagtaatgccacttcatagaaataatcattgccaaaattcaatatatcccttcatataaataatatatgaatgtaagtgcaatatttttaaaaacaaaaggaagatatataatttaaaaactcaaatagaatttaaattgttacctgccttttttcagtgaaaaatcaattccttagtcaggtatttggtttaacattttaacatgaaaactcagatcagctctgcaaaccacactgttactattttcagttctccaaatagagtaggaatacacaaactcctaatctttaatctttgtttctattcacagatctattggtttaaagatgggaagcagatctctccaaagagtgatcactacaccattcaaagagatctcgatgggacctgctccctccataccacagcctccaccctagatgatgatgggaattatacaattatggctgcaaaccctcaggtaaagaagggtataggtctgggctcagttctgtgtctagtgcttacaggcatttgattagacaaaggaactatttaaaaggtgaagttaagaagtttctttgatttatgaaactatttttccaaattctacatccatcttggtttcagaggatagaaaaattctttgtttcatgaatacttatttattccatcaggtgttattctactccttccacaaatattattaagggtctaatatgtacacactttctatgtgggtgatggggttgcagtggtagactggacaaagtcctatggtaaaaaataagcaattaacaaataatataacttcaggtaggattacatgaagaaaataaaggagaaaaagagtgagtggcatgcataggctgtataagaaaaactcaacaaagtaaaatattttaaaagaaacacatcagtgggatttaatgtgcaaatgtagacaaatgataattttgatagcattcaggtttatcagttttcatcaaaatgttttctcttgtatttgcctttagacttagggtcaaaaaatcagttgccttcttagaatttaataggaggctgctgggtatcatgttgccagttcgagcctgcaaattcttttttattatgttatacattttagtcactatgctggatataggggatacaaaaatgagtaaaaagttattttgtaccttaagagctcaatgtatgacaggtagttttactaaagtctgcaaaagtagtataaataacacacttttaaaaagaaaaaaaaaggcatggtaaaatgagcagttttctctagaagtcatctttttagaatctctgatctacttatatcattccatattatttcttttgaagaaaatatttagcattagaaactatataaataattttaatgacactacaaacttttaattaaagtttctggcccaggtgcagtggctcacatctgtagtcccagcactttgggaggctgaggcaggtggattgcctcagccccggagtttgagaccagcctggccaacatggcgaaaccctgtctctactaaaaatacaaaaattagccaggtgtggtggtaggcacctgtaatcccagctactcaggaggttgaagcatgagaatcacttgaacctgggatgcggaggtttcagtgagccaagactgcaccactgcactccagcctggttgacagagtgagactttgttttttgttttgttggttttttttttttttttttttttttttttttgagatggaatctcactctgtcgcccaggctggaatgcagtggcgcgatctcggctcactgcaagctccgcctcctgcgttcacaccattctcctgcctcagcctccctagtagctgggactacaggcacccaccatgcccggctaatttttttttatttttagtagagatggggtttcaccatgttagccaggatggtctcgatctcctgacctcgtgatccgcccgcctcggcctcccaaagtgttagcattacaggtgtgaggcactgcacccggcctgagactctgtttctaaataaataaataaataaagtttattcaaggtttattatattctaatattccatggtcatataaatatatttttctgcaataatattaagatcagaatgaaaacagattatccagctaatcaggttgtgatagagcacagcaaactcttcactgttaatgaaaagcttctatattaatgcacattcttaaagttctaaatgttttaatcaatgaatacatgaccatcaccctgaaaaagtctaaatcactattaagaagttgcattttaatgtttgtgttcatatttgatatatatgaagaaacaaaagcggaacttgcttttttttcttttttttttttttttttttcttttttgagacggaatcttgctctgttgcccaggctggagtgcagtggcatgatcttagcccactgcagtctccacctcctgggttcaagcaattcttctgcctcagcaccaccacgctcagctaattttttgtatttttaatagagacggggtttcacctcaggtgatccacctgcctcggcctcttttttccttattatattttcagtgcatttccttgacattaacaaattctagcttttagtttagttttctgcctgtttaagaaaatggtggagaactgacaaaatccaaaatttttcttcgtgttgggtcatttattcctcttttgccctagaaaggctggggtatattatgggatggaattatctgtggtccttacgtatttgccaacactgggaacctgctattaatttcaagacatttttcttagcatgttttaaattgttattggaataagccattttatagaacaaaagaacataaacgtaaaactgcaattgtgagtccgcttagtgtcttcctcaaattataataatgcatttttacatgtggaaaagttctcagtgaggaaggactgactcagtgctcatggccaatggcagtgtgcagagtttaagacagcaggccagccttgggggtcagtagtctccagtcatttaaactctcttgacaaattattatgaagtcactagatgaaggtgagctgctgaaaatctcccttggatcattccatattacatacatataatatcacattgtaccccacaaatatatacaattataatttatcaattagaataaaaaagaaatttttgtttattcatttagagacaaggtcttcctcagtcacccaggctggagtacagtggcataatcatggctcactgcagcttagaactcttgggctcaagcagtcctcccatctcagcctcccaaagcactggaattacaagcgtgagccactgccattagccaaaaataaatttttagaaaataaatgtaatcttacccaaagcccaatatataatgccaaaaaaaagaaacccttgttaacataggaaaaaaaggaaaggaaggaaataaaaaagaaatgttactacaaataccaagattgtagggcaacaccgatgatactgaaaaaacctaggatgaggccggcaggccatgcagtacaggggttatgagcatgaactttggcatcaggcaatctcagctggaattctagctctgccactcactacctgtgtgaccttagcaagtcacttaacttctctgtgcctgtttcctccctcgtaaaatgaggatgataataataataataataatacagatttaaatagtacatgtaaaaagcattcagtttacctggcacatactatgctttcaataaatgctagttactgtcattattttaattcagagacagtaactaccccatcttaaagcaacaggcctacaacagaagcctgtggaaccagatgtaaaggatcagttctgtgtctaggtactccgttcccacagtactgtcagaaagtaagcaagtcaatttgggatggaatttctacccagtatgttgttgctgtgtggtcttctgacctcctggcttttccattttatcacctccatgggaaaggacttaggcagcagatgtggctgtgccacaactgccacagctgtgggcttgggtggaggagctgtgagctagaggacggccacacccatagcacagctgacatcagccacacatgaagctgggaagctgctctctactctcagcaccctcagggccaagagaagccccaaaagagagtggttactgcccttattccaggccccagaattctctgctttgcaaatcccaggctgagccccatggttaaccctctctggttctttgctctaccctttggagagaagacaaagcaatgagaagtggaccaagaacagccctcctaatagaatatcctatccaacctgtgatttcagccaagggtaaaataactactctgggtctatcaaaaggagaaaaaaaaaagattcaaagaacccagagcatcacagtaaacagaccagtttctaacactacctattatagtattccaaccaactccaaagatcagttgacactcccagcatcttaaggggtagggctaagagtcttctttacctaaataacccaagacaggcaaaaggaagggaaactcatgaagtctaggcctcagtgtgtaaatgtatatatcccactgaaattgctgtgagagaattttgatatttatgccacttagcagtagtagtatttgttccaagtttctgagcatgttgcctagttgattttaattccaagagtaaaaccccttcttttctgtcttgggggcttcagtaactggtatgtccaaatatggcagatataagttctgtgagtcatcacttaaaaattggagtgaacttcactatccattagcaaaacaaagtggcatttaaaccatgaccagtgacacaccatttttctacctaactcttggcataagttaccatttgttgctgtaaggatgccattctggaaatgtttaatgctcttagaatctcagctttacaacatctattaccgtatattaaaacttttttcttataatttatgaattaagacatgagtttaaatagtcatgtcataaaaggtggtgaaaaaaaaattcaaaatagctaaatctttcaagatatagtaatcccaaaagcataaagtgtagttgacagaaaactgaagttgactccttacttccttaatgccctttagttaccttaaattttgaaattttaaagttatttgagtttagaaaaaaaagtatttgggtttgaaagggagaatacatgtatgttttctagtacactgtagcccagatgaaatgaaataaccaaggaaaagaggaagactagagtggaaaaattagttcagtaatgaaacacagacggtagagctctcctgagcagtggaaaataattacagaaagcagccaagagaagggtgagaaccaaggagggaggaaaatattaaagttcagcagaatattttatagaatatgatatttttccacctgggttaatcttttgggaataagaaaaacattagatattgttgactgcatccaaattctacttgggatagaacacacagctctaaacatatactgggctgtgtatcacactcgatgtgtgtagctcaagcaattcataagagaccaaagcaatcacatagtttagcaaaataatgagtgactgtgcagttacaccaaagagaatgccaaaatgaggatcacaaatacagtttattttagactctaatcctatctttaagaacaacgacatctaaacacgaatgttttactttgttttgttgtgttgctaagttactttgtattgcacttggattttggaatggctattttgcagtctgatgtttcctcaaactgcattatgtatacaagtggcaagcttttatgaagacctgtgtgccacaagttaaatttcataaactatgaaatataaatgttatttccatattacataaataattggccttgcacaaggtatgaaataatctttacaagctggatgtttaatacagaatcacttttagaattcaaacttatttgtaatataagctttaaactctgtggatttgtttggaatggaaaagtaacacacaactgagttaaatataaaatgttagtttgttgcttgtgttttgttttagcattataaggtttcctggctcatttcaagcttcactctaaacattcccttccattattcttatgttcatagtaaagcagatagaaatgagaaaattaataaaagcaaatgcagcagcattaatgtgcatcagagcctactaactatgattaccagggttaataggcatattattattaaaatcacttattgctaattctatatgacctttgtcaaaaatagtatgttcagacttaaaaacctgaattttctattatgcacatggaaggcatcttttcaaaaaagcttcactgaactctgggggttttttcccccaaacaaaaatgacaaaattatacaacttcttagtttggatgctctctaaatgctcctggttatgtattggttagtaatatatttagccaataacactgtataaatcaaactaataattctgcctcctgaagaccacaccttcccctttcatgttcagaagtgcaggttggtatcagaatagagagattacaaatgataactattcctttttcttaaatttgggaagttaaggaaatattctgtggcaatatttgtatatatggttctaagcagtagcagcaaaaaccctgaaaacagtgtagaaatgtgtgacctttccagagtagtatgccaacctgtttactttttttttttttttttttttgagaggggaggaagaggcaggctaagcatatcaaggatctgtttagagctgaatagggcatatttttcctcctccacatcaaatgcagccatcacactaacaagtacatttcagtatgattgtgcttagcacctttcaagcaccagcagaagttaaaaaggttaatctgcttcccacatagtctgcctcctgtgccaaaggtattttgtttttcctttggagtaaattacattctaataccaagaaaaataaaattccattacataaacaattctaaaggatgcctcaaaactggttattataattatatccatagtgagtgctacaataatttaacattttgagcattggcttcatgcaaaacacaatgctgcccggtgctttacaagtattaatgcctttaatcttcataagaacccattaggtattaactatatggccttgttttacagagaaggaaacttagaaagattaagttacctgcctaaagtcactcacctgtaagggacagcagaactggtttacaaacttagactgattccagagctactgaatgcaatacgaaggtatttaaggctcattccaggattaagagcactaagtggcaggggagatagtggttaaatatgaaagaattttagaaggaggtaagcatatacctcatgtaaagtatattcacatggaaattcttgctggggtccgccaagctgctggggctcctaaaaaccatcttgatgcatgtccatgcataatgtctcagacccatgataacacagtaccagctatgaggaatttaataatgataatttatgatgtcacataccatttgatatttatgagagcatttaggttacatcatttaacccttaaaacatccttgtgagagatatatgtagcatccctatttgtacagaaaaagaaacaaaggcttgaacaaattcagtgatttgctcaaagttttaggaaaagtcagcactcaaatccaggttagtgaggtgtgtttgtttgactgtttgtaacaacccatacctccttttccaaattcaagtttaagtctgaatttaacttacattatatctttttctaaccgcataaatgattagttcattttaacttaccatggatcttctgagcttcatatcacaaggaaggatatatccaaattataagcatttcatcatggaagccgcaaagcacataataaggaagccatatcccacatcaggacaattggaagctatttgtgtaaaacaatacacacacttccttgtcctcaacctccaaaaagaatcattaattttaagtgttcatgtgttatcttgtatgatgcatcagttggatagttcatgatggaggtcttctaagcaagttacatctagattttctacagcaagtacagatctggagaacttggatgaaattaatttttagatttcaggctagtttagggaatcccaaatgtttgccaagagtttagcataagaatctgtatcaagtggcctgtgcttcaggtacagttaatctgagctagaaataattctccttcataatgttagacttcatgtctccttggaaattttcaggaaacacagtgttttaactatgacctcaatagcaaacaccgtgaatgccagacggagtcacatatgtagtggtataaaactagttatgtttgtttctttgtgatgacctctctttggtaattcctcattcttctcctgtctgtattacattcctatgtgtctttgccttttctgggtggttatagccctaaagaagtccaggttttaggagacctagagaacccccccagttagagtcctgcccttcagtgaatcttgctatgggatttttctctgcattccctccactagtgccctcaccctgacccccactccagtctactcacagttggaaagcagttcttcaaaacacacagaacactgcagcttctgttacctgtctctataggcagcttgcaataaaaatgacagccaatgggagaattttattctgagtgtaagtgcatgagggcttctcatcaactctgagctagaactcactaagtctaatcattgatggtacatctgcttcttgtttttcctctcttgctgttacctttggcagtcatcacaatttagaagcacatcttctcattcttctgagagagtgaaggagaaaaatcatcttttttgctactctgctggtaacagtgaaaaaaacaaattaagagaaagggctgaaacaaaaaccaaagtaacaatgtgtggcttatccatgtcatctgggtgccctgagtattacttgtctgttcacatatgacagcgtttatcaaactctttttttgcttttattatttttagttgacacaatgattatacatatttatgaggtacagtgtgatatttcaaagcatgtatacaacgtataatgttcaaatcatggtaattagcatatctgtcacctcacttatcatttgtgttggaaatactcaaaatccactcttccagctatatgaaaatacacaataaattattgttatcctacagtgctgtgaaacactaaaactttttcctcctatgtagctgtaattttgtatccattaaccaacttctggctatctccccgaccccaccaccccgtcaaaatttcaattgacaaatttaagagaacaaaatataggtttttttaattacataggcccttatcatatgacccacatattttaggtatttaactgcttctagtttttaaatctcaaatatgttcatttcatgagaacatggcttcatttagtcatgaagctctccttatcatcccacgcatacttcttacataacactcattttatcatgctcattttaatgtatggtttggggaagggatgccactaacttttttttttttttttttgagacagagtcttgctctgtcacccaggctggagtgcagtggcaccatctcagctcactgcaacctccgcctcccgggttcaatagattcttctgcctcagcctcccaagtagctgggactataggtgcatgccaccacgcccggctaatttttgtatttttttagtagagacggggtttcaccatattggccaggctgggctcgaactcctgacctcgtgatccacctgcgtcagcctcccaaagtgctggcattacaggcatgagccatcgtgcccggccagccactaacatttaattagtatattactataattagtatattactaaaaagagaaaactgaaatcatctaggtttgatttcagaattggctacagctggtagatgaccatgaaaatggaatcttcacaagagactgatgtcctcctgctatattttacaattcaacatcatgtgttacggagacctttgcaggttacaattaatcaagggttgtcattttaaataccatcctagataaaacagtaaagcttatttaagagttccaaaaaaagaccttgtcaccttcaagttcttcaagtaaaaatagttttactgaggcacttaactcacagggaaagtgtttttctgaaaagggttagtcattactcaaatggcatactgaattttttatgaaataatgtcttatagagaataggacagtaggcatgatagtgcttagtggttaatagttttaaatagcaaatcatttatttcctgatatttctacagggccgcatcagttgtactggacggctaatggtacaggctgtcaaccaaagaggtcgaagtccccggtctccctcaggccatcctcatgtcagaaggtatttaacatgttccttcccagaagtgttacattattttatttattactataaatgtagtactattagaatcatcatatgaccacaaaagtaaacataactggaagatagaataggaatgcaaacctgaagcctgtggctccttgattattatgctcccttgtgatgcagaaagggaatgggaacaaacattcgctaatgtgtgctaagcccattcacatatactattagtttgttaaataagacatattttatagacaaataaatcaagactcagcacttttaaatggcatatgaaaatactactaaatggtacacaaatgttggaaaccaaacttctgtaaccaacagctgtgtgagtggacgcacacattaaaagctattaccactgggtttcttaaaatcagctcatttgttaatgttcatttttcagccacttagttcaaaacataagaccattagactacaaatcttgtaggtaagatctgtcacattttaaatactcagatatctgctagcaatagagatgctttccattcctagtagttctgagtctatgcaaggacactgatggaacaatggtaggcagagatagagaaaggattattacttcttagtaacacatttgcacttaaaaaaaattcagtaagtcaaccatcctgtcaacttggcctgtttagatattttatagacagaatatcctcaaatagtcctgagtctaaattacaggccataggtgcaaactcctttagtgaagagaatacatagttagctcacagagagtaggcaggaaaactgagtaaacatcaaacaagtggtgtgtgactgcatccacacagacttttgttcaacatttggaagacagttctggcaccagagcatgtgtagatttaattctaacttcatcatggcaatacctattcacaggatgctagcctgtatctttgggtataaacatagcatatacaggattaggtccattgtcttgcattattctctttgcttctcttgttgtctgcaacacatttttaagcctttccttatatcagtgggtcctggaaagctttttttcccataaattagatctatacttagagaagggtaaactatattaaaaagctaataattattagcctagtatgcttctttcatttgttccactcttgcttttcctagttaagtgtttttaaacttatcttctagtcactactgacagaatttgtattcaacatcttttaagtcttccctgcgattactttcaactgtattcctcttaaaggtttctctggcaacctttaaaagtgacagagatgcacagaatctgggagatttgtacaatctcattttttaaagcaaaaaataatgcctctaggcatatggataactaatgcaaaagaaaacttgcctaaaaatgtaatttgttttcctgcttaatatgaaaaggaattttaattaaaaatatattgaatttttatcagaacttttaatttcctacaaatttaaaaatcacagtgtaaagttctagtaacttctgttgaaaaagatttggtaataaatgagcaataatgctacttttcataaatatttaaaaatatttaggaaaaatatgttaatatgtaataccccatttttttccatttccccttttatgatttatagtagcctgcaattggcagacaattaaatttatagtaaacttccaaactaaacaagagtttgcttttctgattttttaatgtgtaaatcttagctgtagggatcagataaggaaatcatattattaccccatgtattttaagaaaacagatgactaaaagtctggaagtaactactatctatatttctatctatctgtcatctttcttgtttcaaggcctcgttctagatcaagggacagtggagacgaaaatgaaccaattcaggagcgattcttcagacctcacttcttgcaggctcctggagatctgactgttcaagaaggaaaactctgcagaatggactgcaaagtaagattttgttattgcttgcatatcctattgccccacttctccctcacttgccatttctctatagttccttttggggaaattacataaagtataaaatgagagctgggcacagtggctcacacctataatcccagcactttagagtccaaagccgggcagatcgcttgatcccaggagttcaagaccagcctgggtaatatggagaaacccatctctaccaaaaatacaaaagttagccaggcgtggtggcgtgtgcctatagtcccatctacttgggaggctgagttggaaggactgcttgagcctaggagctgaagctatgtgagctatgatcgagccactgaattccagcctgggtgacagagcaagaccctgtctcaaaaaatgaaatgattctagcttaagggggggaaaaagtgaaatacgtcggatatttatatattgtttactatgattctttaaatctaaattaaatatgttctttactcagaaccctacatgacattactctagaaagtcatcaggaggttttatttatccctttaaatgttgaaataataaatatgataaatctaccatgtcttcattcttttttcatacaaattttgtatccatatatctactctgacttttattcctcccattttctaattctttttttttttttttgagacagagtctcactctgtcaccaggctggagtgcagtggtgcaatctcggctcgctgcaacctctgcctcctgggtctcctgcctcagcctcctgagtagctgcgattacaggcatgtgccaccaggcccagctaatttttgtatttttagtagagatggggtttcaccatgttggtcaggctggtctcaaactcctgacttcatgatccgcccacctcagcctcccaaagtgctgggattacaggtgtgagccacagtgccccgcccccattttctaattctaagataagttagagggacatctttctttcatctgttttgcagcagggctttttgtttttttggggtttttttttttttttttgagacggagtctccctctgttgcccaggctggagtgcagtggtgtgatctcagctcactgcagcttccacctcccaggttcaagtgattctcctgcctctgcctcctgagtagctggaagtacaggcacgcaccaccacgcccagttaattttttgtatctttagtacagacggggtttcaccatattggccaggctggtctcaaactcctgacctcgtgatccgccctcctcggccttccaaagtgctgggattacaggcatgagccaccacacccggcctacagcaaggctttttaacccaaggtccttgggtaggcaggcttcattaggtgtttgaactctgaaattacctacaaaattatgtgtgtaagataacgttcatccatttctcaaaggagtttagggaaaaaatatttaagaaacactgctctaaaattttttgtttgatttcttttttgccccctgtttactgatcttaaatttagtttaactcttaaatatggataaggttttaaaaagttatttgggctccctctgctggttctgtatggaatatgagaacacaaatataggctgcttagaggatttgggcattgtttcttcagaaagtaaatctgggattatagaaatgtataaaaagaataaatataacaaaaatattttatttcttaggatcattatttattttttacagtataaatacacaaattgtgtttcagtctgtatatattttatatatatatgagtgtgtattcatttttggtctataattaagaattatacagtacagctaccatatgatccagttaattctactagtgcttatatatccgaggaaaatgaaatcagaggctgggcacagtggcacacgcctgtaatcccagcactttgggaggctgaggcgggcggatcacgaggtcaggagtttgagaccagcctgaccaacatggtgaaaccccatctctactaaaaatgctaaaattagccaggtgtggtggcatgcatctgtagtcccagctactcagggggctgaggcaggggaatcacttgaacctgggaggcagaggttgcatcactgcattccaacctgggcaacagaacaagactccccgtctcccccacaaaaaaaaaaaaagaaaagaaaatgaaatcagtagcaatatctgcattcccatgttcattgcagcactattcataatagccaggatacgggatcagcctaagtgtcaacagatgaatgaataaagaaaatatgagatatatatatatatacatacatacacacacagtggaaaattataatcctgtcattgtgacaacatggatgaacctggaggacataatgttaagtgaaataggccaggcacagaaagataaatactacaggatcttacttatatgtgcaatataaaaaagttgaactcatagtagagaatagaatggtgattaccacgggctagacggggagagggaaagttggggaaatgttagtcaaagcatataaaatttcagacaggaagaataagttcaagagatctgttgtacaacatggtgactatagttaataacgatgtactatatacttgaaaattgctaagagtaggttttaagtgttcttactacaaaaaaaaatgaagtcatacatatgttaatcagctcagtttaggtattccacaacacatacatatttcaaaataatgtgcagaattacatacaatttttatcaattaaaaaacacttaaaaaaattcatacagaccacttgtaaaataacgttttgagttaaccagggaaattttattttaaatagataattagattataccaaagaattattaattttacgtgtaaaatggaattgtgattatggaaaagtcttgtttttagaaatgcatactgagctatatgggggtaatggtatataaaatctggaatttatttttaaatataaaaaataagagagtgactaaatgatgggtatatacacacttaccatactggttatctctatttttaatcatatttaagaaagaaataacagtactgtctttcactggactggcacataactgtccttaaaacgcctgccattaaaagaatattggaaacaaaaagtaaactgcctattgatttcactatgatgatctgacctggataaagaaaatgtgaaaaatcggccaggcacgtgggtcacgcctgtaatcctaaaactttgggaggccgaggcaggtggatcacctgaggtcaggaatccgagaccagcctggccaacatggtgaaaccccgtctctactaaaatacaaaaaaatcagccaggcatggtggcaggcgcctgtaatcccagctactcaggaggctgaggcaagagaattgcttgaacccgggaggcggaggttgcagtaagctgagattgtgcccactgcactccagcctgggcaaggagcaagactgtcttaaaaaaaaaaaaaaagtgaaaaaccttgccacatgtacagatagatcaggaaaaaaaaaaagttagtgtatttaagctttgaaaggggaaaaaatcctgacgataagccaaacactaaagcagcagcttgcttttcctccaaaaagccccctccccttttagcccctgaggaacattcctagacactgattatccttaactggtactaaattttcaggaaaataactaattccactcccatagcaacaagcatcactattttcatgtgtgctgagagtacagatctagttacattgtgacctgctggtggtgaccttcagctcctgagatcatgctgtctttacttagccaggagaactggggttagaaaaaaggtacaaggggcattctctttgccctagcatgagtaactatccactgggtaggttcactgtgaatcacgtggtttgagagtacgcgtgctttgggcatctctcctactaaacatactgtggcttcagtcagtagatggcttatctaggatctaacctggtaaagtaggaacaagcagtgccgctttgtttctagatgtgggaacaacaaggagcctgaccaaagatgtccactccctcttcctccacaccacttctgatgacctccaaacaggtcaggcagtgtacatggagagctggggacagcaagtggatagataggagaacacagagcctgagtgtctcagaagccaagctgcctaactactgctgtttgtttccaaaacctcttcatccttttaaccagtcatttaagtttactttaaatgctgtagccctttgctacatgtgtggtgggaggcatcttgcaggtaatatcagttgagtatcacgtagcaggaatggaatttgtgagtcctctggctgatgctggcaaagctagttcttcaaaagaactgttttacagtctaagtgacatctttttgtatataacttcgtactagtaaagttgggggtagggggtaaaaaggccttccttaacagtgcatttcttccattcaaaatcaagggcaaaactaaaaagctggcagatggcgaccatcctgaccctttgcggcacaacatgttattagcaattaaatgcttttatctgatctctggtccacacaactgtcaaggtctcaagattttatgatgtttccattgtgatggtaatttgttgagatggctttctgggtaatttcgtattgctcttgttattcagtttcaaggattataaaataataatagcagccctgtgtgctgacgaatgcattctccataactatggctgctccttgatgagaagctttacagtactatatataaatgccagctgagtatttgttattattgttggacatcttttttcaaagaagcccagagcctggtgctgatatcatcccattaatctccatagccctgggcaaggtaagaccatgacagcaattttttaaatcccatctcggtcttctctaggttgctctgtaagaattgtttagatgtaagctggtgagtgctcaggaagccaaagtttaaagcaaaagttttaagcaaaagagtaacatgagctgatactaaaagccatctcttggcccggtgcaatggctcatgcttgtaatcccagcactttgggaggctgaggcaggcggatcacctgaggtcaggagttcaagaccagcccggccaacatagtgaaaccctatctctactgaaaatactaaaaattaggctggcatagtggcaggcatctgtaatcccagctactcaggaggctgagacaggagaatcgcttgaacccgggaggcagaggttgcagtgagctgagattgtgccactgcactccagcctgggcaataagagtgaaactctgtccaaaaaaaaaaaaaaaaaaaagccacctcttgtactactgaaggaggaatttatgcagacttcttagctaccagtgatttcactctgttttaatacaaaaatttacatgtatttcttttatgatttaggtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctggtaggctcatctgtgaatccttgctctctgacagaatgaacatcagacttacaaatgtaaactaattctacattactaaccaatacggaaaataaagtattgaaaaaatagattgtatcatcaaaatagccaatgaggacatggttataaggcctagcaaaacagaaacagaaatctttcatttctcccactaacctggcaaagagagaaaaagattttattagctcttttgggtcattcgacctcctgtgtgtatagtggcccctagtgttacatagagaaatagtaacagcagcatggactccaagaaccaaagaatttgcttatatataaagttttatatttatatatatatatatatacacacacacacacacacacacacacacacacacacacacacctggtttttaaaacaacactgtcatctaccctcatagtcattgtcaaactacactcagatttgctttttcactgattattgtgtaggtaaattctgtaaaagtgctgttacatgaagtcttatgctttgagaagcctaaaaggaaaacacatttatggaaaggtttttataccatccttaagagttaggtgttgagtacctgatctcttttaagaaagaacataacaaaacatttatttcttctacctctttatgcaaagtgcttcatgtacattatgtatcagttggccctcacatgagccttatgagataatcagagcaaatcttctctgaattttccagggtcccacttagtaagctgatgattagatttaacacaagactcctagtgctcttctaaacacactacgtcactgagctctttcaagaaatagagtagcaatgagaataaaacccaagaagtcttgacaaaactcttggattatgattctgataatggtaccaagatgttttcacataaaaatgtggtaaatatgtggactgtggtgctacaggttagccatgctttcaagttttgtacaaagtactctatattcttacatgctacaattgatttcattcctctaacctcaaactaaaacttcacttttctgctgttaaatatgccttttgatcacatagatacctcagtgcgcatcagctggcactcctgtcagaagacggtgatgcacagtaattggaagcaaagtctttggggtcagatctgctccagtcccggctcttgtcgattttactagtgtgacatttggcaaatagctatctctgcgacttagtttctccatatataaaatgggaatataatgcctcacagtgctttcctaaggattaaatcataaaaatgtgtatgaagctctgcataactagtaccctgcacagcaatgctgcaaagtggtagatgttattcttactgatgagttgctatgacattaagacttgttttatacattttatgttctttgcaaaactggagccccagaaagaatacaaagtgagcttctgttcccacttctcccagaatagcctaggatgggcaaccatgtaaaattcaataaaaatccaaccttctaactaactcgtggtgttggagagtattaagcatttgaaaagttcaggtagaattttcatcctttttgagctctttcctagctgctttgctgtgatatatctgtcactccagatgagggagtagtggtggaaaaggaatgcattctcagattcattgttggtagttcaaaagaaaataagtaaaccttattcattctctgaagtactttccaccactactacaactgatccaagaaaacaatttcccattggatggtattattcagagtgttattaacaatcagtcctgaatttttcagaatagtactaaagttgtcttttttttttaatgggttccttccttcaaggttataataaagcttttttataaccttcaaagaatacaaagtggaatttgtaatttataggatatacattcctagtttacaggtaactatttaaagctgccaaatttagataaagatgcctcccctttaaattgccccctttaaattctatggcatgtctcacttaagagttacaaatattcagaatattcatggcaaacatggcaaacggcagtgagggaatctaagtggtcaaattcctagaaatacttgtcctcagcaccactaggtggcagtagttggttgaggctgtgaatgatcggtaacataatcactagtagtgaagccatcacagatgctagcaatgacttaggagtctcccacagctggtcagacaggcattctgtgaagcagatggccagtggacagtgtgagcctatcagacttgaattaattgaggaaataaatgagcggaatgaagtatacagacctttgcttggtaaaagaataatttggagaggggactagcatcttaccacctggagtaaaaaatggtatcataaaagatctattcaagcaatattccaaaagccttctgaattctttctagtgctccttttgtatatcattgatagagaattcatctcatgttttcttagctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgaggtaagactgcacaatgagaacctgatccttaactgttcagtcctaatgatgtatcaaaagatacattttatatagcatggaaatctatgtgtaaaagccacatagatgttttgatttttgatgaaatcaatcaaagacaaaaaccatgcgttacccaatgtaggattaagcttttagaaggaagctatgggtgtttgatctaatggtgatttcttaaaagtgtttatcattctatctaaaagaaaagatgaattcatttgctttagtgataaaagactattcagtggtttttgtaaaggcagatcctcaactaggaattaagcacacagatgtattcaactcttgacgtctgttctttctcccattaactttaatggagctagtaatctctacagaataagtatgaccctattatcagctacttgcacaattctgtttctaatgatctaattaaaaatgatgcttcatgtccaaagccacttttaaaaaatttagaaccctaatgactttatccttttctccagcatgcaccaggacaaccacggctacatctgcctgctcattcagggagccacaaaagaagatgctgggtggtatactgtgtcagccaagaatgaagcagggattgtgtcctgtactgccaggctggacgtttacagtgagtgccacttcatctcatttcattgcgtttactcattaaattatgaaaaattagacatctggacagcaaatcacattactctttataaacaactattgtgttttatttgtcaaaaaaattcatattgctctctctctctttctatttgtagtttctcgacattaatagtgaaccacaccaggagaacaaatacccaagtatcattcaggaactttgaattattagcaaaatatgcatgttgatttctcttacattggctagttagttgtggcttccttactcaagcatccttaggagttaacagtaggcaaaggcataaccatgtttttcacatgttcttgttactgtgttctgcaaatgactgccttttaacatttcttcctatattctatcgcagtgtcctaatgcactctaaacgtgtgttccattgatcctggaatgcgtacttttgtggcttagtgcttttctcattaatatatcttaagcagccagcagtagacttgtgtttgtatatttgtgtacatgcatcccaaatttaaagaaaattattcctattgaatttacagtctagtacaatcagcattatgttatccattgacataaaaaaaacactagaaaaaaattaagaatttatttaagaatttatttcagattttgcctcttcttgaaataactatgtgagggtcatcaagaaatgtgtggcctcaaccttccctactgtacgattcctttcagttgattagtgttaaagcatccacatccagcagaattcctaagtgctataattattttagagaaaatattttttaaaaggagaggggggatgagaattaggaagcttatcagctattccaaaggattccctgtgctgcagtgtttacttaaaaaaaaaaaagataaactacacttgacctttgtaatctagctgctttattcccactatcctgtatagacagtaaatctgcaacatgtgagtaaaatgcaaaagtgttcctaaattttccatgtttctaccatggatgtgttcaggtgccttgcatctatctagacattctgtatttatttgaaatatctaaaggctttccaagtatatcttgattaaaaatcttaatttactctttttctttgtagcccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttgccaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataatagttgcagttttgtgaagcaaaataaatattcagttttagttttctgttgctgccataacaattagcataaactttgagtgatgtttgaggcttcagcatcactcatttattactcacagttctgtaaatcaagttcgggcaggatgtagctgggttctctgttcaggatcttataaagctaaaatcattgtatcagctggactgtattctcatctggagctcaagatcctcttcaaaattcaagtggttgtgatagctctgtgcaattgtagaagagacgtctcctttagtccctcagccaggagctctctctctcagctcctgaaggccgcctgtattccttgccatgtagcccgctccatcttcagggttagtggtgagaatctccttcacctcagatccctctcacactttctctttgtcaaaggcccagtcccttttaaattacgtcaggcccatccagataatctccctttcttaaagtcacctgactttgggaaccttaattacatctgcaaatcccttcaaagcagcagctaaatcgccatttgattggaataactgagagaaggtgtgtatacaccagaggatggggatattaggggccatcttacagttctgcctgccacagcaatgtactgtaggtatgcatgtaaatacacaccagtgccatgacgtacaaggatacataaaatacagcaagatgatataaattaaaagtgaggggaaaaggaagaaagtaagtataaatggaacaaggaatgagatattacacacacacacacacccatattcatatacacatatagcattaatatctacatagttacaacagacggacaacatatttgggcctaggctttcctactacgggaaagagaaagctggtcatttatctaattcacagcctccataaggtgaaaatatttcatcttttacatatgcaatataatggagctttgaggatacatttgaattagactagaattgtgtatttcacattgtcttctataccccatgacttgctatgtagtttacaagattcattatatattttaatgctgaatttgtccttgattttcccttttatgaacatgcataacatgacaatccccttggcttgctcagtagctacaacctcctttatcatcatgtaaatttagtttgacccctttaaattatagaaatacaacttctatattatggtggtgaggaacttgagtgttggagttggccaaccaggatttgaatcctagctcttttgatcatgtgtgacccataagcaagttactttacctccccaagcctcagtttccttatttggaaaatggagattaaaatagcacccctctctttgtgctgctgtgaagattatatgggatgataattttgacatggtacctggcacatagtaagagctcaataaatttcagctattattttagtgtagttggaaactaaagtaaaatttcaattacaaaatgtgtacacacctaacaaaattccacagatggttaaaatttgtgaacttggatgggaaaaacattaccccctagctgaaatttagaatttccttcaattatgaatgtaggcaacaaaacacaacagtataaaatacctgggactgtcctagtaaaaattatattacaaatattgaaatatcttaaaatccatctaaattcagcattacttcaaaattatggcagttgttagagttaccaatagatgtaatttataggcatttgtattataaatttgtttttaatactttgataattacttaaaaataatttgttttatgtattttatgcctccatgaacattattttgagaagggatccagaagatttaccagagggtcaaaaaggcatatggcaccaaaaaaattaagaaccaggccctacagaagcttaaatacgtagaaaaggataaaaaatttgaggaaagcctaatttgtcattagtagaagaaggaacaaaactaattaattcatacaatgaaatattacttactattcagagttaaaggtaaagaaatggatttacttctattggcagggataaatatgaaaaacagcatttgacgaggaagggaagttacataagagtgatgtcagcaagatggctgactagaggttcctggcattcatccccccaagaaaggatcaacaaatgaacaaacagttaacattcaactgaagtgtcaaaggaagagcactggagtgcagtgggggtagctgcggtcactgaaagtccagaaggcagcatggagacaccttgtctctgctgcccatgcccctgcatcccccaactctgactggcctggagtcaagaggagaaactttcctttgctgggaaaacgtaagcagagccccatcagcccccattaccactgcaaacacctacaatccttactacaggagaattccacagtcctcacaagccctgaaccgactttagagagccactgtcgattgcacagctgcattcctctggattaggaacatgagatatgtactctccaccccttaggtgcctgctgtggggcccagtagcaaatgcacctctccagcccagcggctctgtcattccaccaagcacacatgggtggctgcaatgccacaaccctggaggctcagaacctgggcccaggattggctgtgactctggttctgcacagcaggaaaaccaaccatcattgcctgaacttccaggcagagaaacagtctagcaaattctcccaaagcatacatacctacccttgagctggccaaactgggcccctgagctgctaagcacctgacatgccctcaggccagaaccagtaccagcctatctcctaagcctgagaaacagcccaatgccccctacctccatggacatgcctccaggcctacccagtggaactgtgcccaggctagggtatgagaaacagtccagtgggcccaatcccagcatacatgtccctagaccttcccagcagccctgtgcccatgcccagggcctgagaaacagcttgggagattaacttccagtagacacacccctgggccaggtgagctgtcacatgaccatgcccagggcctaagaaagagccccatggggtcaacccccatggacacaccccctggctggctgagaggcacaccactgtcccaagcccaagaaacagcccacttggcccacctctggcagacacacccccaggccaaatgagcatgcctgtacccagggcctgagaaacatccctgtggccccaatcccagcaagcaagaccccaagttggttgacaccgttcacacacatgcccccaatttgagaaacaatccagtgagcccaccccagcaaagctgcaccaccactgctacaaattctcacagcctaggccactgggcacttacaaacatcagcagactggattacagctgaagaatctgcacagacactacagtactgcatccacctagaaccaaagccaacacaccccccctaactgacactataagatcctccaatacaaatacgtctttccctacaaaacctttcatcaaattagaagaggtgactgttctaccagatgcatagaaatcaacatcaaggaacatatcaaacatgaaaaaacaagaaaccatgatacctccaaaagaacacaataatgctccagtaacacaccttaatcataaggaaatatgtgaaatgccataaaaagaattgaaaataataatcttaaggaagctcagtgaggtaaagagaatatagctaaactgttccctcaaatcaggaaagtaattcatgatttgaatgagaaattcaacaaagaacataaaaaaaaaaaacccaacagaaatcttagagttgaagaattcaatgaataaaataaaaaatgcaatcaagagcttcaacaacagattagacaaagcaggggaaagaatttctgaacttggaggtaggccttttgaaataactcatgcagacaaaaaaaaaagaataaagaaagcctacagaatgtatgggacactgttaagtgaacaaatatttgcattttggaactccagatggagaagagaaggaaaaaggtatagaaaacagatttaatgaaatcacagcaaaaaacttcccaagttttggaaaagagatgaacatctagctctaagaagcttaaagtccccaaagagattcaacctaaacagttcctctctgaggcacattatagtcaaattgtcaaaagtcaaatacaaagaaagaattctaacaacagcaagagaaaaacgtcaagtcacatataagggaatacccattaggccaacagcagatagcagaaaccttacaggccgggaaaaaaagaaataatatattcaatgtactaaaagaaaaatattgccagtaaagaatattgctttaatattctttattaaatataagcaaagctattcctcagaaatgaaagaaaataaagtctttttcagatatgcaaaagctaagggaagactagccttacaagaaacactcaagagagttttagatctggaagtgaaaagacaataaccaccaccatgatgaaaacaaatgaaattataaaattcacttgtagagctgatatacaaaagagaaagagaaaggaatcaaaccttatcactacagaaaaccactaagccacaaaaataaacaataaggaggattaaagagaaaggaatatacaaccggaaaaccatcaataaaacgacaagagttaagtcctcacctaccaataaataaccttgaatgtaaataaattaaattccccaattaaaagacgttgaatgaatgaatgaataaaaaaaccatgcaactatatgctgccaaataaaaactcacctcacctgtaaaagacacacaaagactgaaagtgaagggatggaaaaaaataatcaatgcaaacagaaacaaaaagtgagcagaagtagctattcttatgtcagataatacaggctatttaagtaaaaagtgatagagacaaagaaggacattatataataataaaggtatcaattcagcaagaagacataacaatggtaaatatatatgcacccaacactgaagcacccagatatataaagcaaatattattagatctaaaaggagagatagacctcaataaaataacagttgggaactttaacaccccactttcagcactggacagatcatctagacagaaaatcaacaaagaaacattggatttaaactgtactacagactaaatggacctaacagacacctacagaacatttcacccaacagcaatagaatacacattctttttatcagcacatggaacattctacaggattgaccatatattaggacacaaaccaagctcaaaaaatttttaaacactgaaatcatatcaagtgtcctatctgaccacaatggaataaaactggaaatcaataacaagaagaatattcaaaactgtacaaatacatggaaattaaacaacatgctcctgactgaccaatggatgaaggaagaaattaagaagtaaattttaaaattccttgaaacaaatgaaaacagaaacacaacataccaaaccctgtgtgatacagcaaaagcatgattaagagaagtttacagcaataaacatctatatcaaaaaagtaaaaagagttctaataaccgaatgattcatcttaagaatctaggaaaaaactgggcatagtggtgcacacctatagccccagccactcagaaggctcgggccaggttgctttgaggccaggaatttgagactacagcacactccaatttggcctgtgaaaagccactggcaagacccagtctccaaaacaagttttaaaagaaactagaaaagcaaaaaaaacaaaaaaaaaaaaaaaaaaaaaagcaagccaaacccaaaattagcagaaggaaagaaataataaagattagagtagaattaaacaaaattgagatttaaaaatacaaaagatcaacaaaaagttggttttttgaaaaaataaacaaaatcaactagccactagactaagaatacagagagaagacccaaataaacaaaatcaaaaacaaaaaaggagctgtcacaactgatactacagaaacacacaggatcattagaatctatcatgaacaaccatatgccaataaatttaaaaacctagaggaaatggataaattcctggacacacaagctaccaagactgaaccaaaaagaaacagcctgaacagatcaataaaaagtaatgataataaatcagtaataaaaagcctcccaacaaggaaaaaaccaggactggatggcttctcagctaaattctaccaaacattaaaaaagaaagaaaaaaaactgccaattcttctcaaactattccaaaaattgaagagaagggaattcttccaaacttattttacagggccagcataattttgacaccaaaaccagataaggacataacaaaaaaacaaaactacagaccaatatccctaatgaacatacatgcaaaaatcctcaatataatattagtaaattcaatctaacatcacatcagaaagatcatacaccgaagatggccaaatgggaacagctccggtctgcaacccccagcaagatcaatgcagaaggcaggtgatttcttcatttccagctgaggtacccagctcatctcattgggactggttagatagtgggtgcagcccatggagggcgagcagaagcagggtggggtgtcacctcacatgggaagtgcaaggggtggaggaactccctcccctagccaagggaagccgtgagggactgtgccatgagggacggtgcattccaggccagataccacgcttttcccacggtttttgcaaccatagaccagatgcctgtgccaccaaggccctgagttttaagcacaaaactgggcagccatttggccagacactgagctagctgcaggagtttcttttcgtaccccagtgactcctggaacaccagcgagacagaaccattcactccctggaaagggggctcaagctagggagccaagtggtctagctcagtggatctgaccccctatggagcccagcaagctaagatccactggcttgaaattctcactgccaccaagcattctgaagtcgacctgggacaccccagcttggtgagggaggggtgtctgccattactgaggcttgagtaggcagttatcccctcacggtataaaaaaaagcctccaggaaatttgaaatgggcagagcccaccacagcttggcaaagccactgtagccagactgcctctctagattcctcctctctgggcagggaatctctgaaagaaaggcagcagtcccagtcaggggctcatagggaaaactcccatctccctgagacacagcacctgggggaaggggtggcggtgggtgcagcttcagcagacttaaacattcctgcctgccagctctgaagagagcagcagatcttgcagcacagtgctcaagctctgctaagggacagactgcctcctcaagtgggtccctgacccccatgcctcctgactgggagacacctcctgactgggagacgcctcccagcaggggtcgacagacatctcatacaggacagctccagctggcatctggtgggtgcccctctgggacaaagcttccagaggaaagaacaggcagcaatctttgctgttctgcagcctccgctggtgatacccaggtaaacagggtctggagtggacctccagcaaactccagcagacctgcagtagagggccctgactgttagaaggaaaactaacaaacagaaaggaatagattcaacatcaacaaaaaggatgtccacaccaaaaccccatttgaaagtcaccaacatcaaataccaaaggtagataaatccacgaagatggggagaaaccaatgcaaaagggctgaaaattgcaaaaatgagaatgcctcttctcctccaaaggatcacaactcctcaccagcaagggaacaaaactggacagagaatgagtttgacgaactgacagaagtaggcttcagaaggtggataataacaaactcctccgagctgaaggagcacgttctaacccaatgcaaggaagctaagaagcttgaaaaaaggttagatgcattgctaactagaataaccagtttagagaagaacataaatgacctgatggagctgaaaaacacagcacgagaacttcgtgaagtatacaaaagtatcaacagctgaatcgatcaagtggaagacaggatatcagagattgaagatcaacttaacgaaataaagcatgaagacaagattagagaaaaaagaatgaaaaggaatgaacaaagcctccaagaattagggaactaatgtgaaaagtccaaacctacgtttgactagtgcacctgaaagtgacggggagaatggaaccaagttggaaaacactcttcaggatattatcaaggagaacttccccaacctagcaagataggccaacattcaaattcaggaaatacagagaaaacaaagatactcctcgagaagagcaaccccaagattcataatcatcaaattcaccaaggttgaagaaatgaaggaaaaaatgttatcggcagccagagagaaagatcctcctttggaggatcacaaaaggtcaggttacccacaagaggaagcccatcagactaacagcagatctctctgcagaaaccctacaagccagaaaagagtggggaccaatattcaacattcttaaagagaagacttttcaacccagaatttcatatccaaccaaactaagcttcataagcgaaggagaaataaaatcctttacacacaagcaaatgctaagagattttgtcatcaccaggcctgacttacaagagctcctgaaggaagcactaaacatggaaaggaacaattggtcccagcaactgcaaaaacataccaaactgtaaagaccatcaacactatgaagaaactgcatcaactaacgggcaaaataaccagctagcatcataatgacaggatcaaattcacacataataatattaaccttaaatgtaaatggactaaatgccccaattaaaagacacagactggcaaactggataaagaatcaagacccatcggtgtcctatattcaggagacccatctcacgtgcaaagacacacataggctcaaaataaatggaagaatatttaccaagcaaataaaaaaagcaaaaaaaaaaaaaagtggttgcaatcctagtctctgataaaacagactttaaaccaacaaagatcaaaagagacaaagaacggcattacataatggtaaagggatcaatgcaacaagaagagctaactatcctaaatatatatgcacccaatacaggaacatccagattcataaagcaagttcttagagacctacaaagagacttagactcccacacaataatagtgggagactttaacaccccactgtcaataccagacagatcaacaagacagaaaattaacaaggatattcaggactggagctcagctctgcaccaagtaaacctaacagacatctacagaactctccaccccaaatcaacagaatatacattcttctcagcaccatatcacagttattctaaaatttatcacataattggaagtaaaacactcttaggcaaatgcaaaagaatggaaatcataacaaacagtctgtcagaccacagtgcaatctaattagaatttaggattaagaaactcactcaaaaccacgtaattacatagaaactgaacaacctgctcctgaatgactactgggtaaataacaaaattaaggcagaaataaataagttctttgaaactaacgagaacaaagacacaatgtaccagaatctctgggacacagctaaagcagtatttagagggaaatttatagcactaaatgcccacaagagaaagcaggaaagatctaaaatcaacactctaacatccctatgaaaagaactacagaagcaagcacaaataaattcaaaagctagcagaagacaagaaataact

SEQ ID NO: 372 - DNA, 55688 bp, Homo sapiens
ggtctcccgctgcggtgactcggaaccactaccccgcctgtgtccaggaggcgccgcggctcccacctccagcagcacctggggctgtgagtggcgccccccacccacccccccaaaaattcgccgctcctgtggccagctcctcctccccctcccttcccttcccctcctccaccagcccaggagcgcgcatgcgccgccaaggaagccaaccggcactcggcaggccctgggcccaccgggcgggcgcctctcaccgggagcgctcgcggcggcggcggccagatttccttcgcgctctcgctctccggggtttccttttttaaaccggcagccgcaagccgagtccgtgattgcgccccctcccggcgcatgcgtcgtcagcgaccccgcgggctcagacggccggcggaggctctgcgctcgcccctcccctcactctccctttccccagcgcggctcggtgcgcatgcgacttgccccgttaggcagcacggagccgcgccaggggatcccggacgcccgaagagactcccgcgccccttgggccgaaatctggctctgcaggcgcaccgttccctgccccggccgggaacggcgccggttactagaaagccggggaggcggggcctggtcgggtggagggcgcggccggccggcagagcgctagccttaggtcctggaggctctttggctttccccccgtatgccgggggctaggaggaggaagaagagcttcctgccggatgagggatccagaggccagaaaaggaacccgctctcccttccaaagcaaaacactgccgacgccagcttagatttttcgggtgttggcaggagactttttcccccagtggcatcattcgtgtttcctctcctggtgctgggagagaagagttgcaaaggcgcctggaccgccagtaacatcttctcccatctcctgagggagcgcggcttgggttgcttcttcttggtgggtgggcctggggagacagggcatgcgccctcggccagaggagggaagcgaaaggaggtcgggatttatttgctcatttggagatttttcccttgcccttttattaaaaatcaagtgacagtgtaatggaagatggagaatgaagcatcagaaataaaccaggaccctaatttgcatggatttcctcgttggaacaacgtgtgactactacttatcttcgggaaattacttatcttgatgcgttaaggcacatttggtccacatgagaaagcacatttcagtgcttctactggaaaagagatctttacagtcttaattcctagtaattcctatgttttaatgaatatcttttggatttgaaataaaagccatctttttctttcaaaaaatgcacttttctggccgtaaaatcctccctttaaagtaacagtcacctcagtaaacattttcaattcttgctgtatgctctgggcaaaagaacatcaaactgaagcacttattcagatccttgatcctgcacctaaggatttttctttcaggagtgggaaaacatgatttgttaatttaccccatcatatagcagaagatattttggtcgacatttttgcctgttcagcattcattccctattctgataatttcttttgaagaactatcatttatccactctcagtccatatggtctgagcaggacacaaggggaaggcatatttgagtttaatcctcggttgcaaactacggttcctaagaagggtgttacgtctttaccaatgggtttaaatctgggagaatggagacctggagccatctttccacacgtgaattctgagaaagaaggcaacacggaaaaaaagcagatttgaagacaggtttggcctaaagacatgtttgaggcctggaaacaaatgtagattagattcctctggaaatttcgttaaaccagtcagtaaattcttgcatctgttttattgcttaaaccagtgagaggttttctttcacatgtaatcaagagtcccgactgacaagaggtaggtagcaagacggaggcaaagttattaatactgataaggtaggttgcagccagacaagagagggcttgaatgctttccctaggatggatttttgaattttattctagagacactgatccctccttatattccccatcatctagaacatattatcttcaaaatacctttgccctttttaatgatttcattgtcctctcagtcaccaagatcaaaccatgtccatctttgactcctccctctttcactgtatttaattatttaccaagacctgttgataatcccccgtttttctgctcagtcctctctcactgcttgaacatttcccatggttcagttcacagcttctcctttctcccacattctctccaagaaaagaaaaaatgtactggatatgtcttttttttgagacagattttttgagacagagtcttgctctgttgcccagctggagtacagtggcatgatctcagctcactgaaacctctgcctcccgggttcaagcaattcttgtgcctcagccttccaagtagctgtgattacagactcccaccaccacaccagctaatttttgtatttttagtagagatggggttccaccatgttggccaggctggtcttgaactcctggcctcaagtgatccacccacctcagccacccaaagtgctgggattaacaggcgcgagccactgtacccagcctgtattggatatttccaatagcttttccaacttccagatcccacatttccataaaacaaaaatcctgcctcataatttcatagctcctaaatttatattccatagccttaaacataatttcagatattctgttcaccctttcttgtgaaccttgctatcatttaaactgagtatttccaactcctctgtcaactgatttcccccagttggtaggcaacgtatcatagtggttaagagtacaaaattaggatcttaactgcctggatttaaatcatagcttcaccactaatattctgcatgactttaagcaagttatttctctgttctttaatttcgtcatctttaaaatgggataattacaatcctatctcatagcttaaccgagacagtgtgtgtgtctgtgtgtgtgtaattttatctggtacataagaaatcccatagaaatgttggctattcttgtcaatgatgttcctttttgggtaattttcatgtctcttttgctctaattcttgccctaactcctatgtcccatcagtcacaaagtcatatctgttctttcatagtaactcatccattcattgacattcctagttttactaccatactttaaggtgaattggagaacaggaagctttaagatatgcttaatagagaatataaggttaagtatttttttaaagcttgcatagtttattcagttactcatattctttctaatccctttaaaatggaactacaaaaccctgcctcatagttgaggtagtattatagactttgtggtcaaaactcttggcttaaattctgactcatgctgagagatagtgagcaaatcaagtaattcctctgagcttcaggtacttatctgtaaagttacaagactaggcatttcagagaactgtgatgatcaaaggtaaattaaactgctacataaaggctaggtggtgacgatggtggttgtaaatctttacaatttcttgttggaaccctaagaatagttgaaatgactcacagatttttaactccagccttcacttctcccttgggctctatacacacgtctgtttatctacctgatgtctcttcttctgtatcacaaatatcttggatgcttctttcaatctattctccacagagcagtcaaattattttgaaaatataagtgaagtcacattattttcttctaaaaccccttttgtcatttcccattacatacaaattcctaattatggtcacaataacctgtttgatctggcccctccctacctctccaacctcatgtcttaccatttttttccttttcctgtgacactccaacccagaaactgcctttcatttctttgctaatttatctctgctctcaggctttcatgcatgctgtgcccttgcctggacccctcctaccttttctcatggctggctccttctcaaccatcacatctcaaagatctaactaccctatttaagtaggtctccctccaacaccccacctgcccccccaccaccaataatatccaaagttattctcttctgttgtgtccagtttcccccataatacttaagtttaaattatgtatatattagttatatgtatatatgatatttgttttcttattaactattttccctaccaccacaagataaactccagaagggcgagaaccatgtgttttctttgccactatacgtgtagcatccatttcaatacctcaggtgagctgggtagagtgacacgtacatgtagttccagctgagccgggaggattgcttgagcccaggagttaaggaacagcctgggcaatgtagcaagaccccatcactaaaataaattaattaaaatttaaaaataaaaaccaggttgggtgtggtacctcaagtctgtaatcccagcactttgggaggccaaggcaggcagatcacttgaggtcaggagtttgagaccagcctggccaacatggtgaaaccctgtctctactaaaaaatacaaaaaaattcgccaggtgtggtggtgcatgtctatagtctgaggcttaggcaggaaaatcacttgaacctgggaggcagtatctgcagtgagcccagttcgtgctgctgcactccagcctgggtgacagagcaagagtcagtcgaggcaggataatcacttgaacctgggaggcagaggctgcagtaagcccagatcgtgctgctgcactccaccctgggtgacagagcaagtctgtctcaaacaaacaaaaccaccaatgcctgaggtgaatgaatgatttaatgagtgaatgaaatgccagaaagatgatttttagaatcatctttgtcccaaattatgactgtaggcagattattgtcaaggggtagccttagtaatgtgcatgaaagtgtgtccggaatttattccttccggtgggttcctggtctcactgacttcaagaatgaaaccatggacccttgcagtgagtgttacagctcttaaagatggtgtgtctggagtttgttccttcagatgttcagatgtgtccagaatttcttccttccagtgggtttgtggtcttgctgacttcaggagtgaagccgcagacttttacagtgagtgttacagctcttaaaggtggtgtgtccgcagtttgttcctcctggtgggttcatggtctcgctcacttcaggaatgaagctgcagacccccacagtgagtgttacagctcataaaggtagtgtggacccaaacagtgagcagcagcaagagttattgttaagagtgaaagaacaaaccttccgcagtgtagaagggggggccgagcaggttgctgctgctggattgggtgccagcttttattcccttatttggccccgcccacatcctgctgattggtccattttacagagcactgattggtccattttacagaatgctgattggtccattttacagagtgctgatggtgcgtttacaatcctttagacacagagtgctttagacatagagtgctgattggtgtgtttacaatccttcttagctagacacagaatgctgattggtgcgtttttacagagtgctgactggtgcatttacaatcctttagctagacacagagcgctgattagtgcatttacaatcctttagctagacacaaaaattctccaagtccccacccaacccagaagcccagctggcttcacctctcaaaagtacaaaagagaagcaaactaaaatcagtcagtgaaatatgatgtgactaataccgttctagtgattgaatacttgagaaccagcaagaatatgtaacactaatagatacagctaatacttgtaaaaaagatgctgactgaaatctaaaatagggtacaagtgcatgaagtacctcaacttctaaacagctgccaacatttggggtcagatacccactccttcacccaaggataaaagttggacaaaaagggatctaccatagccaaaacctccaactctctaccctcagaccacataagttcaacacttggcaagaggaaaaacacctgacagaatcactgaagccaggttcctggggtgtactatggtttttcctttcctttttatgcctcaccctatcccaagtgaacaagactccaacagaatcagctaggtgactatgagggagggagagtggcatctcattcactatcaaacttgctgatattgccttgtacctacatgaaacaggaaaagagttggagaaatagctggccagggagtgggctgaaataaagcaatctgcaacatctaccatgtggtatagcaaggataccgaggatgtgtaagtttctcatgggtcaatcgatgctgcgtagaaaatgctgtccaggtttgaactatcttgatcctgaagggggaaagaaattctagcagcaagaggctggatttacttctgggagaggaaactaagagagttagcagagatagagctaagactgctccatcgcctgtgttgatcgagggactgtgcagttgggaagctgtttcagagtttctaggagaactcaatgtgccccattaaagagtgaacatttggatgcagtattcattgtacagttaaggaaaatttatccctttcatccctattctctctcccagtccccaacactagagggataggccctgaaagtgttactgatagagggtcttgactgcaaggtgtccaagttctttgcgttttgaactaagaattggacaaaacgccccgcaaagaaagaataaagcaactaaagaacgaaagcagggatttattgaaaatgaaagtacacttcacagtgtgggagccggcgtgagtagtggctcagaatcttctccggtccaaatacccgctagaggcttcccattggccacttcatttcatgaagtggtggcttgcaattggtctgagtggttgccaaaagcaagcaatcagaggctaaggtgaagttacaaagttgcaaacgaactctcagccagcaagcagtgtgattggttgcagacagccaatttcccatctgccacgcacagaaggtgggggtttgcaaagtagcctctggtccttttgttacttaggcatggcaagttagggttttcctttaaatctggctctaagaagttggagtgaaacagccttaggttccctgcctccagaccttattctcctgcctcaaaaggagagggaaaaactggttaaaaaccccacctttcatcttcagagttgcttaagtcacgagttcagccagagaatgtttgcttggaactgacactggagtgttcaactagacagacttaataacccacactgtgggatgggtaaaagaagttgctcaggttgtctttaaaggatttgctgtgtagtgcttctcgaattttaatgtgcgtgtcacctggagatctcattaaaatgaaaattatgattcagttagtctgggatggggccagagattctgcatttctaacaagctccttaggaatgctgctgattctaggaccacatttaccacattttgacaaaaaaggcactatagagaagggagattcaatagagcacacttggcaaaaatagacaaaaatattaggataaaatatcaatttttatagatcaaaaaatgactgaatattggcaattaaaaaaactaactttgtaccccattgaatattcattcagtaaaatggggaacaatattacatattaaataatttctgcatatcctgacaaatatttttaccctagtcaaatgagaatgtatacatgaagcactgtatggaagtagtagtgacctgtgttggtaggcatcaatcagtccttgctaaaagaatgtgtgtgtgcactttgctaaagagcggggctgaaatcacaagcagtcagttctaacatgatataattttattatttttacaaatgtcaaagtctccagaactgtttgtgggtaaaaacttactgccacctggtggatctgagttaagacaaagggaaatagatatcttttttaagctctcctaaatactattattatttcctttgttcttttaactttaaaaagaaaacaaatatgtatttactttttaaaagactacatttgggggaatttctgcatttggtttcaattggaggggaaaataatgtatatgaatgttattttgataaatatggttatatgcattagatgttatatgcattataggcattagagttacattgtaactttagaagatggctcttcctttcatttccacggctgtttttatcctgaatagtaacttatccatccatttctggaaggttcaggaattggataaataaaactagataattacctgaagtgtgtgtaatgctgtaataaagaccactgtgtgtgacctctctgaactttcctccatctagtcccaagatgtatctcagaagaattttcctaatccttcccagaattagatcaattgatttcacctggtgaaataaattctcattaccttactcaaatgtgtatttaactttccttccacttcatgattctctgtagcctctaagatccctaaacccccaccaatagcaagaaagagccttttcttgactcaatgttcaactgcctcaattctcaccaatttatttttgtaatctaggcatttaaacctagtctagattctcttacaaatatcagtgaacatccataatgagaattatggatcatgaatacaaacaaagtagaaaaaaatctgttactgaactattatatgctggatttaccaacctttcctctaaaagtgatgttcattattatgccaagacgaaacatcctataggccttctgcagtgtactaatgtatattttctcatgatgaattcttctgtgattactgttaaaatataagtcatcctacaatatatttttctcacctctgctcaggatttagaaacttacatggtgtagtgttctaatgattctatactttaactattaatgagaatacttagtaattttctaacttaatagtaactactcagaacgataataatgaatagagatgttttttatgtacttttcagaatctattaattgcattatgctattaagtggttaatgttttaataggtaagggattccaaagaaaaagcattatggccataaatttaaaactttttacttaagtctctagattttaaaatgtgttgacttaaataaaatttcatggttttcttacattgctttaatttgtagttctctttggaagtgagtaagcaagaaaggtcttgtaacatttgtgtttttgtccaacatgtgttagaaaaaggataaaccacagaaaaataccaaaggcttaacacaaattctgtttttttgttttgttttgttttgttttgagatggagttacgctcttgttgcccaggctagagtgcaatgacgtgatatcggctcaccacaacctctgcctcctgggttcaagcgattcttctgcctcagtctcccaaatagctgggattataggcacgtgccaagacacccagctaatttttgtatttttagtagagacgggggtttctccatgttggtcaggctggtcttgaactcccgacctcaggtgatctgcccgctttggcctcccaaagtgctgggattacaggcgtgagtcacgacgcctggccgccaaatactatttttttcagaggcaatgaatattctgaaatgcctggaaatttttaaaatgacatatatgccataattctaatataaaaatgaaaataaaataaatctatttatgacttttctgatccctaatataaaagcagtcataagtaaaacattcagtacacatatactaaaagctatttattgaatatttctctctatttggtatcattatcactgttggagctatcactgtcatcatgaatagaagtgtttctaattgaagataccatcatatctaccatgtcttttctggggttttcttccaaatcagtctgtattgctccaacttctgctagcttccattcaagttctgtaataaataacccatcattcagttaaaaatcttgaaaaaatgaataatttttcatctatatgaaacaagagttgactcttagtaatattaccatggaaatgatgatatatttatttataggtttttttttcttttttgagacagagtctccctctgtcacccaggctagagtgcagtggcacaatcttggctcactgcaacctccacctcccaggttcaagtgattctcatgcctcagcctcctgagtagctgcaattacaggtgcacgccaccacacccagctaagttttgttatttttttaagtagagtcagggtttcaccatgttggccaggctggtctcgaactcctgacctcaagtgatccccctaccttggcctcccaaagtgctgggattacaggcgtgagccaccacgcccagcctgatgatatctttagaaccgggtgacagtaaaagtgctacaatatcaaaatacacattggatacagcaaagttatactgaaagggagaaattatggttaaactgggtcttagtctgttttgtgataacagaatacctgtgacttgagtaatttataaagaacagagatttatttcttatacttccggaggctgggaagtacatggttgaggggcctgcatcaggtgagggccttcttgctgaagttatcccatggcagaattcaagtgagttagagaaggtgagtgagagagagcaagacagggctgaactcacttttaaaacaaacccattctcatgacaacaactccatttctgcaataatgacattaatccattcatgagggcagagacctcatgacctaatcacctcttaaggtcccacttctcaacactgttttactggggattactaattttgggggacacattcaaatcataccattccaccccagcccccaaaattcatgtcctctcacatgcaaaagacatacattctatcccagtagcccccaaagtctcaacttgttccaacatcaactcaaaggtccagagtctcatctaaatcagatataggtaagactcaagacacaatttatactgaggcacatttccctccagctgtgagcctataaaattaaacaagttggccgagcgtggtggctcacacctgtaatcgcagcacttcgaaaggctgaggagggcggatcacctgaggtaaggagttcaagaccagcctggccaacattgtgaaactccatctctactaaaaatacaaaaaaaaaaaaaaaaaaaattagctgggcgtggtggcaggcacctgtaatcccagctactcaggaggctgaggcaggagaatcgcttgaacccaggaggcagaggttgtagtgggccgagatcgagatcgcgccattgcactccagttgggcaacagtgcaagactccgtctcaaaaaaaaaaaaaaaagaatgaagtgaaattttaataaatggtgttgaaacaattgcattttcttacagaaaaaaagtagacacattcctgatatggtttggctatgtcctcaccctaatctcaccttgaacaatagttcttataatccccacgtgttgtgggtgggaggtaattgaattatgggggttgttacctccatgctgttctcttgatactgagtgagttctcataagatctgatggttttataaggggctttttccccacttcacttagctctcattcttctccttcctgctgccatgtgaagaagaacacgtttgcttcccattctgccatgattgtaagtttgctgaagcctccccagccatgctgaactgtgagtcaattaaacctctttcctttataaattacccagtctcaggtatgtctttattagcagcgtgaaaatagactaatacaataccttacatcaaatgatacacaaaagcccaatgttattcaagacctaagctcaaaaatgaaactttaaaactcttagaagaaagtataggagaatatatttttcaccttgggaatacagaaagcttttcaaaagaaagcacgaaacatgcaaagtaaagaaaaagattaataattttcactatgccaaatcataacttttatctgacaattgaaatgataagccataactggtgagaatatattagtaatactataaaaatagtatccagaactttacatacacattcatgcacacatacccactcttataaatcaatgaaacaacatatgcacacacacgcactcttataaatcaatgaaaaaacacaaatgacaaaatggacaaagtatataaacaggagaggaaatcagaatgaccaatgcatatgaaaaaatccataacctcacttgtaatcagggaaatccacatttaaacaatgaaatgataccaacttcatatccatcagattgaccaaaaaaccaatagtctaaaattaacaagaactggtgaagatgtgggtatatcttcaaacaccgatggaaggataaattgatactttcatttacagagcaatctatcaactatcaagtgaagttgaaaatgtgtataccttatgatcccacaattctccatatatccttgagaaaatttttacaggtgggcacaacaatggtcacagcagaattgttcataatgggaaaattggaaactcacatttcacacagtaggggaatgataaattgaggaatagctgattatagaatgctagacaggagataaagttattgaatcagacatatatgaaataagagattctgaatactatggttgagatttttaaaaaagcaagttgcagaatgatactacaatataatgccctttattaaatactttcaattttgcaattaattattccttctatttctatagatatacttaagttaaagcataacaagaagaccagatagttctttttaaaattaaaaatagaattaccatatcatctagcaattccatttctgtgtatattcccagaagaattaaaaacggagatgagcatattatttgtacacacatgttcataacagcattattcacagtacccaaaaggtgaaaacaacctaggtgtccattaacagatgaagggatacacaagatatacttaaaaaggaaaaaaattctgataacatgctaccacatggatgaaacttgaggacattatgctaagtggaataagtcagtcacaaaggacaaatactatatgattccacttatatgaggtatctagagctgtcaaattcatagagacagaatctaaaaaggtgattgcctgggctgaagcaaatggagactgaggagtttttaacgagtacagagtttgttatgtaagatgaaaaaacttctggcgatggatgatggtgatggaatgtgaatgtgcttaattccactgaactgtatgcttaaaaatagttaagatggtaaatgttatgttatgcatattctactacaatgtttaaaatataccaataaatttcattgatatctgtctcaaaaaaaaaggggggggggacgagatacacactaaattcgtgatagtttttgcccctaaggaagcagggaggggaacaggactaagtatggaaatacaggtaacttcaactttatctgcaatgtgtttttaaaagataagcaaacaggccaggcttggtggctcatgcttgtaatcccagcactttgggagtcaaatgcgggaggatcacttaagcctaggagtttgagaccagcctgggcaataaagtgagaccccatctctactataaaatttttcttaaaaaatagttaggtgtgatggcaggcacctgtagtcccagctactcaggaggctaaagtgggaggattacttgagcctgagaagtcaaggttgcaagtgagccataattgtgccactgcactccagcctgggtgacagagtgagatgctatctcaaaaaaatagctgaagcaagcataaacaaatgttcacatttgttacttttggtaattactatggtcttgaatgtttatgtctccccaaaattcatatgttgaaatcctaatgcccaaggtgatggtattaagaggtggggactttgggagtggttagaccatgagggcagagaactcatcaatgaaagagtgaacagagaggccaaaaggagcttgtttgccccttccaccacgtaaggtcaatgaagaggtcaccatctatgaagaacaggccctcagaaaacaccaaatctgctggcgccttgatctgggacttcccagcctccagaactgtgagacattaatataaagtttcttgtttataagccacccagtttacagtatttttattatagcatcccaaacagagaagacaataatgatttcatgaatgcttactatattattattctatgtattcttttatgtactcttatgttgttaatttttttaattaaaaagaaaaggtccaagctacaaaaaacaaggtggtgaaacaaggaaaggccttagaagattaaaagaaaaatgggaaaattctgaaacaaagtatcagaggtctcggtaagggcaaaaacagctttgggggactgacagagtcaaagaatacctattgaaaacaaccagccaggggcagaggctcacgtccgtaatcccatcacttttggaggctgaggcgggcggatctcctgagatcaggagttcaagaccagcctggccaacagggcgaacccccatctctactaaaaattacaaaaattagccaggtgtggtggtggccacctgtaatcccagctactcgggaggctgaggcagggagaattgcttgaaccagggaggcagaggttgcagtgagccaaggtcatgccactgcactctagcctgagtgacagagcaaggttctgtctcaaaaacaaacaaacaaacaaacaaaaaacaaaaaccgaaaacagccactcatgatgactttaacacaatggtgagagaaaatgatttttagttttgtaaaatcgagttaaagcagtgccaaaaaatgaatatatcaaagagatgaccttaggaagtaaaaacaattaaagaagataaaaatagaaagtcttgtgttgtgtgctaagaaaaataaagtaataggaggcatggtccatgcaccttttaggaagataaaattcaaagggaattgattcatcaacaaaattagatatcatgctaataagtgaaaagaaagatgcattgagaatatacactacagaaattcagtagagaagaaaaagattacgaattggtccaatattacataatgcagtaaataaaaattgaacagactcatgaaggaataaactttggatttggataatagagaaaggtagaatacattaggtacaagcagagaatgtgtaaaaaaagtgtgatggcacaaatgagtaatgtctatttgtgggttgtggctgaagaccagcctaacaggaacagaaactagcaagcactgagaaatatagttggagaggtgggtggagattctaaaggagaagattctaaatttttaatttacttgagacagggaactattaaggattttaagcaagggggtgttattagagtattactataggaaaattaatctggaggcatataaaaagagactagaagcaaggaaaaaaccttggtactaaggaagtaagctttcaggatgcttgttagtttgcagatgttttcacctatcatttttataaacaaaatttgtaacattaccttccagcttgagatttatccctccacattctataattccaatgaatttggcttctatctgaccatttttatacacaaaaattgttggtaaacaattgtcatggtagtgttgaatacagctattcacgatggctttaacaaatttagtttctggaaactttcttgctagaagactaagatgctggttaaccaacaaacacattgggatgctaaaaagagaaacagtacacacaatctttaataaatgggctactcatctcagtctaatgaaataagtaaaatatcgccatggcaaaaatatatcttagattaatataaaagcacattattatcatcctctattgttacctttagcaatgaagaactgtatgtagagtcctctggtttttattgcaagcaccattataacccgggaatgaagctagctaccatggcaagctgatgcttaacttagggaaactacattcaactgagcatcagtttggttcaagcaggtacccagtttgtagaaaaaaaaaaaaaaaacaggacacttctaggaaatcctttgcagttctgagttgaaacaaaaggatcccaacccttgctgccatcatgagcttctttccatgtaatgagtttaccatatccagaactgtctttcctgactccaacaaacttcttccagtctttggaatcccactccatgccacatcctggtggcccattatccagaactattccttaccagaaatttaatattgattggaagtgtgaccacaacctcagctcttcctgctttatcacttaattctcatcacactccttgatcgattagtcccttttctcccagtttatccaactttcaagtgaatcccttcacctctactttattccacattccttccacctcccttgggatctttgttggttattctgcttccctcttttcctgttttctcatctttccttctccaaagactctttctccattttacataaacatattcaatttgagccgggtgcagtggctcaagcctataatcccggcactttgggaggccaagatagacagatcatttgaggtcaggagttcgagaccagcctggccaacatggtgaaaccctgtctctactaaaaaatgcaaggttttaggggccaagggaaaactttgccctccaaaggaaggttcactgaaagatcaactaacaaaaggcaaattaattggagaaaaggcacacaagtttattaacatgtacatgagagaggaaacacaaagtgattacccaaaccctccaatgggggacagaagcttatatgccatcttgaggctacagaaagaatggaggctctggcatggccaaaaacatgttattggggtaaatcaggttacagtgacaagacaggctatgggaggcagagaagaggaggcctggatagcaaaagtggtgttgttatgtagatgaaaccttacaggtagcagccctcaaagagaatagatggtaaatgtttcttttagacctttcaaggcatcagattctcagttaactttggtcctaaatcagacaagggaaggccctcagagaaggcctgactgcatgaatgcagattttctctacagttgcaaatcccctccacaaaagacagctttacggggttacttcagttttgctggctctctgaacacccatctcaaaatatgtcaagaaagtatatcttagggtaaaatgttttgatttccttcaaggtgaaatgagtccactaatatctaattcagagaaattttataattttcattagaaattttgtcagaatgaaagctcagtcagtggtacaacagatatttgtggggtgggtcagtagtgtgaatggcagaagtcaggtaggtattggtggtggcagtgaaaagtatagaattaagagaatattgcataacagattgtgatgcagggagaaagggttgcccgaagacagttctgacagcaagtagtaggggaacaaatttggtgttggggctcagggccagaattttaaccccagaagagctgtaaaatatgaggcagacctctaacatcacaaaacaagttaagagactatttatggtattcaagcttcaaaatatacacttgggtataagaataatataaaagccccaaattagaattggggtacaggcatagattaaatagaattggggtacagggtaagattaaataaaaccagaaacaagactgacttaaagctaaatcattgggcttactggcccaggttgagttagatccctctaaggcaccttaaggaggctaagccttcattccgataaaaagtgggtctaatcctatcaatttgatggcaaagagccattgaaattatagaatttaggagcctaatcaaaaaacaaacaccacccttttataaaattgatagaaagtagctaaaaatgaaaccacctttgtaaaaattttaacagtgagagaattatgacagtgaaagagatttgatctaaccaactcccatcttccctttaacctccaaactgccccgaatcattcctggacttgggccaagctaactctgggagaatttcagtttacagtttaaatgataatagcttttccccaaaactaaaaccacctttgtaaagctaagggaagactaggttaggaggatgagaggagcctgaactctgctatgatacacacttaaacaattaccagccattattctggaagtcacaagatttgcaacttcctcaattactcctgcaggtaacaacactattgtagaacctaagattggtcttttttatatatcttttaaggtttttgcatttctgatgactgatgcctctacctggacccaccaagcagtactgtggccccatacagaagcagacttagcacacatgaggactgtattagtccgttctcatgctgctaataaagacatacccaaggctgggtaattataaaggaaagaggtttaactgactcacagttcagtatggctggggaggcctcaagaaacttacaatcatggcagaaggggaagcaaacacattcttcttcacatgtggcagcaatgagaagtgctgagcaaaaggggaaaagccccttataaaaccgtcagatctcatgagaactcactcattatcacaagaacagcatgagggtaactgcccccatgattaaattacctcccgccatgtccctcccacgacaaatgggggttatgggaaatacagttcaagatgagatttagtgaggacacagccaaaccatatcaaggatcattttctacatccctatgattgcattcccaaccaatcagcagtacccattctgtggtccttgaaaaacctcagcctccaaattttgggggaggctgatttgagtaataataaaactctagtttcctgttcaactggctctgcatgaattaaactctttattgcaattcccctgtcttgataaattgactctatatgggcagcaggcaaaatgaacccattgtgtggttacaaaaacataaattaacagctgtccttcaactttacaatattaaaaagctgtaagtaaatccatttttctgtttttttttttttttttttttttttgagatggagtcctgctctgttgcccaggctagagtacagtgatgtgatctcagctcactgcagagctgcctcccaggttcaagcgattctcctgcctcagcctcccaagtaactgggattatagggacacatcaccatgcccggctaatttttttgtacttttagtagagacagggttttgccatgttggccaggctggtctcaaactcccgacctcaggtgatccgcccgcctcggcctctcaaaatgctgggattacaggcatgagccaccgagcctggccagtaaatccactgttaaaaactaaagttttctaaagaatatttgtaacacaattattttctgttatattttataaatttagattactacagattaattttcaaaatatatgttttataccaacacaggaatgtattttcctttttctcttttttttttttttttgatttggagtcttgctctgtcacccaggctggagtgcaatgatcttggctcactggaacctccgcctcccgggttcaagccattcccctgctttagcctcccacattgctgggactacaggcatgcgccaccaagcctggctaattttttttttgtatttttagtagagatggggtttcaccatgctggccaggctggtcttgaactcctgacctcaagtgatccgcctgcctcggcctcccaaagtgctgggattacaggcaatgagccaccgcacccagccccaggaatgtattttcttaatgtccagaaaactaatatgtaactactttagagtggcccagaaaaaccttctgagaaggtttacttaaagtattatgaaaccacatccttctttttgagtctatcaaagcatacaacaatttgaagcagactaaatcacattcaacctctttatgaatttttaaaaaattatttctaaaaactagtaatttatctggaagtaaccattaagctagataattttacttagaagccatatctactctgctaaccacacaggatcagaaaaaacattcagtaaaccacttcagtatataatatttaccacaaacagatccttgttttataaatgtccgtgtttctcatccttatttgtgagatctacaagcagcatttacaaactggttaaccaaataaatagtataggtaatatggaagtgtgatttcaggaaataacttttctctgaagaatgcaagtccttttaaatgtttacccccacggagtcattaaaatgagacagcaggccaggcacagtggttcacgcctgtaatctcaatactctgggaggctgaggcaggaggatcacttgaagccaggagtttgagaccggtctgggcgacataacaataccccatttctacaaaaaaattttaaaacctggccagatgtggtggtgcagacctgtagtccaagctacttggaggactgaggcaggaggatcattgcttgagcccaagcattcaaagctgcattgagctacaattgtcactgtactccagcttgggaaacacagtgagaccctgtatcaaaaataaaaagagagaatcacaacctactccctccttgacctatgtattcatctcttgaaactgcttgctattgcttgcaagtagctatgaatcaacccaataatacttcagacactgtaacttttatagcttaacaatatattgccagtcactaatcaatgttatttccttaagccaaagagaattcctgacaaacaactttgtatcagtccactccctgtcctccttttatgtcttcacaaacctgctcataacaaaggctaaagggagatcatatccaaaggtacttgggtttagtcttctgggcagctatcctcactttggctcaagtaaactctttaaattatattttgtgccccagcctcttccttttaggtcaacacattcttttaaggactttaaagctacttaaaaattaatctaccaagagttttagttataataaaataacttttatggggcattttcttttatggggcatgttgtcctgtcaaaatttgactcaggaactgcgaagtatagccatacaggctatacagggttatatacagggctataatttgcataaattgctctgtatataatttccctgaggacctaaagataaaaacatttattattcagagattgagataaggacagtgaaggttgctgtcatggcctctgttcctagaatggtttatagccctgaggcagaggggtagggacctaaagctagaaggactgaacgagagaaacattcaaaagtctactttccccatttactaggcaagactggtgaggcctagggacagtgggttatacttagtacaaccaggtatttttaaattaactgtcttggaggaatgggggagtgcaggggtgcagggaaattgttctattagaagagacttcagagagctgatatatctaaatgtgctgcataattcttgattgactccttgtccaaaacatatgtattcataaaagatatttttaagtcagtcgggaaaatctgagtaaggacgacgtattagatggtattaggaattactgttaattttgttaggtgagaaaatggtattgtggttatgtagaagaacgttcttgaagggattcatagtataccacaccaaaataagccactctggcataaggattattttgagctaaagacaactgaaaagaaacagacacaagaaaaatattctccacccagtaacatcctcactcctgtctctaccaggaagggcaggacactcttaatcactggataaagctctagattcttatcattccagtgaggcaccagaggaatctatataacaaaccttgctaaaacaacctttaattttgattaaattaaacactctaaatatcgaccatatagattcaacaagttgaatacatagtttcacccatgtatttaccatcccacagtttgtcactcctagaagctcaaagaccctttctgttgtcttatcaattctctacaaatttgctgttcttttgttaagaatctatataagcccaagttctaaccacccctttgagttacttatcactgagctctcctatgtgtatgtgtaatgcacttgtaaatagacttctgtttgtttttctcttgttaacctgtcttttgtcagtccaacttgcagggccccagccaataaacctaaaatgggtagaggaaatataatttttttttctttccaacacctttatgttttgaaggtgcatgctgaagtacacaggaataaatcatcatgctatgttcagtttactttcagttcactttctacaaatgcaaatatacacacacacagaaacagttatataaatatggcagaaggttacttgttgaatctgtatggtcgatatttagagtgttcattttctcattccttccacttctctgtttttgagatattctataataaaaagtttttaacaaaactaccaaagagtgcttatttttctaaaaagtgtgacaagttcctgaaattagaaatgaaaagatcttaaaatacctaatttaatccctgaagccaatgactatcaaaacctctatggatgtatatgtgtgcaatatatagttgctttttcttgagtactgttatatactttgtaaaaccttaaaaccaaaaatatgtcttttaaaatagtagtatattaacattttgaaatattatggtaattaccttgatctgtatagatgaattataacccacacatcttcttctgcatttgtgacttcattcacatactgatttccagaaatttctcttaattctccaaatttttgttttttcttaagagctttccattcctgtaaccgcttctttctaattaaaacatgaaattaaattacataagaatactgtcatattcttaaggtcattctcatatgtaataacaatttagggcaatgaatataatgcctatccatatcaaacactttaaatgatgggataaccatgaatgatcttataaaaccaatttctctttttatatgcaaatttgtgttatcatggttattggaaagtgtaagaagtttgctattgacttttaaatttgtttgtatttaagactaggtttaaatcatagctatagagagtttatctagatgttgtgccaacaaattctcatgtacaagttgaatacttcattaaggagaataatgatatccaacattaaccaagtgcttgctatgttaccaggcactattttaaatacataacattaatgaacttaatccttgtaaaaatgttacaaagccagtactattattatccccatttaaatgttagtaacagtcatgctaagatgatcttcacttcgaagactttgtggatatttgtaattacttgttataaatatagatttattatagacagagaggtagtagaggagagtgattatgagcttggattctaagctcagactacactgggtttaaatgccagttccagtacttgttaatagcataaacttgggcaagttgtttaatctctctacacttcagtttccctaactgtacatgggaataatactaatagctactcacaagggattactgggaaaaaaatgaaataatacatgtaaatttcttagcagggtgcctgacacactgtgagcattcaataaatgttgctacctatttatctatccatagagaaccttgaaactgtttaaaaaaccaactctctcaacatttacataatttgacaatttcgctgttgaacgcctggattcatgaagcaaatctaaatggtttctgactgtctgcaagtttattaacatttaatgattctatacctctaagtttgctggaagtatttactccttttctttctctgtgtattaaccatattttcttattttatgtattcttgatgctctggcatctgacacattgctgattctgtagagtctgcccctcccagggctagtgaactccatgaaatagcaaacactgttcaaacgcaaatcaatctagggcccataccctcaatcacttcatttatcagactgagccatgatcccctgccctaatcattccagggccaggtaccaaacaactagagatagcctctacagcccagagcccaccaaaattattgaaactagccaatcctaactctgcttaccctgccttgccatgtgtttcccacagaaaccataatggaagccttatgcccatgctttccccttgctccttctgacttctgatcaattcaggtgcttcactgcatggcccctgtgtggcatgatgtggcatgcacccctcccttggaaactgtgagtaaccaactatcctttcaatagcaaccatatcctgacacacttgaataaaaacaaaaccctgggtatattttaaaacatttttagctgggcgcagtggctcactcctgtaatcccagcactttgggaggccgaggcgggcagatcacgagggcaggagatcgagaccatcctggctagcatggtgaaaccccgtctctactaaaaatacaaaaaattagccgggcatggtggcgggcgcctgtggtcccagctactcgggaggctgaggcaggagaatcacttgaacccgggaggcggaggttgcagtgagctgagattgtgccactgcactccagcctgggcgacagagtgagactccatctcaaaaaaaaaaaaaatttttgaccttatttcccatgctagaaacatttcaagtaaaatctcttactttacataaccagtaatccaagcaaaatcaaacccagaggagaatgccaaggatagtaacccaaggctggggacctctcatagttttcaaattgaagtccttcaatttttcctccactggcccagatatttggaacctagagttactccacagttcttatgggagccctactttgtttgcaccgagtatctaacttcccgcaatttgatcttactggcttaatatcattcagaaatttcaaaatattcttgttccaatgatgacaccatgctctaatggtgcaactatcaacaacttcccttcctcctctcctcttccacttcttcctccttctcatttctctgttatttcagtggaattgggcaggggagaacagtaaatacatgggctggttttgccattagaagttcaaacagtgttcaatggcctgcgtttttcacctaacaagcctatcagttgggattcagttgcataaacagaaggcccactagctattttaagcagaaaagaacttaatatggggggaattaaatgctttatcaacccaataaaaagaaggagcaggctctagactgggataccaggaatgactcccagaacaacatgcaaaactggtatgccaaggctttctctaccacaatccagaaactagggaatctggaactaccacactattgttggctttactatcaaactattctgagaatcagaaagccagtgtaacaacttttgtctctagaaacctatctccttagtaacaatctgaggatgagaaactgttgccaaaataatggctccattggatactatgctccacacctggatgaggggatcaatcatatcccaaacctcagcatcatgcaatataccagtgtaacaagcctgcatgtgcatcccctgaatctacaataaaagttgaaattataaaacaaaaaaagaataatggctccaaaaccatgatgcaaattctagattagtaccaactaaatggatgctttgtgtgtttcttcttcttcttttttttctttgggatggagtctgtctctgtcgcccaggccggagtgcagtgggtgatctcggctcactgtaagctccgcctcccgggttcacgccattctcctgcctcagcctcccgggtagctgggactacaggcgcccgccatcacaacaggctaatttttctatttttagtagagacagggtttcaccgtgttagccaggatggtctcgatctcctgaccttgtgatctgcccacctcggcctcccaaagtgctgggattacaggcatgagccaccgcgcccggctgtgtgtttctacttctttccccacttaattctgaattcaaatccccggtgaaatgtctaaatcatattctttacctttattgcaataaagtctgagaaatatccttttagttttttagcttccatggtactggaatacaccaagagaaaggggaatatatgtcaaaaaggccaatttagtattatatgccacaaacaatatactgcagatttgtttattgctgtgtataaatttttttcatctttttagctagaagagcttctgagctgactcccttgttattttacagctaattatctacacaataacatttgtctctccttttttgaatattacatctttttttaaaagaaatcttgtccgaaggtactggctaggacctattgtatggtgtttaataacagagatgaggcctggcgtcatggcttaagcctgtaatcccagcactttgggaggccaaggcgggcagatcacttgaggtcaggagttcgagaccagcctggccaacgtggtgaaatgctgtctctaccaaaaaatacaaaaattagccgggcgtggtagcatgtgcctgtagtcccagctactccagagactgaggtaggataatcacttgagcccaggagacagaggctgcagtgacctgagactgggccactgcactccagctggggcaacagagcaagactctgtcctcctctcccccacaaaaaaaaacagacatgatagtgaacaattcttctttttctcataatagtaacttttaatgtttgttaaaatttttatcaagtaaaaaaaaagttccattactttagcttatcactagtttttgtttgttttttgtttgtttttttttttgagacagagtctcgctctgtcaccaggctggagtgcagtggcatggtctcggctcactgcaacctctgcctcccaggttcaagcgattctcctgcctcagcctcccatttatcactagtttttaaaaaatattttcttgctgttttgtttttactttaaatgaggaatttgctttaaatcagcactagcaagataagtacagaatttcttaagaacaagtaatatttttaaacattcaggtacagaaatgaaaataatgccataatttggtggcaactaaatttgtgattttgatgtggaatacacaaataaaagaatttctatttatggtatcgctctttaatctctgtggtagagacaggtagggtgatcatcattgtagctttctcttctggggaagctacatttacctgaaagactacatttgccagcttgccctgcagttggattagggtcatgagactagattacaacccatgccacatgagtgaaagtgatatatacatttcaatgactcacccctaaaatgtcccacgtgacctttcacactttctgattcacacaactggaagtaaaggtttctgagattatgtagcccctaatgaaacagcccaggttcatagtcattgcctggaggagagctactcaggagaactataggataagcatcaaagaattgtgcaaccatcaccactacctaattcaaaaacattttcatcactccacaataaacccatatctatttgtagttactccctatcccctatcctaggccctggtaaccaataattgtgttctgtctctatgactttttgtactggtttctttcccctagcatgttttcatccatgttgtagaacatattggtacttcatttcatttgaattatggctgaatagtattccactgtatagactgatgacatttagattgtttccattttgaggttattgtgaataatgttgctatggccattcctatacatgttttgaattttcttgggtatatacctagaagtggaattgctgggtcatatgctaactttatatttaaccttttgaggatccaccagactgtttttcaaagtggctgtaccatttacattcccagtggcaattcaaagggttccaatcctcaccaatttatttattataaccaccttagtgtgtttgaagtagtctcccaatgtggggtcttccctaactccaatagttagtgtcagaattgaaatgaattgtagaacacccagttggtgtccagaaagttggagaattggttgtgggggaccctgccccaacatttcatgtcagaagtggtatgagtaaaacataccagaggaactaaaaagtacagtaactaaaattaaaaaaatacattggagagttccaaaagcagatttgaggaagcagaagaatcagcaaccttgaaaataggacaactgcaatgatcaaatctgagaaaaaaaaaagaatgaaaaaaaaataaacagggcctaaagggtctgtgggatgatataaagcagaccaacacacatgttgtgtgaatctcaacagaaaagagagagaaaagaagcataaaggatattttaagaaataatggctgaaaacttcccaaatttgatgaaatacattaatctataaactcaagtgtccaacaaactccaagtatgataaaagtatgataaactcaaagacacccacatggggatacatcataaactactgaaaggcaagaagagacaatgagaatcttgaaagcagagagaagcaagtcatcacatacaagggatcttcaataagactatcagccagtttctcagcagaaattttggaagccaaaaaggcagtgagttgatattttttaaatgctgagagaaaacaactgtcaaaagcaagaattcgatatttggcaaaactatgcttcaagaatgagggtaaattaatgcattcctagatttaaaaaataaaaataaaaacaaaaaaacaccaagggacctagacctgcctaaaaaatatgtgaaaggagtccttcaggctgaaatgaaagagcaccagatagtatccaaagccacatgaagaaacgaggaacatggtgaagttaactacatagggaaatataatagccagtattaccatttggcttttacataggaaaatgtaaaagccattattggaattggtttcttttttttttctttttgagacagtcttgctttgttgcctaggctggagtgccgtggcgcgatcttagcttactgcaacctctgcctcccaggttcaagcaattctcacacctagcctcctgagtagctgggattacaggggtgtgccaccatgcccagctaaattttttgtatttttattagagacggggtttcaccatgttggccaggctggtctcaaactcctgaactcaggcgatttgcccacctctgcctcccaaagcactgggattacaggcgtaagccatcatgcctggcctagagttggtttctaacttctctttttttcctgtatgatataaaaggtaaatacataaagcaataataataatctatgttaatggatgcacaatatataacaatgtagtctgtgacactaacaaataaggagaaggatggagatgtgtttacatgctattgactctaagttggtattattcaaagtaggccactgtaagacgttaatttttatccttaagataatcactatgaaaaaactaaaagatacacagaaaatgaaagaagaaggaaataaaaatggtacactagaaaaatcagctaactgtgaaaagaaagcagtaatggaagacttaaaaaacaaaaattatgtaagaaatacagaaaacacctaagtagcagaagcaactcctttcttaacagtacttactttaaatgtaagtgaattttaaattaatatgattaatctccaactaaaggcaaagactggcaaaacaaattttaaaaaaagcatgttccagatttctcagtccttttttttttttgagacggagtcttgctctgtcgcccaggctggagtgcagtggcacaatctcggctcactgcaacctctgcctcccagattcaagcaattctcctgcctcagcctcccgagtaggtgggattacaggtacaggccactacacccaactaatttttgtattttagtagaaacagggtttcaccatgttggccaggctggttcgaactcctgactcaggtgatccgcctgccttggtctcccaaagtgctgggattacaggcatgggccactgtgcctggccttctcaggcctcttttataagagcattaatcccgttcataaaggggtagccctcatgacctaattacctccctaaggctccacctcttaatgccatcacattgggaggggattaggtttcaacatatgaatttgggggggacacaaacattcagaccacagcaccatcatttagtggtttttatggaggtttcattagataggcatgattgactaaatcgttggccactggtgattaactcaatctctagcccctctcccctctccagagagcagggaatagtgttaaaagttctaaccttctaatcacatggttggttcctctggcaaccagccctcatcctaaagctactaggatcccctccaccaaggatcatctcataagcataccaaaggtacttttatcacctagcaaattccaagtatgtttgtgtcaggaactggggacaaagatcagatatatatttctcattatcacagttccagaatatcttttattcctgtttataacttctatttctttattgatattctctttttgatcatacattatattcctatctttttagctctttaagcatccgtaagatagttgtcttaaagtctttgtctagtaagtctgacttctgggcttcctcaagtacattttctgtcagtatattttgttcctttgaatggactatactttcttgtttgtgtatgccttgtgatttttgttgaaaactagatatttgaatcctataatgtggtaactttggaaataagttctcctcctttgctggggttttgtttttgtttttgttttaattgttgtaggctgtctttgtgctggcgatcattctgaggtagaagctttaaggtcttctcaggtattttttgagcctgcatcttccccggagtaaatgcactggctttctatattttcccaaaagcacagtttgttttgaatctttaaaaaaggttatagctcttttaaattctctgatagctgcctgagccagtgggagttcacacaatggcagtgagcctctgtccctgtacatccatgttcagaaggagcaatctgtaataagaacacagaaccccaatatttggaggaaaaggtccttattgtccaccctggctccagcaagctgtgtcagaaatacaggttgtcagctgcctgtcatggagctaggggttgagcatgaacagctgctactgaactgagggctgaaatcaactgatactgccatttaccagccaagttttcacttggaaactacaagcattcaatattctccagagtactaaaacagtcacttcagacagttcctgctagtacaatctttgattaggtagagatgtatttttggagttccctattctgctattttccctgatgtgtcatcagtgggtttttttttttaatgagttcttcaattagggtttatttgaagttttcttataattaaagttatgcattactgaaaatgataccacagaggtgatatgtccttctcagtacaacataccaggggttacttgatcacctcccagcatattttactggtgatattaaccttgatcatctgcctaagatagtatctgcctataaacttactatttcctcctttataattactaaatatttggggaagaattctttgaaattatgcaatatcctgtttgtgtttaaactttcaaccaatcattttagcatccatcactggatcttacccataggaaattaccactgttctgatggtgatttttctatttctctaatttcatttacacttattaattaaaactcttctgtaagggagagagattacttcttccaaatttgttcatgtattaagttatttatttatatcactatggacttttataaatttatttcattatttgctttacaatcctatcatataattattgattttgttgttcaagttgttctaactttggcccttgggagatctgtccatttgactcctgggactttttttttttttaagtacttccttacctactggcaacataagatgcttcatattcatattatactttcctaacacacaccgtgggatcaagcagttcgctaaggagcactaattcctgttattagagaatagtatttatttgttttttgtttgtttgtttgtttgtttgagatggagtttcactcttgttgcccaggctggagtgcaatggcacgatcttggctcactgcaacctccacctcccaggttcagcgattctcctgcctcagcttctcaagtagctgggattacaggcatgtgctacaacgcctggctaatttaaagacacgggtttcatcatgtttgccaggctggtttcaaactcctgacctcaggtgatccacccgccttggccttccaaagtgctggaattacaggtgtgggtcaccgcaccctgcctcagaaagatctgagtgctatatgtgctcattgctcctggagtatggctgttgtaactccattcactggtggcttttggtttttatttttgttttgtagagacagggtcttactatgttgaccaggctggtctgtaactcctagcctcaagcaatcctcccaccatagcctcccaaagtctgagattacaggcatgagccactgtgcccagccccaattcactggttttttgtttgttttttttttcgaggtggagtttcgctcttgttgcccaggctggagtgcaatggcgcaatcttggctcaccacaacctctgccccaccgggttcaagcgattctcctgcctcagcctccagagtagctgggattacaggcaagcaccaccatgcctggctaactttgtatttttagtagagacggggtttctgcatgttggtcaggctggtctcaaactcccgacctcaggtgatccgtctgcctcagcctcccaaagtgctaggattacaagcatgagccactgtgcctggtccactgtttttttattgttaaaatgatcttgcattcctgcaatcaatactacttgatcaagatttattatttccttaaattgctggacttaatttgccaatatttccttaaagattttgtgtttacagtcatgagggatatttgtagtactctgttttagtgatgtctttgtctggttttagtatcaggataaatactggtcttgtaaaaagtactttagaaattagaacaggttcatacatttcccaacttattttagttgtgaagtaagttgggaaatttatgaacctgttccagtttctaaaataatttaagaatagtaattaattattcatgaaatgatagtcacctttgacagacatcatgctagaaggaaaatcatggccatctttttattggcctcttattgctattttccactttaatcgtatgtagcttgatgaagttatattgtacatgattggataattttctattaaatcaaaggcaaaatattaagaaaaaatgatgtaatgatgtaataaaattccaccttatataaagggagtttcaaaatgttacttaaaaattagttttgttctttgtaaaatctatgtgacaagacaaatctctttagttttattcttattatacttcattcaaaaatttataattaacccaaatgaatcactgtacctatatgtttcaacagcctgcatatcttcttcatcaaattcatcttcagcttcctttagctgtgcaagagtcatcttttcaaatggtttcactaaaacaacataaattatagattatcaaattgtttaaaaatttttttactatacagtcaatgtctagaaaaaaaccgtcttatacaaaggagatcaacagtatctttaaacagccgggtgcgatggaatcccagtactttgataggtcgaggtgggtggatcactttaggtcaggagttcaagaccaacctggccaacatggtgaaaccctatctctactaaaaatacaaaaattagtcaggtgtggtggcaggcacctgtaatcctagctactcgggaggctgaggcaggagaatcacttgaacccgaatggctgagtttgcagtgagctgagatcgcaccactgcattccaccctggccaacaaagttagacttggtctcaaaaaaacaaacaaaaaagagtatctttaaacaaacataaagcagccagccaccaaaaaaagctataaatattatagaaagtataatattaaagtattactccctcaaagttcatagaactgacaggctacatttaaaactaggtatgaaaatcaattagatttcataaatttagatttccctcaagtacctagaaatcttgataaataatacatactataaagaatgatcaaaatagatggtaataaggcagagggacatggtgggagaagaaagctcacttggttacacaccaggatatttcagctctgttattagcatgtgattttcaacatgtgaaattagtcattttaggtgtcatatccaaatactgaaagtagttgaggggggttatattaaatgtttatttgttttgttttttgagatggagtcttgctctgttgcccagagcagtgcaggagtgcagtggcacgatctcagctcactgcaagctccatctcctaggttcatgccattctactgcctcagcctcctgagtagctgggactacaggcacccaccaccacacctggctaattttgtttttgtatttttagtagagatggggtttcaccgtgttagccaggatggtctcgatctcctgacctcgtgatccgctggcctcagcctcccaaagtgctgggattacaggtgtgagccaccatgcccagcctatactaaatgatttctaatgtcctctctcccactatgttcatgaaataccttagtactaacttaactgtattattcccatcatccagcccaccaaatctacgaccatacccattgcttctttctgtaaacgtaaaaccatttcttcaatttcatcttttgactcttctttaggaggaagaatgccgaaatctcttaaaatgtcattccattctgtatcttcattgggatcctacacaaaaagaaaagaaaagaaaattaacatggttgtacactttaatatgtatttggaaaattcattaagatgtagcacttccaagtattcaattgttcatgaactctacagttaattggttttgaagaataaagcaaagtgacctactttttcctgcttcccagcactaatgggattatatgctccactcaaaattttaataaaatatcaatttagaatacatatagagaatattaaggaagtatctcctaagtcatggaaaatttgctgaagactgtattgggcaaaaccaattcacatcatacacaaatacagtttggtttctttttctacagaagcattcaagaccatcagatgaacttccttttttcttttttttattatactttaagttctagggtacatgtgcacaatgtgcaggtttgttacatatgcatacatgtgccatgtttgtgtgctgcacccattaactcgtcatttacattaggtatatctcctaatgctatccctcccccctcccccaagcccatgacaggccccggtgtgtgatgttccccttcccgtgtccaagtgttctcattgttcaattcccacctatgagtgagaacatgtggtgtttggttttttgtccctgtgacagtttgctgagaatgatggtttccagcttcatccatgtccctacagaggacatgaactcatccttttttatggctgcatagtattcccttttattttattttattttttttgagacagagagattcttgctctatcacccaagctggaatgcagtggcacaatcttggctcactgcaacctccacctcctgggttcaagtaattctcatgcctcagcctcctgagtagctgagactacaggcttgctccaccaggcccagctaatgtttgtatttttacagggtttccccatgttgctccagctggtcttgaactcctggcctcaagtgatcctccctcctcagccttccaaactgctgggattatctttgctaattttaaaattgggttgttttcttactactgttatttgagttctgtatatattttaagtagtaatgccatgtcaagtgtattgcttgtaaatagtttttcccaatatatagattgtctcttcactttgttaactgtttcctttgctgtgcagaagctttttagttcgatgtaatcttgtctatttttgcttttgttgactgagcttgggggattaaatccaaaaattcactgcttggaccaatagtgtgtagtttttcccctgtgttttcttcttgtataatattttcacaatttcaggtcttatatttaagtctttaatccatttttagttgatttttatagatggagtgggataagggtccaatttaattcttctatatgtggatatcctgtttcccaacacccattattgaagagactgtccttttccccattgtgtgttcttgtcccctttgtcaaaaatcaattgactgtaaatgcatgagttcatttttgagttctccattggtcaatgtctattttatgccagtaccacgctgtttggattacaatggctttacaatatagtttgaagtcaggtaatgtgatgcctctggttttcttctttttgctcaagattgtcttagctattcagagttttttgtagtgccatatggattttagaattgctttttctacttctgtataaaagggcatattggaatcttgataaggactatatggaatctacagattgctttgggtaatatgaacactttaacaataatttttccaatccatgaacatggaatatcttcctatttatttgtgtcttcttcaatttctttcatcaacgttttatcattttcagtctatgaatttttcatgtccttggttaaatttattcctaagtatttacttttttgtaaatattataaatgggattattttcttgatttctttctctgatagttcattgttagtatacagaaatgttactagtttttttttgttgttgttgttttgttttgttttgttttttgagatgaagtctcgttctgtcgcccaggctggagtgcagtggtgcaaactcagctcactgcaacctctgcctcctgggttcaagtgattctcctgcctcagcctcccgagtagctgggactacaggtgcctaccacctcgcccggctaatttttgtatttttagtagagatgaggtttcaccatgttggccaggctggtctcgaactcctggctgcaagtgattcacccatctcggcctctcaaagtgctaggattacaggtatgagccaccatgcctggccagaaatgctactagttttcatattgttttggaatcctgcaactttactgtatccatttattagttctaacagtttttttggtggggactttagggttttacatatacaagattacatcatcagcaaacagcaacaatttcactatttccttacctgtttggatgccttttatttatttctcttgcttacttgctctggcaaagacctctggtactatattgaatagaagtagtgagaatgggcatccttgtctacgaaaaaaacctttcaactttaccattgaatatcatctgtaggcttgttgtatatgcctttattgtgctgaggtacattccctctatacctaatttgttgcaagtttttatcatgaaaggatattaaatttggttgaatgttttttctgcatctaacaagatgatcatatgatttttgtccataattctgttaatgtggtgtgtcatatttgtagatttgcgtatgctgaaacatccttgcatccacaagataaatcccacttaattgtggtacattattcttttaatgtgctgttgacttcagtttgctagtattttgttggggatttttacatctgtgttcctcagagataatggcttgtaattttcttttcttgtaatgtccaggtctggctttgatgtcaaggtaatgctgatctcattaaaaagatttagggctgggtgcagtggctcatgcctataatcccaggactttagcaggccgaggtgggtagatcacctgaagtcaggagttcgagaccagcctggccaacatggtgaaaccctgtctctactaaaaatacaaaaattagctgggcacagtggcaggcacctgtaatcccagctactcgggagactgaggcaggagaatcacttgaacccgggaggcggaggttgcagtgagccgagattgcgccattgcactccagcctgggagacaaagtgagatactgtcacacacacacacacacagacacacacacacacacacaaagatttagaagtattccttccttttctatttttggaagagtttaagaaggattgttattagttctccttgaaatgtttggtcaaatttactggtgaaggcatcaggtcccggacttttcgttgatgggagccttttaattttttattcaatctccttatttgttattggtctgtttagattttgtatttcttcttgatccactgttggtaggctatatgtgtctatggatttatccatttcttctaggttatccaatccattggcatgtaactgttcatattaatgtcttacaatgctttgtatttctgtggtatcagctgtaaggcctcctcttttgtttctgattttatctgagtcttctttattcttagtatagctaaggttttgttgattttatattttcaaaaaaccaaagattttcttgattttttctattgtttttctagtctttatttcatttatttctgctctttgttatttatttccttctgataactataagcttagtttgttcttttttgttttaggcatttattgctatgcatttccctcttaaatctgcttctgctgccttccataggttttgttgtagttccatttttgtttttctcaatatattttaaactttctcttctaatttcttctttgacccattggttgttcagtagcatgttgtttagtttccacatgtttgttaattttctaagatttcctctgttattcatttctgtaatagaaaaactgtactcattaaataatagcccctcattctctcctcttccaaactccaggaaaccattgttccatgttctactttctaccatgtatttgactattctgtgtacttcatgcaggtggaaccatacaatagttgtccttttgtgactggcttatttcgcttagcatgttttcaaggttcgactatgttgtagcatgtagcagaattccattcttttttaaggttgaataatattccattgtacctatataccacattttgtttattcatccatcaatggacatttgggtagttttcacttttcattattaggaataaagctgttataaaaatgggtatacaaatatctgtttaagtccttactttcaattcttttgggtacatacctggaaggagaattactgaatcatatgatatctgtttaatttggaaggaaattaccagttttccacagcagttgtgcaattttacattcccaccagcaatgcaaaaggattctaatttgtctatatccttatcaacagttttgttattgcccatcttttctatcataaacattctagtgggtgtgaagtagactgtggttttgagctgcatccccttcattattagtgatgttaagcatcttttcatgtgtttattggctatttggagatcttcttttaagaaacgtctattcaagtttgtcttagtccagtttgtactctataacaaaatatcttagactgggtaaattataaagaacagaaatttatttttcactgttctggaggctgggaaatctaagattatggcactgtcaagttcattgtccagtgagggtctgatctcttctttcaagatggtaccttgaacactgtgtcttccagaggagaggaacactgtgtcctcacgtggcaaaagacagaatagtaaaaaaaaaaaaaaaaaaaaaaaaaaaaaagggacatactctctgtagcaagcccttttataagggtatctaatcccatttataaggaaggagacttcatggcctaatcacctcttaaaggccccacctcctaatactatcacattggaaacaactgaattttggagcagacacactcaaactatagcaaaatcttttgcccatttttatattgggttgtttgtctttttgttgttgagttttaggaagtctttatatcttctggatattatcctcttatcaaatatatgatcagccaatattttctattctgtgggttgtcttttttctttttctgttttttttaaattttttttttttgagatgaagtctcagtctattgctcaggatggagtgcagtggagcaatctcggctcactgagaattcttcctaggtttaaacgattctcctgcttcagcctcctgagtagctaagattacagatgcccaccaccacacccagctaatttttgtatttttagtagagattgggtttcaccatgttggccaggttggtctcaaactcctgacctcaaatgatccacctgcctcagcctcccaaagtgctgggattacaggtttcagccactgtgtctcaacacttgtcttttcattctcttgataatatcctctgacgcaaaaaaatgttttaaatttggtaaagtacaatttatttttttcttttgttacctgtgcttttggtgtcataaccaagaaattattgtcaaactcaatgtcatgaatctatcttatgtttccttttaagagatttctacctttagctataggactttgatgcagtttgagttaatttttgtatacagttgtgaaagaaaaataaatctcaggacccccaaatcactaagccaagggaaaagtcaagttgggaactatgtcaggcaaacctgcctcccattttactcctaaataaaatagctacaaagacacaagctacacacctccctcacaatttgcccaaaaggaaattccttgtggacaaaggacagacagaactgaaagtcatccctctcagactcacctgagacaaatgcatatctgattgcttcctctgctctactgtttatgtaaaagtgcagactcactgagccagactaaattgtgtattcagtggaaggctaatcaaggactcaaaaggatcaaggactctcttatctacttctgaccttaaagccccctcttgaagttgtcctgccttactagaccaaatcaatgtacatcttacacatattgaatgatgtctcccgaaatgcaagctgtaccccaaccacactggacgcatgtcatcaggacctcttaaggctgtgtcatgggtacatccttaaccttggcaaaataaactttctaagtcaactgaaacctgtttcagatatttcagattcacaaagtctaagataaggttccaacttcattcttttgcatgtggatacccagtttacccagcaccctttattgaaaaaaaattaactgttgcccatttaatggtcttggcactcttgttaaaaattttttgaaaatatgtgtgggtttatttcaaggctttctattctactctatttgtctgttttatagttttcagtatttataagtactttttttttttttagagagtctcgctctgttgcccaggctggagtacagtggcgtgatctgggctcactgcaagctctgcctcctgggttcatgccattctcttgcctcagcctcccaagtagctgggaccacaggcgcctgccaccaaacctggctaattttttgtatttttttagtagagacggggtttcaccgtgttagccaggatggtctcgatctcctgacctcgtgatccgcccacctcggcctcccaaagtgctggtattacaggcatgagccaccgcgcccagccagtacggatgttttataacctatttctgatcattctgttatctaaaaatctctgtaaatctgtttctgttggttcatggtctcatggtggcttatttccttgtgtgcttggttacctttgactgatttctgctttctgtcctcgaaaacttattgatgggaattccttaaagcctaaactaaagacatcttcctctacagaggatttatattttttttcttccaggtatttgagagcactacaatatataacgaattcacagtttaaggttgctggaccacccaacaatacgactcaggttacaaatccatatgagagctgtcttaggccgaaatgtttttcgacagggtttactccttttcattttctcttctgttccaataagcaccaagatatccttccctgaattctcctagacatgtgtttacctccggttcaccctcctattcatctcccatcctttgatggaccaaaccctttggttccacctcaaataattttctatcattctgacttcttagctgggacagactcctgtaataaaagacagattaacaagagaaaaagagtttatgagtatgtatacctcatggatacattggagataccagggaaaatgagtgtatgtcaaagaggttgcttaaaattcaggcttaaataccatgtttcgctgaaacaaaagaagaagggtatgtgggaggcaagttatggggaggtgaccaggaaaagcagggtacattaagagtaagctttggcagccaggcgcagtgactcatgcctgtaatcccagcgctttgagaggccaaagcaggcagatcttttgaggtcaggactccaagaccagcctggccaacatggtgaaaccctgtctctactaaaaatacaaaaattagccaggcgtggtggtgcactcctgtaatcccagctactcaggaggctgaggcaggagaattgcttgaacccgggaggtggaggttgcagtaagctgagatcgcaccactgtactccagcctggatgacagagctaggctctgtctcaaaaaaaaaaaaaaaaaaaaaaaaagagtaaggtttgttgtgcggatttcaggtggtaccttttccaccttgagcccaacagtttgagatcaacctgggtttggcgaggccccatctctacaaaaaaaaaaattaactgtgtatggtggcatgcacctgtagtcccagctactagggatgctgaggtgggagaacacttgagcctgggaggttgatcatgtcactgcactccaggctgggtgacagagcaagatcctgtctccaaaaaaaaaaaaaaaaagacatgaactatgaattttttcccccccgagatggaatcttgctctgtcacccaggctggagtgcagtggtgcactctcagctcactgcatcctccgcctcctgggttcaagcgattctcctgtctcagcctcccaagtagctgggactacaggtatgtgccacaatgtccagctaatttttttttttttgtatttttagtagaaatggggttttgccatgtaggccaggctggtcttgaactcctgacctcaagggatctgcctgcctcagcctcccaaagtgctggggttacaggcatgagccactgccctcggccatgaaattttatctaacagaaacaggcaccacaatctatttgctcaaactatgaaggcatttaccatgccattaatagttatatctgtcttcttcttgttccctcattagtaagctcttagaacaggtccgtatctaaaacataagcactgaataactggctgttgaattaatcagtaaaccaacaaagattaatgtgatgttgccttcactgtcaattacatttcaatcctgaagagcagatgcaaatcaggacaaatctgcaatgtttttacacacatataaaatgtgcttgctacgaatccattattagcatgaaaggactggccataaaaaattatatgtaactgatgttcaaaatatcctaataaattatacagtacatacaaacacccaaaattaaatatgtaaaatgagaaaaatcccagtggttttaatctgcaggagcaggtggggaaaaggtgtttctgtaagttagaaagacaattttactgtaccaaaaaaaaaaaaggacggcacaggcttctgattaataaggaaccattagacagaggaggagccttctaagaaacattttggaagtctgagtttttgtttgtttgtttgtttgttctgaggcgcagtctcactctgccgccaggctggagtgcagtggtgcaatctcggctcactgaaacctctgcctctggttcaagcgattctcctgcttcagcctcccaggtagctggggctacaggcgcacgccaccacgcccaggtaatttttgtatttttagtagagatggggtttcaccatgttggccaagatggtctcaatctcttgacctgtgatccgcccgcctccgcctcccaaaagtctaacagagtttttgaggtgaggtgcaagaaactctagggacatatggtattaagacatatgtgactagtaggttttctgttcttattttttaaggtagtggaggaggacaaccaaattgaattacacttgggctaacgttgccgctctattaagtcaaaaatagtattcagcagtaagatttctatgattttggtgtgaaacacaatacgtaacaactcttttaacgttttctccagcgacagacacaagtcttaaaggctgaaaaaatggcgttctcctagaggatttttctcaaaactagacagagaagcacgcaaaatttagcactttccaagaacaaatgttagagcctacctcctgtgtccgccctccccatttgtgtcccttggcttcgggcccagctggagacccactgggtgttccagggtggctcggcaggtcccgaccctcacctgcatgatgcgctgctctgcccctcaagagcccgcgtcgtcctgcagctggcgaggcgccacggatggagacccgcagccttctccaggctggaagagcgcccgcttcaggcccggcggtttcgagtgaccgccagaagagggagaggcgaacaaggacttgttacgcatgggcgggcgtggcagcttggttgccaggcaatgcagaggcccaacacaggggatggttgtgggtactgacgcgccaggtcctggagcatctatcccaagcactgcctttcctgttccctttgtggtgctggtgctgacattcttgtcaacttttccctccatcaccaccattgaatcaaccgattgtttcagagactctggcacccttcaaaccctgagtcctgtcttcatggagaaataacaaactcctggggtggagaacccttcagaggaggcgttcttaacctggaatccatagactatatatttttttgtttagagacagagtcttgctctgtctcaccggctggagtgaagtggtgcaaacactgctcacagcagcctccacctccacggctcaagcagtcctcctgtctaagcatcccatgtagctgggatcacagatgcatgtgccatcatacccagataacttcttaaatttttttgtacagacaggggtctcacatgttgcctaggctggttttgaactcctgagctcaagtgatcctcccacctcagcctcccaaagtgctgggattacaggcatgagccactacacttagcccatacaatgtatttggatagattttagggaatatcttgccccccagcccccaagtgtactacacgtaattttgttgtatgtgtacatttttttctgaaattaagagccagagctttcattagatgcttaaatgggactgtaggctccccaactccatcttaaaaaatccactgccttaagtgacagaagctctggctttaggccaggcacggtggcacaagcctgcagtcccagctctttgggaggctgaggcaggtggatcacttgaggtcaggagttcaagaccagcctggccaacatggtgaaacctcatctctactaaaaatacaaaaactaacaggatgtggcaggtgcctgtaatcccagctactcaggaggctgaggcaggagaatcacttgaacccaggaggcagagtttgcagtgagtcaagatcacgccactgcactccagcctgggcgacagagtgagatctgtctaaataaaaaaaaaaaaaaaaaaaaaaaaaaaaaaaaaaaagctctggttttaggtaggatgcctagacaggtaggggttcctctgtgtttaaattaaggaaaggatgtttactgggagatgccaggaacttgaggaaaacacttggtgttttatacaagttgttttacacagttccagagatatactcacaggacttggaaagaaaaaaaatgtttttaatgacataactttaaacttgggttcaacatggggccagtccatctctagtgcctagctgatacttaatacaaatcttatactcctagtagcccatatattctgttgtgtttgtgtatgagacatgaatctgttaaatataaataattaagaacatatcacaatttttgtaatcatgtcttggtatttttctcatcttcttcttcttcctctttcttcttcttattcatcccaggagccctaaaaatgttacctatgtctctctggatttctgagaggccctgggaactgctgattaaattaatattcttttcttattttgacaatccaaagtccaggctagtggaagtactgtgcacagaactagctaatgctgccccatgcatttgtggttttagggcagcatgctctccttgctctcaagtccccatcttatcaaggcaatttatttttctaaaaataatgtatttttttctcttctgcttcttcttattaacctgagttcttcactcaggttaacaagaagtgaaattcaggaactttgttagtaaaaggtgtaacttaagctataataattggtcaacattagaaagacaaagatttgttagatactctgctctgaagaatgtctgtatagacccaattctacctactcaaaagagccactcctttccaatcggccagcaaccttcctgatggaggaggtgggaatctaagacagaggtcagaaggaaaaaagatcaaggggaacctcagaggagataaattcaatctccatctgaagttaactctgtgcccactaaacatttatttgatgttaaaagttcccaatgtgtgttcatgatcctctattaataagattattttctttctgctaatagacaagactggttgcctttcagatattgcgaggtgaagtaacttattttaggataaattgaatactatgagttggtagaagaagttagtcctctgatatatttgtagcaatcagaaatccattatacagtttataaatcagaacttgcttattggactattggatgggttatggcccaatcctccaactagtatagtttcagttggtgctcacattctaagattggtagctactgggcattctggtatttatgagagctggtggttttgtcactgacaaaaatccaaacatgataaactaaaacagctcattaaaactcaactctcaactctctctgagtgcctttaatgaaaacatcaaaaaagcatatgggcagggcatggtgactcatgcttgtaatcccagcactttgggaggccaaggcaggtggataacctgcggtcaggagttcgagaccagcctggccaacatggtgaaaccccatctctactaaaaatacaaaaaaaatacaaaaaaaaaagttagctgagcatggtggcgcatgcctgtaatcccagctagtcgggaggctgaggcaggagaatcgcttgaacccgggaggcagaggttgcagtgagccaagatcacaccactgcactccagcctgggtgacagagccaaactgtctcaaaaaaaaaaatgcatgtgtgctgtactgtcaaacctggcagggatctaaggaacatcattatttacaggtttattacacagtatttctcattaaaacactaagcaaaaatatttttagattttttaattttcaacaaattgaacatttacaacattgttacaactgagaacattgacaacacagggattttcaacagagtacatttagcaaggatttttttcagaagaaaacaaaatgtcagtacattttgtattccatagcattgctctgtggaaaattagctggcatcctgtaaaaaaagaaaaattgaattaaagtgtaaatgaccacgtgaatgtgtgtatataatgtttgtatatagacatttctataaatattttgtcatagaataacagtagcatctgacatatttcccagctgtatatatatatatatatatatacacacacacacacacacacatgcacacagacagaagaaatatatatatgtgtgtgtgtgtatatatatatatatatatatttttttttttttttgagacagagtcttgctctgttgcccaggttggagtgcagtggcgcgatcttggctcactgcaacctccacctcccgggatcaagcaattctcctgcctcagcctcctgagtagctggtattacagaagtgcaccaccatgcccagctaatttttgtatttttagtagagacagagtttcaccatgttggtcaggctggtctcaaattcctgacctctagtgatctgcccctttggcctcccaaagtgctgggattacaggggtgagtcaccgtacccgacctgtctgtatatttttaactatatatcatttaatctgtctctaatggaacacttattctgtatgtctgtgtcttccaacagtttacagtatttaactatttaaaagtgatttcctaaagctcattaataccaataagatttatgaataagctatttcaaaggcttacatttactccttgtatatctatttcctcctatatttgcaactaaatcattctattttatgtttaaccactttctaaataaatataggtcatcaggatagagaaaggccttagaaaatcagatgagaaaaacaaagaaaaaatgattattatattgtttttctattggcaaaataaaatgaaatcacgagtacattagtttatggacaccctaatcttgaaaataatctgaataaagcaattattctcaattttggaggtttttttttttttttactaaattcaccaaatcatggattaagttctgtttcacattgtgaacactctaatacttatttcaatgttacaatcacaggtattttttcccatttaatattaagctatttaataaaatttttaaatgccaatgtacatttataatattataaaagataaaatagtttcttttccattagctctctgttctttgttccttgaaaaaatacaaaattaaggatatgttttctcatattccttatgtgaacataatttatcaggcctcttctgaagcaggagttaataccaaacacagtctgcaaattcaagttcctaattatgtcccatgagcacattaaatttttccttcgcttttccactatttgaatcttttatttctttcttttctaattgaattggctaacacattaagaactacattaaataagaaattagagagtatctttatcttgttcctgacattaacggaaaagctccaaagtgtttcactaacaagtcagctactgtactaacttggtttgagaccattgtataaatcatgtcaagaaaggtttaatctcttcctaatagatcagaaattgatgtgaaattttaccaaaagcatctgttgagattatcataatttttcttctaatagtgaaaacttttaacacacttcttaacgttgaacaaccatccttgagttgctggaacaaatcttagtggggtcataaaattatttaagtatactgatgaatactgtttaataatattccttttaaatttttacattaatatttataaatacaatttacttacagtttcatttttttatactttttaaaagtttttgtattaatattatgctggcttcataaaaatattgggtaatttttcttctttctctgagctgaaaaaattcaaaattattggcttagtactttttgagggtatattgtgggtatagtttcttttttttcttcttcttcttctttttgagacagagtatagttttgagtgggcatagtttcctttttttttgctcttgttgcccaggctggagtacaatggtgcagtcttggctcactgcaacctctccctcctgggttcaggtgattctcctgcctcagcctcccgagtagctgggattacaggcatgcaccaccacaccaggctaattttgtatttttaggagagacaggatttctccatgttggtcaggctggtcaggctcccgacctcaggtgatccgcccaccttggcctcccaaggtgctgggattacaggcgtgagccaccgtgcccagccgcgggtatagtttctagataacatattccaattttttccccatacctattagtctgtttagtgtttttctttcttctgaggtcaattttggtagcacctactttattagacaatcctccattttatccaggtttccaaactgatgtgtagagagatgtgcaaagtactctttcatgatttttatttcttctctgttttaatttctcttttcatttgtacttttctatatttatgattttatcctttttcttgattacactagtataatttattttattttttgtaaagaattactgacagatttttgctttgtttaccgtccttctactttactatttttaacatcaatttcttctttcatttttataactttcttccttctgccttcttgaaatttactttgttgttgttgttttggttgtggtttttttttttttttttttttgtgagataagttcttgttctattgccttggctggaatgcagaggaaagatcatagctcacagcctcaaactcctgggctcaagcgatcctcccatctcagcctctgaagtagctaggactacaggcatgcaccaccacatctggctaatttttttcttaagtatttgtagagatggggtatcaaaatcctgtgctcaggtgatcctcgtgccctagcctcccaaagtgatgggattacaggcatgagccactatgcccagtctaaaatgaatgatatatttgaaaaaatatgttcagcataaaatctggatttaggattacaaaacttaatagaatacacttttatttctgtggtataaatttatgaatctgcatttgggtttgatttcaacttttattgtctaataaaatattaggattaacatatttattaaacatgtgggaacagtcaacagctactaaatttctactctatgtccagcactgaggtagaaattctggtagcacaaaagaagaggtaacattctctcatgtctttccacattttaaaatattctctagaaactggtaaatcactagcttttataaagaatctttgagtatcagttatttagatgacagaagtactttcagtccgtaaatcttggcccgttatgatagacactgattactgcaataagaattcattccctgacatatcctacttgcacaataaatgatgataagatcaatgtctacaaaatcacttatgatcattactattgtgacatagtctgaggaataaatgacataggcaaagcaaatgaggccctaaaatactggtattttctcattacaataaagcccttacagctcctatcattgtagtatttatatggaacattcatgtacatatgcaatcaaataatagaaatacatttaacatagtttaatttgtgactatttgaaaacaacagcaaatgtcaaactgtgttgaactgtgaaatgcatactattttatttatttatttgtttatttatttctcacataccattttaaatgaaccctgctgaccttcttccattccgtggctgaaaaataatagattagaaataaatcagtgtaactaaagatgcaagctaacagtcatagaaacagattgatgatttagaggagtgtttaacgtgcatcacaatcatctagagggctttttacaacatagactgctggaccccatagccagaatttctgatttagtaagtctgagaatcctgagaaatttgtatttctaacaagttctgaggtgctgctaatgctgcaaagaccaccatgaactagatgctatttgactttgcttatttccttgatggtaccaacattttaaaacaaatgttctcaattttaatttgatatgaaccaaaatgaacttactgaagtcagggctgtttagctgcttacttcttcctgctatcagtccaattccttcattcaatccattctctaatttgctgttagaattattttccaaaaggcaaatcttaccacatttgccccctccttagcctttagtgtaaagctgaaatttcttagctaaatatttcatcaaccgattcccattgatgcttcaggattcagcccttgaagtcttctctgtacctcttccattccccagctggaattaaatgcttttcttttggaaatcacagcctttggactacaagtgcatttcacacagtactttatatttgtttacttatctgttttgagcctatctaaattcctagagcataggaatggaatcctatctgtctttatagtcccagcccttggtacattgctcagcacccagtagaagttcaataaatagttgttgaatgaattaattaaaactttctggtaatgtattaaggatgcaaatattttgcaaagtgtagctgcctagaaaaaaacctcacattttatagacaatgtggacaaacaaaatcagaactgtaatcctgaaattctgtctacttataccttttattatggcagattcttttaattttaagaatttgtgaaagtattcgtaactcttccaatctactgagtcaaaaattttgtaaataattccatagaacataaggaatagtgtatctttaagacagttactttctatacataaaatgtcatggaattaaagtgtcaaataggtgaatgctatttgaggtgtttaaacatgagcaataggtcaaagaagagatcagagatcagagatactgtggtattgaagcaataaggtggtgacagaagtgaatgtcagactgtaacacctgatgccaaacatctataaactttaaaacttaattgaaatgtaaaagttaaatacacagggaacatatttttaaattttggtgtagattgattttttaaaaatacagtatgtacctaccctgaataaaaaatatcctcgactttgacttgcaaagggactttggaattcttcctagaagagaaaatgagggcattacaaatcacataacactaaaaataagtgcaaattctccttgaaagtatattgagggtcaaaattactttcaactgtcataactaaacatagagggaatcagggacttgaatagagaatttttgtatcatacctgaaaattttcaacaactagcagtatcatcagaatcttatatttaaaaataatttccttgtcagtgtgacagatttgcctttcaggaattttgtcagttttaggtgaattcatcaataagtagaaagagaaatgacagacatttcataattgactatatttaaaatctcctttcagcattttgttagaatgaaataatttatttaaaatacatattgcatgtgttaacccatgaacaggggaaaatataaaacagaattgtgtcaaagctaaaaaatattatccaatatttctacagaaatgtagtttgaaattgaaggacaaatttggtaaattacatttattcaatgaagctttaggatagatgttcctaatataattatatgtgcagaatgttaatttttaaatatccaaatattaacaggaatgacccaattattcataataagtatatctttttcttaaacatttcattttaagcttcatgaaaaaaatacattaacattttatggtttccataaaattggcttatagcttcaacttcctattttcattaacaattacctatatcataaaagcattatcagcatggctatcaccatgaaatctttcagccaagacctttttcaactattttataatatgaatacaatcatattaaattctaagaaatggctctgatgtatgtttaaattctgaaatacttagtttgcaacaaatgtatcttaaatcctcaatatttctacttaattttcatctttactataactccccaaattacttaatattgaaaaaaatctgtatttaaaaatgtacacactgtatacatgtatcaaaatatcacatgtacccccaaaatatgtataactataataaaccaatgaaaaataaaaaataaaagtttaagttttcaaaatttaaaaaaatgtacacatataaaccatatgtttatatacctatataagcaacgttctcagctgggcacagtggctcatgcctgtaatctgagcactttgggaggctgatgtcagagaatcacttgagcccaggagtttgagaccagcctgggcaacatagagagacctagtctctacaaataataaaaaaatttagccaggtgtgatggcatacacctgtggacccagctcctcaggctcctcaggaggctgaggtgggaggattgcctgagcccaggaggtcaagtctgcagtaagccatgatcacgtcactgcactccagcctaggtgacagagaaagaccctgtctcaaaaaaataataataatacaaataaaaaaattcaaatgcatattatattaaagagaaaaaactaaaaggccagacaaaatgtaaatttaaatgtgccaaatacaaacttccaaatgctaaacccaaacatacagatctttttagagttttatcattagcatagagcatcatataaaataatttgggaggtagagataaaagatgtgggaatgatat

SEQ ID NO: 373 - DNA, 35143 bp, Homo sapiens
tgccttttccacttttattgttcatagaggcataagcaagaacaaatattgaaagataagagttttatgacagtagaagtcttaatctgtgaatttgggaaaagcttatttacatcaaagatgccatcctcggtcaggcgcagtggctcacgcctgtgatcccagcactttgggaggctgaggcgggcggatcacctgagatcaggagttagaaagcagcttgtccaacatggtgaaaccccgtctctactaaaaatataaaaattagcctgatgtggtggcgagcacctgtatacttgggaggctgaggtaggagaatcgctattataaaaagtagaggttcctcttcaaagactttcctccccatctaattagggataaatagtaacttctcttagaagcaaaatttattcaaagatctgtggtgacattcttaaatatctgcaagtcataataaagaaatcaatgtcctttatgttcttagctcccacaatgtagcctaaatatttgccctggcatgcttatactggtccaaacaaacattaggtcatagcctgttcctcatccttatttgaaggtgtttttacctttctcagcattccacaagttacttccccttcctttgttctcctctgcctttgcctcttttaaaagttctaagttgctagccaatcgggacaaatacaaaatgtgaagtcccattccagccaatggaaaccggacacagcagtagggtggacgcgtcaggttataaatgaccctgtctcctttgttcagtgtactctcatggcaaaactgctgacgagggtaccctttctgcagaaagtaaaaatggccttcctgaggaaattgaatttatgttcaagtgctatttctttacggcactggggaacaagcatttcttttttaattttttttatatttaatattaaacatttaatatattaagtgaatacattcaaatctgcaaacaatacatctaggttgtagaagagttaaaaaaatccctccactcagtttttgccaaaacaccacctgtaagcactgagaagcctactgatgcacgcattatcctttgggccaatagaaacaaacgttttaataaaatgctttcccagtggtcaaattgtcttcctgagtaaagctaaacttgttgtagtgagaacaggtagtgtttatttctagcttcttctgggttccaggttacctaagacccaagggtaatgacaatgggcagctccactttattaaaagccaacatttagcccagacattttattctccaaaaattagcaagcatagctttacattcaagttgggtataatgactttattttcccagtaattccctaaataaaacattattacaaaaaatgactcttcccagtgcaaaatcttaacattttgcttttatgagcaaaagcctgtattttacatattttttttttgagacggagtctcgctgtcgcccaggttggggtgcagcggcgcgatctcggctcaccgcaggctccgtcccccagggttcacaccattctcctgcctcagcctcccaagcagctgggaccacaggcgcccgccaccacgcccggctaattttttgtattctcagtaaagacggggtttcaccgtgttagccaggatggtctcgatctcccgacctcgtgatccgcccacctcggcctcccaaagtgctgggattacaggcgtgagccaccgcgcccggcctacgtatttcttatattgatttttacattttcaggttctcaaaaggacttactcattttacctgtaacacttggacgtctgaatgtaacatgcacttgaaaaaaaaaattctatcaccttggataggatagtgatggaggagaatgttgacattgactatataccctcacctagtattctgtgtaaaatcatgtttccctaaagaggactctgatttgtccagttgcatccttgcaacttggcacaggttggcaggtaaaaatgacctttctgtagaagtagaagcctattcttcacatgtaagttttgattactactattttatcacatcttaaatatataaatctcaggctgggcgtggtggtgcacgcctgcaatcccagcactttgggaggccgaggcaggcagatcacctgaggtcgggagtttgagaccagcctgcccatgaagaaaccacacctctactaaaaatacaaaaccagccaggcatggtggcacatgcctgtaatcccagccacttgggaggctgaggcaggagaaccgcttgaacccaggaggcagaggttgcggtgagccgagatcgtgccattgcactccagccttagcagcagccattgcagtctttttagatgcttgcttagccttttttgcttccttagcagccctgatagcttgttctcgtcgagtctttctaacttcaggtttctgattcctcttggccgttatatcagcaagagatgcaccagtaatggccctctggaatttgactgctcggcgggttcttttcttttgaatttcttccgactgcccctttttgtgcttccttctgtagaggacagtccagtttatctgccgaggattcctcttggaaaggaacgccaactcgcatttcgcattaagaaactggaaaaccttcccgtcggtcctggcgtagcgcctcccgtgtccggggtagatcttgtacccgctaaaactgcacagctcgaccttcatggcgacagctccacagaaagacaaaagatggcgaaaagtcttttttaattttttaaaaaatttatttatttatttttttgagatggagtctcgctctgtcacccaggctggagtgcagtggcgcgatctcggctcagtgcaagctctgcctcccgagttcacaccattctcctgcctcagcctcctgagtagctgggatatcaggcgcgtgccaccacacccagataaatttttttttttgtattcttattagagacggggtttcaccgcgttagccagaatggtctcaatctcctgacctcgtgatctgcccgcttcggcctcccaaagtgttgggattacaggcgtgagccactgtgcccggccaattttttttttgaaacggagtttcattcttgttgcccaggctggagtgcaatggtgtgatctcggttcaccgcaacctccccctcgcaggttcaagcgattctcctgcctcagcctcctgatttgctaggattacaggcaggcgccaccacgcccagctaattttttgcatttttagtagagacggggtttctccatgttggtcaggctggtcttgaactccctacctcaggtgttctgcctacctcgacctcccaaagtgctgggattacaggcatgagccaccgcacccagcctccagggaacaagcatttctggcaacttgaacccaggaggcggaggttgcagtgagccgagatggcaccactcattccagcctgggcgacagagggagactccatctgaaaaaacaaaaactaaaccatatgtaaaacaaacattgttttggtccagaaagatgggacaactggaggtgaggaggcttgggggctttcagatcacaggtgggagacaaagggttgcgttcttttgagtttctgattagtctctccaaaggaagcaatcagatatgcatttatctcaatggaggcaggctctccccaagctctcagcttgaattaacactgacattttaaaatatctagcaaagacaaacataaaatttagacaaaacctatgctgacaaatctgaaggcctttttatttttattcccccaataattttaaagctggctagtttagtaaagttatacttaagtggacttgaaaattgcttagacgtatttacttaattacttaagccctcttttttttttttttttttttttgagacaggagtctcgctctgttgcccaggctggagtgcaatggcacgacctcagctcactgcaacctccacctcctgagttcaagcaattctcctgcctcagtctcccaagtagttgggattacaggtgcccaccaccacgcctggctaatttttgtatttttagtagagacagggtttcgccatgttggtcaggctggtctcgaattcctgagctcatgatccacctcagcctccccaagtattgggattacaggcgtgagccactgcgcctggcggagccctcttttacttataagtcaatttggtagacacaacatatagcagtaagtgtacatataagtaaatacatctagacatgtatatgcacacataaacgatgacctggaacgttagccatgagatggcagtacaagcttgaaggttttactttgccctaatggataatgcagggaaggctgtgaaccaaaattttgggtaaagcagtctccatggcagttttatttttatttatatttatttattttttgagacagagtttctctcttgttgcccaggctggagtgcaatagcgcaatcttggctcatcgcaacctccgcctcccagattcaagcgattctcctgcctcagcctcccaagtagctgggattacaggcatgcaccaccatgcccggctaattttgtatttttagtagagacggggcttctccatgttggtcaggctagtcttgaactctcaacctcagttgatctgcctgcctcagcctcccaaagtgttgggattataggtgtgagccaccgtgcccggccaaagtagtttgattgattgattgatttttgttttgagacggagtcttgctctgtcgcccaggctggagtgcagtggcgcaatcttggctcactgcaacctctgccacccgggttcaagcgattctcctggcttagcctcccaagtagctgggattacaggcacgtgccaccatgcctggctaatttttgtatttttagtagagacagggttttagcatcttggccaggctgatcttgaactcctgaccacgtgatccacctgtcttggcttcctaaagtgctggacagtttgatttttaaaggctaaacctccccaggctccaaggagcactggggccaaacagtaccaaaggagagcatcacccgttaaccaggccccctgcttagaagagtagcacagaccgggcgctgtggctcacacctataatcccagcactttgggaggccgacgccagtggatcacgaggtcaggagtttgagaccagcctgaccaacatggtgaaaccctgcctcttctaaaaatacaaaaattagccgggcgtggtggtgagcgcctgtaataccagctactcaggaggctgaggcaggagaattgcttgaatctgggaggcggagattgcagtgagctgagattgcaccacggcactccagcctggcgacagagcgagactgtgtctcaaaacaaaaacaaaaacaaaaaaaaaccctgcagttgcttccatgtttaggcgctgcccaccaagggtcccaagttggaaaggaaggaggagagaggcagagagagagagagagagagagagagagagagaagcgcgagagcggccctgtaattgagcagaaaggaaagggagaaaaatgaatcccaaactttgggcttacctctttctgctggctggctcgccaaaatatgttaacggtagaggatgtccaggttcttggcatcttgaacaaacaattggacaaaatgcacaaacaaagcaagaaaggaatgaaggattttattgaaaatgaaagtacactccacagtgtgggagcgagcatgagcataggggctcaaaggccctgttacattttgtgagtttaaataccctctacttggggtacaccctatgtaaatgaagaggatgaagtaaagttacagttacaaagttattaatggcgggcatacgccctatggagaggatatttcccgttataactgaagtgtgaattggccttatgttccctgtctctagaccctattctcctgcttcctgtgaaagcagagggttttgtttgttttttgctttttgttttttgagacggagtcttgctctgttgcccaggctggagtgcagtggtgcactcggctcactgcaacttccgccttcccgggttcaagcgattctcctggctcagcctccggagtagctaggactacaggcgcgtgtcaccatgtcccagctaatctttctttatttttagtagagacgtgttagccaggtttcaccgtgttaccgtgttaccgtattccagccgggctccgcccctggattcggtggacagaccagctttacctccagagactccccctgtcttccctgcaccggctgactatacctacacacttcggtggcacaatctttgtttagatatgctgatgccttccttcgctgggaacggtccagtcctgcccgcctggcgctcagctctgcggatctcaggggatggagtggcaatctcattgctcccgcctctcctgacccctctcgccttctcctcgagacccgggttaagtgggcagagggctccgagggtcctctcccgccgtgggattgcacagagggctgggtccgcaggctggctaaaaggacctagcccaggattgcgaggcagcgccctccctgcagctggacagactcgggcgcccggcccaaagcccggcaggggcgtgtccgcgcgctcacctgctattggccaggtggggctgtcggctgccagcagtgcttatgctttaagtgcggagcgggtggctgcggagccaggcgcggcgcaggatggtggacagcgtgtaccggacccgctccctgggggtggcggccgaagggctcccggaccagtacgcggacggggaggcggcgcgcgtgtggcagctgtatatcggagacacccgcagccgcaccgccgagtacaaggcatggctgcttgggctgctgcgccagcacggctgccagcgggtgctcgacgtagcctgtggcactgggtgagcccaggccggggccgggggcgttgcatgagatcggggtctgtctcagcctgtactgcgcggccgcagaaccacagggccgggcacgtcagggcggcctttgccaatcctggaacgggtgggacaccagggccaggagcaggtacctgcccggcagaacaggcactgcgagtgccccgtgaggctaggggtccaggtagcggttcgcagggagaggccccggagaagggagactgagtgtgagtgagggtgtgggcagaaaaagtgagcgtccctgaggctttggagccagagccacggacagattgcaaatattcctcctgtgatggccttgggcagtgttaacagttaacattgctcaacatttgcacctgccaagcccagtgccaggagcttttgatacatcactttttcaaaccctcacaaagccccatgaagttaagcagtgatattctctcatttactactggggaagtaaggcctcagcaaagtaaaattccctcatacatcatccagtgaaaaggagctaacaggcccgggttggttaagatctgtcctgtgctctatttttctctttttttttttttttttttttgagatgaagtcgtgctctgtcgcccaggctggagtgcagtggctccatctcggctcactgcaagctccgcctcctgagttcatgccattctcctgcctcagcctcccgagtagctgggactacaggcgcctgccaccacgcccagctaatattttgtatttttagtagagacggggtttcgccgtgttagccaggatggtctcgatctcctgaccttgtgatctgcccacctcggcctcccaaagtgctgggattacaggcatgagccaccgcgcccggctttgtcctgtgctctaaaccaccatgttctactgccttttgtgcacacgtattttaacttcaaggagcctcagcttgtctgtctctcaaatgggaatgacactatttacctctcaggattgccatgagaattaatgcatatttgtagagtgcctggctctgaagaggtgcttttaaaaaaaagttgccttgtggtgacaggaaacagatttgtgaggtcagtggagagggcctggggagaggaggcagaggaacggactctgagaagtagagacaaaagtgtccagtgcagggtctcctcctggccctcccaggctcccctaactgcctctctctgcctctcctcgctggccgtactcagggtggactccattatgctggtggaagagggcttcagtgtgacgagtgtggatgccagtgacaagatgctgaagtatgcacttaaggagcgctggaaccggcggcacgagcccgccttcgacaagtggggtatgcaggtctagccaggctcccccagcccagtcaccaggaacactgttcattctgcctggggctcctttaagtgggggcgggggtggagtgttgtgttttcctcggggagacagaaaaattactgtcatttctctgaaaagcaagtcttaagctccagaatgagacaccgggtgtgaagagctggttttaactgtgtttgtggcatcttgtccctcccctcaaagaaaaacccataagcacagagccctccttcccaaccagggttccttctcccttgatccctcttttctcctccccctaactgaacggggagcttgtgtgtcttaagaagaaacccaggcaggactgcacttggtggaggtggctgctactggtaccatcgtgcctccctgattcctctttctcttcctgacccctagtcatcgaagaagccaactggatgactctggacaaagatgtgccccagtcagcagagggtggctttgatgctgtcatctgccttggaaacagtttcgctcacttgccagactgcaaaggtaagagagggtgtggccttgggcatggcccccgccttgaggcccccttccacagacatctggcacctgctctcctgccaaagcagactctctgccttggctctggcacccctggggaggggagagatgggagggagactggtgctgggggccctgagcagatggagtctttctgcccgtgcctggagctcaggggaccagagtgagcaccggctggcgctgaaaaacattgcgagcatggtgcgggcagggggcctactggtcattgatcatcgcaactacgaccacatcctcagtacaggctgtgcacccccagggaagaacatctactataaggtggggccctctggggtgggggtgggggtgggggtgggggtggggtggagggagggtccagtggccccaaggtgggttacagaggctaatgccggctgccccaccacctacagagtgacttgaccaaggacgtcacaacatcagtgctgatagtgaacaacaaggcccacatggtgaccctggactatacggtgcaggtgccgggggctggccaggatggctctcctggcttgaggtaccacttggcttagtgggggtgaggcggtagttgggggagctgaggtcaccagtcctcatggttgctggggcctctgttacagtaagttccggctctcctactacccacactgtctggcatccttcacggagctgctccaagcagccttcggaggtaagtgccagcacagcgtcctgggcgacttcaagccttacaagccaggccaaacctacattccctgctacttcatccacgtgctcaagaggacagactgagtgtggcctcagctcccacaagcctctgcccaggcactgctaggctctgtctggaagatggggaccagcagccccacaccagggccagcctctagagcagactacagctggggtgcagggatgtgggttccacagacggaagggtaaacaatatagtctttttcagttcctgcatgcattgtgtttatttatgtcagaaggatcaggctcccatgctgcccacccccccaccctctcccagggcttactcctcccacaaccctgctctttctcactccaacctttcatgccacaacaccagtagggggcgggacatgctttattttcagccacagaactagccctctcagggcccaatccccagaacccaaggccctggccctcttcctgagtagatgggcctttctcttagagccggcctggaaggaggggcaagtaggcaggagatatctcttgagctgttgctgctgtctcaatgccactttgcaccctgggatctcctggagggaggtggcctccaggtgggttggcagcagcctgaggaggagcccttccttcccagatctctctgtgggctatcaaggtacctgcagccatgctgagcggggtcccagaccctggggggctcctagcaggcagcaaacttgcgctggatgcgcttgtaccggagcagctcctgctcactgactgagggttgcagccgggcggcagcctgcagcaagtcctccatggtgagcatcagtgctgagctacctggctccagccctggagatgacaaggtggggaggctgtggtctatgcccaggcaggggagagccctgcgaaggtggcttcctgctcagggtctcctagatgtcaatgatcttccctctggaatccaggactaggtttgtctcccactagttttttttttcccttaaacattttttttagagttggggtctctctgtgttgcccaggctggcctcaaactcctgggctcaagcgatcctcccacctcagcctctcaagtagctgggactcaggtgcacccagctccccactagctttttggttgacctctcagaccggcaagtggctcaccttcctccaggtcatgaaccctgcgtttgagggcagctgtcatagcatcagagcagagagagtagaggtccgcgcccgtcagctggggagggcagcaatctagcacgtttaccaggctcacagatggctctagcttgaatctgttgtgggatacaggaagaaacagagttggcatcacctcctccctcgaaagccagtgctgaccagctcatcctgcatgttgcatgcatcccctaagcatcccaaggcccaagcccttcgcagtcttcctctaacagagcatacttgcgtgtgatggcacttagaacgcgtagctgggaggcccggtcctcatttgcccccacaaacaccagcttgtcaaatctttagggagataggcaggtataagtttcagggagcccagccatgaggggtgaaggaggcacaaaatgagggtggagatgagcagtacaaggggcccacctgccaggccgcagaagggcagggtccaggagatctggtctgttggtggctccaatcacaaacacatcctgagtgctgtgcagcccatctagctcggcaaggagctgagacaccaccctggagagaagggagcaagggcaagagtccttggtgtcccccttagactctgcccctgcctgtggtacctctctttacaggcagtctcaacagggccctccactcagctgtgcccaatgtgccccaccaggtaggcccccattctcctcagtggaccctgcccaatttcatggcccctttcagcttccattatattatctcagaactgaaacagcaggaacttctatctctggactctgaagactgctgtgagctttctcatatccttcccaccctggacccctcagctttcattcccactcagacccctacctgtccatcactcctccagaatctccacttcgcccccggcttggggccaaagagtccagttcatcaaagaagataatgcatggagctgcagccctggccctggcaaacactgaagagagagaggggcccacaggagggcaaagctcggcttgtggggggttgaagttaggtgagagcagggagggaaactggggcctgacaatacagcactggcatcccaggtactagacccagctgggcaggaacctgacttgtagaaaggaggattaggaatgatcatgagtagcctgggagtagggggtggcttgggggccatcggggtttgggaagcatgggacgccctgcccctccctgctcactcaccttcccgcacattctcctcactttggcccacatacatgttaatgagctctggccccttcacgctgagtgagaggatgtgagaaggtgagagccgtcagatgcacatacacacaattgacctcttgggcagcccctcctgctccccagcctgctgcagcccctgatccacccaccatcccttccaggccccctggccacctgaggaaggtaaggctgcactcagtggctactgccttggccagaagggtcttgccggtgccagggggcccatggagcagaaggcctgagcgtctcaggcccaggctcagtagctcagggtgctccagggggagctgaatggtctccaggatctccttcttcacctcctgcagcccacccacatcatgccaggacactgaggggatctaggagatggaaagtgcgtggttgggatatgctcttggaggggctcctgtcccacctccaaggacttggtctccaccttgggggctccaacggcctgggagtgagctgtctgcagttgctccagtgcctgcccaaagtcctcagccaggagaggaaagccggcagcacacagctccccctcatcctcctcagtcaagccacctgccaaactgcaaagaggaacacagggaagcctcctcaccatcagcgtcccattcccttctcccttcctcaccacccacccatctacatccatttcctctttccgcctttccggtgcccacgtcctcttaccctgagttcttgatcctggtgcaggctgcccggctgctgtgggtcagaagggcatagagatcccctaccacaaagccctagggaaccacaggaaaggacacatgagcagggcacagtaggcaggaaccttcagggaccgtcccccagctagagcagaggccctctgttgatgccttaggtttgttgttttttttttttttttttttttgagacggagttttgctcttgttgctcaggctggagtgcaatggcgcgatctcggctcaccgcaacttccacccgggttcaagcgattatctcacctcagcctcccaagtagctgggattacaggcatgtgccaccacacctggctaactttgtatttttagtagagacggggtttctccatgttggccaggctggtctcaaactcccaacctcaggtgatccgcccacctcggcctcccaaagtgctaggattacaggcgtgagccacggcgcccgcgctgggttttctactctcactcacaaggcaacaggactgagttcttgtaacaaaagccagggacctcctagggagggccagtactctcccttgatactcactgcacaccgccgtgctagctgtgccaagttcacctcctggcccaggggaaggtgggcagtgagggcccgcaggatgctgagccgctgcccctctgacagagcaggcacctcgagctcatgaggaaatgctgtctgcacatcagcaggcaggtcctgggcccggcttgtggtggccacaaccatgaggggagggcagctgcagacagaggagtgggcactgagggtgagaacatggctggcagctcctgtggactgccttgtcccaaagtcggcacagaagggcagggaagtgaggtgggtgctaggatggggtagggagatgagcatctaccccagttcctagatgggggaactgtgtttcccccatcacattgagggcagaggctttttctttaaccgagtgttccccaagaaatgctagaccacagactcctccctctggatccctctaaagacacggagctcagggctgtctagagggcagccaaatggatgggagatgactgagaagccactgaggggtgagagaagggaggactgaaaggctgaaaagtaggagggctggcccccccgctcccccttttttttttttttttaagactgagtcttgctcttgtcgcccaggctggagtgcaatggtatgattttggctcactgcaacctccgcctcctgggctcaagtgattctcctgcctcagcctcccaagtagcctggattacaggcacccgccaccacacccagctaatttttgtatttttagtagagacagggtttcaccatgttggccaggctggtcttgaactcctgatcaaggcaggtgatccacctgcctcggcctcccaatgtgctgggattataagtgtgagccaccgcgcccagccggcccccccagctttgagaggcccagctctgtataagtacctgttgagggggtcctcattgaggaggaggtgacgcagcacagccatcacacgggcatcctcacccagcccatcacggtcccggcccagaaggtccacagctgtgagcaacaggactgcaggccggcaacggcgggcccgggagaagatggcctgcagttttgtctccacagccccactactttctgcacagaggctggagcagggcacctggggaggggatcccaatgggtctgtgagcaaggggaaagcatgacaagggcaggagaatcaggggaggaggaggtggaagatgtgggccatctttttctctggagggcagggacagggaaggtaccctggccaagtcctacctcttttttaccctatcccattccctggactgtccaccaatatcttgcaactccctcctccttgaaagtacctctccatagctcagcatcatgggaatatgcctgacccactgggctgaagtgctagggcctgtgagtagacagaggagggaggggagaggaagcagcagagagggagaacatgagctggggaggggaagtagctggggttctactctccagagaccctcaccttcagtaagtggagcccaaggtgactacaggcagcagcaactactgtggtcttcccacagcctggggggccccgtagaaggacactgctagttcctgtcagcagggcacccctgcaaccagagaacagacattcgtctccttcattttgcccaaacattagagtccccagtaacacaagatcccttagatctagaaagcagataccctgtttttctctccttgagcctccctgaccccaggacagggctgtccccatgtagtgaggctgtgtctcccacaccacctgcggtgctctggccggggcatccagcatatccaacagccaaagactaattaattccctttggcattgctgtgctgccaataaaacctcaacgttatgactggtctgaatggtattgagagacattgtggtggcactgaggtggggatctgcgtccacacctgggccactggtatgaggagttgtgtccttcagggccagggcagtaaagtgcaggatggccagtgagctccccaaggggaagggcagtctcagaaacagatgcccctgctggagattcttcctccagagccagccctggaggacagaggttatcccaggaaaggagcctgggaattggcttacagaaaggagtggcctggtggccttgtgtaggacatactggtttgaggaaggtcctcccaatcccactctggccagttcattaggaactacccatctggctgctgctcctccagggatgttctaagcaggcttttctcacaccctggggtgatgacctcactcaccctggctggaggcgaggcttcaggacagcacagagttcagacaccaaggcctccaggcctggaggagacaaactgctccagagagtggattcctctgaagggagccatggaacagggctcagggtagaacccacctgtgaaaggtaataaaaagctttcgtttctaaaaatcgtttctaccccctgcgctggtctacacccatccttggggcctcaccatgtacaaggaggtatgggtggtgtcggccaagtaggcactggctggtccatctggagcttccccaactgttttcttcactttaaaaaacatttcccgccacctgcaggaaaaaggcccaatgaaccccagatccagagtccaaaaacccccctcctcaaggacaaggtttctcaatcacagaggacaaacaaaagcaccacaagagcgtgtcccgagtcatggtggggaaaaggaatgcagatggactttctcatcttcctgacagaccatacacaccttgagggcaagagctatgcctgtccctctgcatcccccatgacagccatgagagctctgagggggtgtgtttctccaggcatgtggcctacccacccacaccaatgggagaagctgctgctgcactaagcagtggatcatctgattacttctactggcttcggtctccccctcaaatacacagccatccaggccccaaaaaccctagggggaagggtcccttggctcttactcaataatccacaaaatctcattgcaggcggagtccttaataatgccatctgatgaataatggttctgtattctggctgcacattggaattatctgtgtaactttaaaaactaaacatttctcacatattatatgattctattcagcagatcagcagttgccattgcctatgagggaagctacagggaatgactgctaatgggtgcagagtttctttttgagatgttgaaaatgttctggaatgaaacagtgatgttggctgtacaaccttatgaataaaaaaattgaattgtatactttaaaagtatggttttatggtgtgtgaattttatgtttttaaaattaacctttctccttcctttgtgaaggaaaaaaagcacaggctccagtctcaccctgattctgccccaatagatctggggtggggcttaggcacctgtattttttgaaagcttccccagcaattctgatgcataaccagggctgcgcagtagttggcgagtgtcatagtgagttagggttattcaacctactaacggggaataggatgggtagcaggaacagctactaacccaattttccagataaagaaatcatgaactacttccctctttaatcctcaggcagcaaggcaatgacagagtcaggctataacctagtcctctttaaggtccaatcaggctgcaaattcctctgctcacactgccccacagtctcaaagctgctctctctagcagcaaaggggtgtgagagtgcagcaaggtggaggggaagcataccaggttagtattatgaaactcttctaagtactacagtaaacctggaacatcaggaagcctgaatctgcctataattaattataaataggtgacagtgggcctctaacctaggatctcgatcaagctcaacagctgagtcatggtgtgtatgactcaccatggaagccctgcataggaatgagatgggggacagcactgtggcatagggagagaccaccttcttcagtggagggtggttggaccacctcagtgaatagaaaggccagagctctggaacctatgtggacactgctaaggaacactgagctgtgctccagccagccagataggtgatagtggagctggctcccatgcagcctggtttggggaagtggagcaccagggacaggatgaagaggctacaccaacagtggaattcctttccagggctcacaggaacttctgcagggcttcccttctcaagcccagtgcagcttaaaacgctcatctgtatctgtccttggacccattgggccacttactccaaccctgctttccttgcggggaaaagaactatgtgctcggcactcaggaggaaagcagggttctacagagttgagacaatagaagttcaggaacagaactggcttgccagcctgtctcatgaggttctagtgcctattttcctttgaaagtacaaagagtgggcattctgtagttttcctactgaaagctagctcaaagacgtttgctaaatttatgataggagagagaggtgggaagtgactgctaagtgccagcctggcattttccaccagactcgtggacttaatctggaaaacctcgaagaggtgacatggagcctaaatggggttccacagagcaccaccaccctgagactgggggtactgagcactggccagaaccaagcactggatattgaccagggatgaacatcaggcactccaaacaaggactgtctctcctggcagaggacccaggctggctatgccacagaccttggacatgaaggctcttatgtatgagttagtgcatctatcagctgtgctctccttctagtaaactgctgcaggaaatgagtccagaatacagggaatgctgggatacagagctatacattttcctccctacacataaggctaaagcagtgtctcaattctttgcctcaccattttacatggaacctctgtggtcagagtcaacaagaggagaaaagctggattccttattttgggttcttggctcggttatgctctatttctcattctctgttgataggacagggtagccctctcaaaaacaatagaaatccctggctgggtgcggtggctcacgcctgtaatcccagcactttgggaggccgaggcgggcggatcacaaggtcaggagatcgagaccatcctggttaacacggtgaaacccaatctctactaaaaatacaaaaaattagccgggcgtggtggtgggcacctgtagtcccagctacttgggaggctgaggcaggagaatggcatgaacccgggaggcggagcttgcagtgagccaagattgcgccactgcactccagcctgggcaacaaagcaagactctgtctcaaaaaaaaaaaaaaaaaaagagaaatccctctcctgttttcagagataggattgagaagtagtttgtgcacactccgtagttaaggcagaaatcagagcctgtatatccttacgttgagatatggatggtatggcccaagtcttggtccaaataacacgaaggctaagaacggaaaggaaggaatcccgtcttggtctaggccattaaactcttctttaaaaagaaaagaatttaaattttacctatttatttattttttgagatggagtcttgctgtgtcacccaggctggagagcagtgatgcgatctgggctcactgcaacctctgcctcccaggtccaagtgattctcccgcctcagcctcctgagtagctgggattacagatgcccaccatcacacccggctaatttttgtatttttagtagagacagggtttcaccatattggccaggctggtcttgaattcctgacctcaagtgatctgcctgcctcagcctcccaaagtgctgggattacagtcgtgagccaccacacctggcctaaactcttcttagtgctttgctttacatagggccaccagtcagtttgaggataaacacctcccaaagccagcagggagtggttcttttagtttgcttgttttttgagacagtgtctagctatattgcccagcctcctgagtagctgggattataagtatgcactaccatgcctgactggttcttaacctttcttcagtcatacacttgtttgggaactgaaggacaggtgaattttctctccaaaaaaatgtacacaggctgggggtgagtggtgcacacctgtaatctcagcactttgggaggccaaggcaggcagatcacttgagctcaagagttcgagcccagcctggtcaacatggcgaaaccctatctctactaaaaatacaaaaaccaatagctgggcgtggtgatgcgaacctgtagtcccagctactggggcagaggcagtgctgaggtgggaggatcacttgagccatggaggtagaggctgcagtgagctgtgtttgcaccactaaactccagcctgggtaacagagcaagaacctgttacacacacacacgcacacacaaaatacatgacaacgaaatcctcttgggcacaaattacacatgatttgcagggaggggattgtagaactcatgcacccaggttacaaatcccagctgtaggacagaaggcagctgcatacctgggcagtttctctggacttccttccaggatctctacttgcccaattgttggcacacatagaacatccccttcctggactaccctgcaacacagcagtggccctggtcaggtcacaatgggagtaatgagcatgtgttcattaccacatgtccacccccgacatgcagactacttcttgagtctactgcccgcccagagatcccacgcagttctccaaggaacaagtcagtcttaggatgagctaggggaaatggtggagagactagaaagggggatcagagacagatgagtggcagagcaggatcctggctcttttggagccctctttaatcacaggtgtctctgtttggaatgtccaaattaacctcatggttcagatttctcttctgtggtctccctgatataccaagaggcgcctaccacaatctgtctgaaatgttttttttgttttttttttttttttttttttttgagacggagtctcgctctgtcgcccaggctagagtgcagtggtgcgatctcggctcactgcaagctccacctcccgggttcacgccattctcctgcctcagcctcccaagtagctgggactacaggcgcccaccaccacactcggctaattttttttttgtatttttagtagagacggggtttcaccatgttagccaggatgctctcaatctcctgacctcatgatccgcccacctcggcctcccaaagtgctgggattacagacgtgagccacagcacctagccgcaaatgtggcttcttttaaccagggcctctggggtacttggttctaaggcatgggataggaggaatgtaatgagggtgagaagctatcctccttaaaaggttaggtagctaacctgggtatctgaaagtgccggtaaagaacaccgtcataatttccattagtgctgtagtggggagaagacacaatttcgatgtgtaactctctggcaaatggaggcccaggcagcaatgagcagcttcctttgtcttcaggggcgatggagccttccaagtacctctattagagaaataaccaccacgttataaccttctcctaagggggcaggctctaacctgtctctcagcagccaacatgtctatttccatcctgtctttcccataaccacaaggcttgtggaaggtggggcctgaggtagcagacctgaaaacctctccctctaatgggtaccaggaagagaatatcacctcctatcccgactctggctccaaaaaattttctcagtaaagataacctttctgtgacactttcaacttggcccagagccagtgaaatggtaaagacatttattcccacaagacctattagtgacaccaggcatccacagggattaacattaagtggtcattagtggggaaactgaattcaggctgtgggaaaagctgaacgggttggttcagtcattggttggttcaatgagctctactcttgagtaccccagtagtttttcctccattcaggaggaaacctacatccactccctttcacatgtatttcacatgtatctctacctgacatcccaaagtattaactggttactctagtactgcccagtagaactctctacaatggaatagtctatatctgcatgtgctattgagcacttgaaatgtggctaaaaacaaaacaaaaacaaagaaatgtagctaaagcaactaaaaaacatgatttagttttttttttttttttgagacttagtctcactttgtcgcccatgatgaagtgcagtggcacagtctcggctcattgcaacctcttcctcctgggttcaaatgattctctttgtgcctcagcctcctgagtagctgggactataggcatgtgcaccaccatgcctggctaatttttgtgggttttatttttttcttgagatggagtctcgcttgtcacccaggctggagtgcagtggcaccatctcggctcactgcaagctccgcctcctgggttcaagggattctcctgcctcagcctccagagtagctgggacgacaggcatgtgccaccacacctaattttttttttttttgtatttttagtagagacggggtttcaccgtgttagccaggatggtctcaatctcctgaccttgtgatctgcctgccttggcctcccaaagtgctgggatttaatttttgtattttttaaaatagagatggggtttcgccatgttagccaggcttactttatttagttttaactaaatttaaaaatttaaaaagccacaaagtggctggtggcttccatattggacagcaccatctaaaccatatatctaggtccttaattaaacactatactgtatttgtccccctaaacacaactttcatttttttctttttttgagacagaatcttgctctgtcacccaggttggagtgcagtggtgtgatctgggttcactgcaactgccacctcccaggttcaagcgattctcctgcttcagcctccccagttgttgggtttactggtgtgcaccaccatactgggctgatttttgtatttttagtagagatgaggtttcaccatgtaggccaggctggtctcgaactcctgacctcaagtgatctgcctggctcagcctcccaaagtgctgggattacaggcatgagccactgcgcctggccttttttttttttacacaatgaaggtttatttttttgtcactcttatgtctgttatggcgaactggtgagtctttactcagtaacccatggaaatggaacaactattatctgttctacaactttcttcttgaagtaaaggcagaaaccaaaaactttccttggatgtatttaataaaatattaaaactaaacaccaggcaccaaagataataaagactcctttccttcaaggtatttacaatatataattggggattaaacagattatgtaatcataacaagatagaataaaataaatgccataaaaaagatagaaaatgctataggaggaagttctaaattcgtggctgtgagatcatgaaaggctttgtgataaaggtgtcatctttagatggctcttgagggaaaggagggtaggattttaacagatgaggctagaataataggaaacaatttgaagtcaaggataagaatgagcaaaagcacagagacatcatcctccatattataaagcacaatactgaatacattgtagcaattcaataaactaattagattgagtagattaacatacacatctgaaacctcacttttttttttttttttttttacacagaatttcgctctgtcgtccaggctggagtgcagtggtgtgatctgggctcactgcaacctccacctcccaggttcaaacaattctcctgcctcagcctcccaagtagctgggattacaggcatgcaccaccacacccaaacttcacctttcacctgaatggatgaaagccttttgtatgccccactacattatggaggcttatgatattttgattacagaatatggatcaataggccgggtgaggtggctcacgcctgtaatcccaacactttgggtggatcacctgaggtcaggagttcgagaccagcctgaccaatacggtgaaaccccgtctctactaaaaattacaaaaattagccgggcgtcgtggcgcgagccagtagtaggaggctgagacaggagaatcgcttgaacctgggaggcggaggttgcagtaagccgagatcgcatcaccacattccagcctgggtgacagagcaagaccccatctcaaaaaaaaaaaaaaaaaaaaaaaaaggaaagaaagaaaaagaaaatagataaatgaggctaagaaacattatgcttttttttttttttttttgagacagagtttcactcttatcgcccaggctggagtccaatggcgcgatcttggctcaccgcaacctccgcctcccaggttcaagcgattctcctgcttcagcctcccaagtagctgggattagaggcatgcaccaccacgcccggctaattttacatttttttagtagagacggggtttctccatgttggtcaggctggtctcgaactcccgaccccaagtgatccgctcgcctcggcctcccaaagtgctgggattacaggcgtgagtcaccgcgcccggctagaaacattatgttcaaagtccgggatgatatggggcacgagtcctaaatcttccaatttacctaagacagagaagagggtataagaaagaggaagcactcctgaccccagtcctttatcctacctgaattctgagctctcccatttccagggggtcacagccaagattaaaagccaaagtggcagggacaagcgccagtccgtcagcgaggggctctcccagcggtccagagccgggtcccagtctatcagagaggtcccagcgaggttctaggacctgcaccctagccaagtgcggctgtgaagtgttcgatgactctctggcctgggccacccacacccattcgccctggaagaggccaaggccacggagacagctccggctcacccctagtgaatctccagtccctcccagaactccctggagtcgccgcactgtgccagaaaccgcaaaggaggacaccacgggcgggggtgggggccgactgctgtccccagactctggacacagtctggcccgcccgcggagctcagtcacagccagccgagtccctgggcccagcagcccttgcaacgccggccgcgtctccagcacccgcggtccgggcactgggagggtctctccgcgcctcaccagcagcggcccgactcgcggtccgagcccaggccccagcgaggtgccaagcagtgcccaacctagcgccgggggccgccgcaccgcccgcgcccgcacccaggccccggagcccagtgccaggagccgcagcagcgcgcggctaaccagtagctgcggcggcccgggaccctgctcttcggtgcccgcgtccggcccctccagggctgccaccagcagcgccggccctgccgggctctcccctgcaggcctcagggccagcaccaggcccagctccgccgccggccacgggcccccgggtggcagcagcactgccaacgggggtgtctcggtcggaaagggctccaggacccgcaagacagccagcgccatggtgacaggacaccaacgaggagggtgaaggagcgcagcttccggagccagagagccagacgactagtgtgcgcgagggccgcttccgcttccgtcaggggaggccagaggaaaaggggaggggggtcgggtgccgcgaacttgctctgagggggttagctgcgcctcggattgatctgcgtcgtgcctcgataggcagtaaccttcatcgctgcggttgcgtagcgtttacccatgcgccatttgaacttgtgcttaagggatttatctttgccttctacggaagtaatgttctcttaactatttttccccgtggcatgaacgtaacagtttattgactgataaatgaacagtcagcatgctcgggatgactgggcccagtactgggagctctaggtgaaatgtttcggaaggagtccgctcctctgcggagctcctgcagcttcccctgtggaactgtgagcactgaggtttgagggttgcaggaaaggttgcaggagggagtagcaggattagaaaactgtctcacacttgcttataggtatatagtggctgctgagtgaattactagatgtgattcatacagccctggagtgcttggtgccaccacacatgttccagcacatctggcacaaaacccatgttccaggacttcttgccctgttcattgttctgtttgttttactcccaccaaacttaagttgaagacaaaacagcttttctttcaccccccccccccaaatccttgcagatcggaaacccattcactttctatcctagagcggggcaggcagcagagcaggcagaaggaaaggagttcaaggcttctgtcagcataacaccaacagtcgacttcctgcgtgtgctgttatttagattccatccttctcttcacctccactgttctgtacaagacactcagctagtggtaggccacatttccttttttatggcaacagggtcctactctgtcacccaggttggagtacagtggcacgatccccattcattgcagcttctaccgtcccaggctcaagtgatctcccacctcagcctcccgagtaactgtagccgggaccacaggcacacgccaccatacccagccaattttttttttgagacggagtttcggtcttgttgcccaggccagagtgcaatggcacgatctcagctcactgcaatctccgcttcccaggttcaaagaatctcctgccccagcctcccaagtagctgagattacaggtgtgtgccaccacacccagctaatgttgtattttcagtagagacggggtttcaccctgttggtcaggctggtctcgaactcctggcttcaagtgagccacctgcttacgcctcccaaagtgctgggattacaggcatgagccactgcgcctggactaattttttattttttgtagagacagagtttctctgtgttgcctaggctggtctcaaactcctggtctgaagagatcctcaggcctcagcctcccaaagtgctgggactacaggcataagccatcatgtcccactgcatttccaattattaacaattattttcacttacaataaatgaattggatggtgccaatctccattttctagaccttacattctctttcagctactgctcagctttctccatctctcctttcttcttgaggcagtcttctattttgtacattatacattcctgaaaatttgaaagacaaatatatgaaaactattagatttgcatattataaggggctgggcgcagtggctcatggctgtaatcccagcactttgggaggccaagtgggtggactgcttgaggccaggagtttgagaccagcctggccaacatggtgaaaccccgtctctactaaaaatacaaaaattagctgggtatggtggtgtgtgcctgtagtcccagctactcgggaggctgaggcaggagaatggcgtgaagccgggagacagagcttgcagtgagccgagactgcgccactgcactccagcctgggtgacagagtgagattccgtctcaaaaaaataaataatagaaaaaaataaataaaatagcatgcaagaatgtactaaccaggaaccatggcttgtgtctataatcccagctatggggaggctgaggcagaaggatcacttgaacccaggaatttgaggctatgattgtgccactgcactccaagtgggtgacagagcaagaccttgtctcttaaaatatataaaattaaaagaaaaaaaaactaaataaagaatgttctaggtacctagattcacatggatgaaagttcccatttggtagtgctactatatgtttcttggtcccctatgtcccagaggaaccaagggctagatagatggtacatgggcctaaagaggatatgcctgctttcctcagtagcaggcaagctctaggcctcaggactatagtgctccttgaggccttggagatgggtaaaaacatcagttatcttgcctggatcagcactcatacagacacaaatacccacccacaaataaatgtccttttctcccaagcttttctcccagcaggtaacagcgggcatgtagtccactttgtgttaccctgaaatcgtcattagtcaccgaaagccaaatactacttctgtaagatcgccaggaccctacatttgccatcttcacttcctcacctcttgatgctcactcttccactcactaaaaacggtcttccactctctgaaaaaatcacccataatcttctaattgcagaatcaagatgatgctgttctttctctgacactactgaccaattgtcttttatttcctttgccattatgacaccagttgtcctcctacaactctgatcacttccagaaatcatcctcaactcttccctttccgttaccgtcccccccacaatacaatgaatcaccatatcctgttgattctacacattttcatgctccatcctctcttctccatccccacggccactgtcttgtaacattgctctcctgggtacctgggtaagggacacaggttttgtgtttttttttttttttttcagatggagtcttgccctgtcgcccaggctggaatgcaatggtgcgatctcggctcactgcaaactccacctcccgggttcaatggattatcctgcctcagcctcctgagtagctgggattacaggcacccaccgtcatgcctggctaatttttgtatttttgtagagacggggttttgccatgttggccaggctggtcctgaactcctgacctcaggtgatccgccctcctcagtctcccaaagtgctgggattacaggcgtgagccactgcgcctgaccttttttttttttaagactaaatattttattttatatagaattttaaaaatttattttttgtacatgaataagttctttagtggtgatttatgagattttgatgcagccatcacccaagcagtgtatactgtacccaatgtgtagtatttttttttttttttgagacggagtcttgctctgtcgcccaggctggagtgcagtggcatgatctaggctcactgcaacctctgcctcccgggttcacgccattctcctgcctcagcctcccgggtagctgggactacaggcgcctgccaccacgcccggctatttttttgtattattttagtagagacggggtttcatcgtgttatccaggatggtctcgatctcctgacctcgtgatccgcccgcctcggcctcctaaagtgctgggattacgggcgtgagccaccgcgcccggcctccattgtatcattctcatgcctttgcatcacaggtttcttcttttttttttgtagacggagtcttgctctgtcgcccaggctggagcgcagtggcatgatctcggctcactgcaacctccacctaccggggtcaagtaattctcctgcctcagcctcctaccgggttcaagtgattctcctgcttcagtctcccgagtagctgggactacaggcgcgcgccaccacgccccgctaatttttgtatttttcatagaggcatggtttcaccatgttggccgggatggcctcgatctcttgactcgtgatccgcccacctcggcctcccaaagtgctgggattacaggcgtgagccaccgcaccctgtctaatttttgtatttttagtagaaatggggtttcaccactatggtcaggctggtctcaaactcctgacctcgtgatctgcccactttggtctcccaaagtgttgggactacaggcgtgagccaccgagcctggccacaggtttattctttttgtcgtcattgttgctgttttgagacagagtcttgctctgtcgcccaggctggagtgcagtggtgtgatctcggctcactgcaacctccgtctcccgggttcaagtgattctcctgcctcagcctcccgagtagctgggattacaggcgtgcaccaccacacccagctaatttttgtatttttaatagagacggggtttcgccatgttggccaggctggtctcgaacctctgacctcaggtgatcctcctgcctcagcctcccaaagtgttgggattacaggcgtgagacaccgtgcctgcctggtttacattctctcttaatcctttgtttatacacatctgtgattcaccagactgcgaactctttgtgggcataaactgagtcttacccattagaacacggacttgagcagggtggcaagtaagggatggatttcctgagacagtcaacaatgaagttgcttttccactgcgttcccaactgctcaaatctagctggttccccaatcccagtacacttgcagtagcaacggggaccctcttcctaaagttgcaccaagccagggattctccactcatttcgcccaggtcctagccctgccaggcttcccctttgctcctctgcaacccctgtctagggaggcgggtgtcttggaaggtccttgggagctccctccatcaattttgcatctgcaattagggctactttaccccagtgaagaaaggtgccctccgtattagggcttccttcctccaattccgactggacagggtagcagagcgggcaaagtgtgagagcctttagaaggaaagagcagggctccaagcgccgcgaagaatggccgaggccgacgcacagcagacgctggagtgcagccctcctagccaagcttgggtttccccttatccccgcctccttctctaagctcgacccactttagggcgggaccacccacttcagccaattctggaagccgaaccctggcggtttgtactatttctttccaataagaaaaaaaggaagcagcttggctccaatgaccaatccgaggaggcggcgcctggttgtcaggcagttttgtaggagttcgggccaattggaggcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggtgagcgtggccctttttcccccaccgccgccttggagcctgcgcggagctctgggaggggccggagccaggcccgggacagccccagactgaccctcccgtccagcccccgcaggactcctggggccagccctccgcccccgcggctggcagcacccccagcttgtgccgcagctaggacagctcccccaccttgccccggagagactccccccacatacacctccctcccttcttcccttctcttacccccggcccagggtaacctccttcttccagatctgccccattcccaggtcactgtcctgctttttctgtcccccccatcacccctggccccgatcccccttcggtttgggcagcccctcatctgaaactgcaccttcctccagaattgccccctcgccccgccctgagcagccccttgtctcctcttcctacccgcctgggacagccgccccgcagtcccctacggccccttctctttccatgccaagcccctgacctagaacagcgctgctttctctctcctccacccaaatctggcctaggcccctccctctagttcttccttcacacacaaacttgtaagcaggactgagcccttctgttgatggaacctcacaacgttggtgctggaagggacctctgagcgcatgcagtgcaatccctaatggtacagatgaggagactgaggccccgacagggcaagggacttgtccaaggtcacacagcctgctggaggcccagctgcaatatcaggtctcctgacttaaaggcctcttttgtatcaaagccctcctaactgtcacccaagtgcatcctagaccagtcacctttcctaatctgagtaggctcctcacccttattcttaatcctaggataacctttgcatttttcctttttttttttcttttcgcaccagtgctggatttctgcctttcctaagctacaccatcttcaaattgggaatttgtcctcactgtcagattattgttccttcttagcctgcaggccagccacccctgaacacccatgtctttatcatgatgtcctgacacaggccatttctttttttttttttttttttgagatggaattttgctcttgttgcccaggctggagtgcaatggcgcgatctcggctcaccacaacctctgccttctagcttcaagcgattctcctgcctcagcctcccaagtagctggaattacaggcatgcgccaccacatccggctaattttgtatttttagtagagacggggtttctccatgttgatcaggctggtcttgaactcctgacctcaggtgatctgaccccctcggcctcccaaagtgctgggattacaggtgtgagccaccgtgcctggcccacaggccagttcttaatgttgccttctttcaccttcctcatctacctcggtgctgccttcccctgctcctcatccgtgcctttttctaccctctgtttcctgctgttgctgaggtctgactcagaggtgtggttcctttgaggtacagactcacacataggatgctaggataccagttccagcctcccccagcttctcctctcctggggctggccctttttggtgggggttggctctggcctggtgttctggccacctgctcgatgaccccagaggtatattgctttcatttgccctctgattggctgggttactgggctgccatctctgaccttttcaatcaaactttttctcctggggctgttctgtatttgccaggcagctctgattctgagttgtccccttaacctttcagggcctgaggttctaagtacagggttggtgatggtgtactagatagtgagcctcctgggagtagtgagctggacagggttttgtgccccacccaggccctgtccttggggagtgggcatgcggaggtggtttgggtagctcagtcgtagacaatgcacacagaaatcagccacaacaggggctaagggaaatggaattcggggaaagctggtgaggtccccacccatttgtaatttttagtctgttggactagatactgtcccatccacagaaagcaatagcctactagattgtgaagaagacaaattgccagtgagatttgctaggaccatgggtgtaaacgtttggttgggaaagggtgttggaagtaacggggtgcatggagccaggcataactctcacctccctataaggtttttctgctcttgattttcagttgcatttggccttcttcaatggttggcaggctctaaggggcaggggggttgccagtgtgactgaggtttgtctggatggctgtgggtggaggatctttattgctcatctatgacctgtcccctctctcctggccatctttcacagcttcctctctaaagcctttctgagccctcagtcaggagtgaactctcctttcttttctggatttgcagaacacttagtaggccacttatggtccttttgtgtttggccttggatgggaattaattgtggacaagacttttcttcccctttgagataataactaagtttcattttggtttgacaactccttttcacacggtaagtacgtgcttagtggataggtgctaagataatctcttggagggattcgcatctctcctcttccttcatgttctcctctgggacttacctcttttattttcctgagtagggtgcccctgccccctccgatttttttcttgttcataataatagtaataacattgaccagcactacggttttcatgtgccttaacactgtgctgagggaagagggtattatgattgtcatcatctaatagatgaggaaactgaggctcagagaggctagttaacttgcctgtgattacacagccagtaagagttgggcccaaaacacagggctgagtccaaacatgttcttttaacctctgtgctacacagcatttgactactgagctgggctgaaatgtgtgtgcttcacctgttctgcaggagccagggagcaagggtggtaggcctggttcctccatgcccactcacacccacacactaaggcagctggatctctcttaggctcattctttgaaagatacgtctgaggcatcatgctgagtgctgtagggtgggtggaggggtacaaaaaagaataagcagcttatggtctaatagattggagatgtatgaagatgggtcagctttgttcaaggggttcatgtctggggtgtgtgcagacacctcaatgttgtgtcctgcctgcaccctgcccccggcctatttctctccaccccatgctctcagccactgataagggtcagtgtggccagctgggttagtatacagcaggagcgtgctcaggccaaagaaggaactccttccccctactgcatggagctgctctacaccacacctttcttcctccccacctccaagaagccttccccctactccagcccacacagagctctcttctccctgaaatccttttgcccccatagtcacaataactcgatttaacacttctcactgaaggggcttggctgctattgaattgcacaatctcagagctggaagtgatttccaagatcctccagtcctcattaaaggcttgaatttcttttgcaacatgccttacaggaggtcaccaagcccctgcttgaatgttctcaggggttggggagctttcggcttcactaggtggccagttttagtgcaattgctccatgataaaattcttccttgtttggagcttcaggtggcttgcaacttcagcccattgctctcgtgcctctggtccatatggacaagttgcatccaaggcatccaagttgcatcttcatttgtttaagatccatcttgcttctccatccctcatgactcctcccttccattgttaactatcccagttcctgcagctgttggtcttgggacatgcctttgaatccactcccagtatgggttgcatttccctctaagaaacactaggatttgtcatggcccctcccaagcctgatgctcatgactgaaccagatcctccaggatagccctgtcagtgccaagcagtctgcacaggtcttttaacaagatggaaggtcacatgagctgcacatggatgatttgtgttgagcttgcagtcagacctaaatccccaagtctttttcacattttccctatcctgtccctgtgcagttgctttttttggctcgaagcataggaagagatgctgggcaggccagggctctgagccagctgccaggttcccaaaggagacttcagactagtgctcactctttgtaacagttcagggttttacccccatccctgtcttagtgcttgtcaactgaggtgctcttggcattttgagtgggacagttctgtacctgttagcattcctgggccttactgattaaatgctgagtagcaccctcttgtctgtgcgctatttgtgacatccaaaaa

SEQ ID NO: 374 - DNA, 59868 bp, Homo sapiens
gaactgtgttgtaatactttgcaaatgaatagacctctatgcctagactttgcagttatgagaccatcaatgccctttctgtttaagttagtttgagttgagtctctgtcatttgctgcgaaagtattagggtcaccaggccagaaaatttttggggaggatgcctctgtttgaagaccaagttcaggttgtggccagactgaaattacaagtgacccagaggccaatcttattcacgggtttgccttcctgaaactcttctgctctggatatttccttctcttcagctccccaaatcctccccatcagtcaagaccctggttagactcctccccgtccaaagccttctctgaccatctctgcctgcactgaactctctaccttttgccttctattaccaattatgattatcaaggaattgtgaactgtcttataggatgtctgctttcattgtgtagcatggcactttaataattttactgtttacagtttgctaccttctcccaccaggtcaatgtcagagacagggtctgatgcttttgtgttcctggcaggagccagcataatgtctggcatataacagacctcattgaatgtttggggattagaaaattagtggaaacatgattttaaggtagaaaacagctgggatctcatcatgtgagagctattgcaatgtgtatacagctctttttagttgagagataagcactcaacttaagcgcccagaatgacagtgggttgcattcctctattaaggctatctggtctcttaccagagaactctttcatatcagggagtggggctggaggaaggggaagagtagggacagggggagggtaggagtggctctgaatcagctcctctttggagctccagaattgcctcaggagccacactggagaaactggaatactcattccactgtcactcttcattctggatccagtttaaacagctggagatgacatttccaccagacgtgggtctgaatggcattctgctatttcccatacatcctgccccaacattaagcagtccaggatttgccagcattgaagccattaaaaataatttaaataacttttgagtgacaagaagatccttgagataagcctatatcctcgttctttgaaaacaatactatttgagtatatggattctgggtcatcattaaaaagggagagaatctctctcctcctttcaagtgtgataatagtcacacctgaaaatgcggcaccgttaggccctaaactattctctaattgttttctggctcttctctttttgatttggttataaatttccctcctggggaaatatcatgtcttatactaagtgtacatctcccagcaaccaggatgctcaataagtgactattggatgaatgcatatttacctagacaaacaaacaacaaaaccccctaacatttattaagcacttactatatccaaggcacatactaagtactttactgctattatttcattcttagagatgtatatgtgtgaaaatcacaaagggaaaaaataattatattagggtgacttctagggcttctttcagctataagatgccctgacttgatgtggcattaaggaaactaagatattgaggtggggcttgggaacctaacacttatcagcagaactataaataatattattagcgacctctttctgtgagctaggaactatgccaagtatcttaaaaatattttctcatttattcccaaacagcaacactatatgataggcactactgctaaccccatttttagaaggggagagtgaggcacgaggagattaagtggctagtctaagaagcagtgctagcacccagggctatggtgtcttaaccaccatgctcctgaagagacaccaaagccctccatacctgagaaggtgtatttccactgggccacagggatgcaggggagggggaggagggaacgttgccatagaaacagcaggatcctctctcaggagggttggcacatagggcagctggggctgaggaaggctctggagataattccggggcatccagcctctttagatctgcaagagtctgtgagcccagtaggaagccaactccccactccactcagcagcacttggtaaacctcagctttgctccccagaagggtaggacaggatgttctttgagttatagcagcaggactattaggcagcagagctgtgattagggcataaaagtctgtggttgccaggcacaaaccgtgcttcaccttttatagccagctagcttgagatgtcaaaagtatttagagacttttgctttttttctctactcatcaactttatgaccctaaacgcattcttccttctctttctgtcacacatttaccagtccctgaaccgagtttgtaactcacttgtgagtctagaaggctttctgaagagctttaagttatttcaaatcagattggttgggcagagtagagagtgggggcatttctttctttccttctttttttttttttttttttttttgagacagagtcttgctctgtcgcccaggctggagtgcagtggcgcgatctcggctcactgcaaacttcgcctccctggttcaagcaattctctgcctcagcctcccgggattccaggcacccggcaccacacccaggtaatttttgtatttttagtagagacagggtttcaccttcttggccaggctggtctcgaactcctgaccttgtgatccacccacctcagcctccaaagtgctgagattacaggtgtgagccattatgccaggtaggggcatttcttttttgggtttattttgcttcagttactcccagcttctctgctctggcctagtggctggctccttgggagctggggtggggtattttggtggtagaatggtggctaagagcataggtttaggctgcagagggtcctgggtcatgtcctgactctaccattaaggaccacatgacttgggacctgtgacttaacctctctgagtctcaatgttctcatctgtaaaatgagagagaatgatcacctgcctcaaatgattgttttgaagatggggtgagaatacttatgaagcccttagccctgttcctgtcaccattctatcccctaattttctcagcagacctaagacagccacaggcctgggatgagggtatctgaaggagggtttatgaagccaggtttttctccctagataaacttggaggtcaaggataaagacagcttgttgtagcagaaagatccagtttgaggtttcttaagctggtagaatccaagactcgcaggattagaagagatcctggaaatcctgtaagactgagaagatggcagctttgttgcaggaaggtggaaaagatagtgaaccaggatgacctccacaaagtaccactcatgaaggcaattgaggttttgatgggagtgcctggaggccaagagtaggatggggccatgtggggtctttgagctcagtcactgttcgagtgaaagcacaaagttactttatcctcccttggaccaattcctcatttttccaggaggagttgctggtgacttaggaaacctgatggaataggtcccagttgccctaatcgggttataaccaacccatgtttcccgtatggcctggcacagaaaccaaaagaaggttgtgcagatctgggggtcacagctgtcctgtcctctttgaacaaactagagaaggctaagaggaaaacatcaacaaccaaaattacagtcaggaagaagtgcctccatctgcaagtaactgggcaattacctgctaattaagctctcagtttgttttctgaggcttaaagtgtagtacttggtagatgtgccctgccctgcttgtcaccaaggtgttgaagatgaagcatttcacatgaatcaagatggaactcttccatctgattaaatataatagcttgatttatttcaacatcatgaggtcttaaaagcaatgcccttttatagttggagcactgggagggattgcagggttttgagtcctctgtatctgcgggtggcggtgggggaagagaacgcaccaagaagggaatagacacgcagaatacacaccagtgtttgtcaaagtatggactgtggatttatctcttttgcatctgaatcacctgcccattatgaatacagattcctgggtccacatcggtcccaagtcagacattttccacatgattcttcagaacatccaggtctgaaaatctcaggtaggggtggaaagtcttctggggatattaacattgatctatgaagtccacagaccaatcaaaacaccatttcagccaatagtgtctacacataccccaggaaatcttttgctttagcattaaacagatgatggttccatgtttatacctcatctccctataggtggagatgcaaatagaaaagcagcccagcatcccgaagccagcgaagaaacagcacgcctgtgtaaaaattaacccccagatcatcaaaggcaggcgtctgcgtgccaactccctagtctcaggtgttgtaaatgctgactactgccagtttatctactgataacgaaggtgaacataagcaatctccagaaatcgttcacatggggctcccaggttcttgaaaaaccacaagagattgacaaatgcttctattgtagacacaaatgcaaacaaacagctcatttcctcaagagctccccactgcagtggctgtaaacagtatagggaaggaggggagaagtcttcttttcccttcccccacagcttcttcccctttctgatgtcagatttttctgacactaagaagtccagactaggggaaagaagctattaatacagaacttcaggaaggggatccccttcccccagaggccgcagttctttcaaagtttgttacaaaccctccttttttctagtttcagagagtctggggccctaaagctttgaatccctgagtcttctgagacattgtgttacagtgcttctcaaacttcattcagtgtgctctggtgaaacacagagctgggtcctgcccaccaaagattccagcagattgtaatagattgtgattataggcagcccccaatactcaggaacagggggtagtagctcacattaaattaaaaaaatgcggccgggtgctgtggctcacgcctgtaatcccagcactttgggagaccaaggcgggaggatcacctgaggtcaggagttcaagacctgcctggccaacatggtgaaaccccacctctagaaaaaatacaaaaattagccgggcatgatggcggtgcctataatcccagctacttgggaggatgaggtggaagaatcgcttgaacccgggaagtggaggttgcagtgagccaagatcgtgccattgcactccagcctgggcgacaagagcgaaactccttctcaaaaaaaaaaaatgttttattgagatatatttcacataccatacgatcctcccatttaaaggtttttttttttttttttttttttttttttttggagacgagggagtctcgctctgtcacccaggctggagtgcaatggcacgatcttggctcactgcaacctccacctcctgggttcaagcaattctcctgcctcagcctcctgagtagctgggaataaaggtgcattccaccacacccggctactttttgtatttttagtagagacggggtttcactatattggtcatttaaagttttttagtatattcagagtagtgcaaccatcagaatattttacaagatttgtatcactcctaaaaagaaccctgaacccgtcagcagtctctccctatttcttctaactttcctcaatcccagccccagccccaggaaaccaggaatctactttctctccgtatggatttgcctattctggagagttcatataaacggaagtatacagcatttgaccttttgtgactggcttctttcacttactataatgttttcagtgttcatctatgcatcaatacttcattcctttttatggctgaataatattccactgtacagatacaccacattttgtttattcattcatcagctgatgaacatttaggttgtttttcttttttttgagacagagtcttgccttgtcatccatgctagagtgcagtggcatgatcatagctcactgcagcactgacctgggctcaagctatcctgctgcctcagcctcccaagtaactgagactgcaggaaagcaccacaacacccagctaattaaaaaaaattttttttttgtagaggtggggtggggtcttgttatgttgactaggctggtcctgaactcctgggctcaagtgatcctcccaccttggcttcccaaagtgctgggaatgcagatgtgagccaccactcctggcctggttgtttctactttttggtttttatgtattagccatgaattaatgctgccatgaacagttgtgtacaactttttgtatgaacaggtgttttcgtttctcctaggtatatagctagcagtgaaattgtggagtcaagtagtaaatctatgtttaacctgttgaattgcgccactgcactccagtctgagtgacacagtgaggtcctgtctcaaaaaaacaaaaccaagaaacaccttttgagaaactgccagactgttttccaaagcagctgcaccactttacatttctgccagcagtgcaagagggtttcaatttctccacatcctggccaacatttattattacctgcctttgattatcggcatcccagtgggtatgaaatggtatttcactatgtttttaatttgcattttcctgatggcgaacactattgggcatcttttctcatgcttattggccatttgtatgttttctttggagaaatgtatattcggatcctttgtccatttttaaactgggttatttgcctttattaaattgtaggagttctttatgtatttccgtaagtttcttatcagatatatgaattgcaaaaatttccccccattttttgggttgtcttttcacttgatgtcctttgatgcataaaagttttaaattttggtgaagtccaatttatctttttctttcctttgttgcatgtggctcacatttttgagaaatgttgctaaaatgcaacttggaactctggaagctttgagatctcagagcttggtggggcttttcaggtcacttttgagggggattttctccatgtttgaggtttcattcctccatcccagccaggcatggctcctctgagccaggagcacagagccccagggaacctttactaggcttacgttccctccctctcctgaggtctgccacaatagagcagctgaaatgacagtctggaaatgtcctttattgtgaaaactcaatggcttttgtctctgggatttgaaattttcatgcaagtattggcagccaagaattaggaaggaggaggggaagagatgggggagtaaaccctgccactaatttccatagtgaatcatctcaattctctgttgtcttggttttctcatccaaacagttgggaaaatacctccatctcctcatctcagctggggtactgtgaaagtgagttcacctgtatttgttagaacaccttgagatcttggattaaaggcattgctgagacacaaggtattataataataataaatgatttaatagcagggtgaggccattgcaacaagaactggtaggaagaggctccgagctgtggaggggctgcagcctggagcccctggcccttgacacagggttttattatcggaggagagactgtgcgatttctcacaaactctttagattgtttcagttgaattcagcattgttttactgagtgcttcctatatgacttctaccacagggagattacaatctttttaggaagtaggtgatataaattaaaacaattattaatagaaacaatatattataatcaagtgaattgggcataacaagtgtcagaaagaaactggaagcagtgatggtgaagggcagaattccctgttatgacttccaggtctaccacccactagctgtgtgactttgcctcagtttccttttctgttactgcaattgtttttgtaaagtacttagaagaatggctaatacatagtaagcacactcatagtaagcacacacccatctaggcacttgcccgacactgcttttgctggttgtgtaatctttgccaagttgctccttgcccctaagcctcagtgttctgtctgcaagatggggattaggatatctcctacctcgcaaggtggctgtgaggatccagggacacagtttgttaagagtgtagcacaggccctctgcatggtaagcattcactaaaggacagttatgactgccactaacactgtaacgtgtcctggctaaggagtgaagggtcgctcacaagtggctaagtcagggggcttctttggaagctggaatttgaagcggaccggaaggcattcgtaagattcaggtgatcagataagaaagcataaacaaaaaaaggtgaaagcctgaggttggaaggggtgaccacaagtcctggaaggccagaagggggacttgtcacttctcccctggccggcggggtctagcggagccccaactaagttgatctatttccgagcccctcttctgcaatctctgctctcaccttcacggtccgcgagtctggggctctgcaagcctccaacacaccctccctccctaaggaatgtgggccccgctttctgggcctgccagaccgagcgcctaccgcttcctccgcaggcaggagccgggacgctgccttcaccccaccctccgccaggatccagtttcaaagtcacctgaaagccatttccttccgcgcctgccccgcctctcccctcccagtagatcacctggagcttgcatttgcccagagcagcattttggggcgggcgcttgttttgttttaaatgatacctctagaaatcgtttgctgtacacctggataacaaatataccccgtggttctaatatcagcgtcctattcctcctcccaaggaactagtgatagcgcctaaccagtgggcgttgttcctcttccggagccccactctgggcttccctcctccgggcttgttgttcttcaggatctttactgatgaattattatgggtttttggatttatgctcttgctcaaaatgtattgaatgtctctgtcccccatcctcaccccttgccccccagtttccaggtgtgtacctttccatgcatacacggtcatatacagagacataaagacaaacggttctctttgttttataaaaacgggtcctctatcatccaggtttctgtgttttatttttcctatttaacagttccttgtggagttgccttcacgttgtctcctttatctctttcccgtcagcttctcagaggtctgcatttaccactgtaaagcgtcacagggaccgagttatggtgaggaattcaagacatgcctttctgacttggaaaagcggacacggccggctctggtaggattaggatccccagatcgatcccggctggtcactcacttgggaaagccctcagcccccttcgcagggcccggtgttccctgtccatacaaggggtacgttctggcagtccatgctgtctcgggaggcggtgatagcaggtctgtgacaccagggtgaccccaccacgtgcgtcttggtatcctagagcatctaggctgcccgggggtgcgcgctcatcaccctgcgggcgttaatcgttaaccgcgcccaggcctcgccgccgccgcagccttaccccggctctggctcgccgcgccgcgaaggttgccccggcccccgcagagccgccaattgctggactgcagccgcgagctggagtctccacccacaggaaaaattcctggcccgcccctccctcgctccctcgctccctcgctccctcgctccctcgctccctcgctccctcgctccctcctgccctcccgctgcagctccggctccgctcgacttcctgccgggcgctggcaagccgcgcgctgcctggggtctccgggggccgcgcttgcagctggccgagtccgggccagctgaggggctggcggtgggcgggagcggtcggcggcctcagccccttcagagagcgactttcaaactcgcgcccgcgtcgcggcagcacctgggcagccccgcacgccgtgcgcgtcccgagcccgcggggcagctaccgctcggtgagtgtcccctgattctcctctctcccctcttatctccctgcattaggctgagcggcggtgccggcagtcacgctggggccccagtcccttcgcggcccccgtgccagccccctgcggggtgaggaccggggcgaccgaggagggcctggaactgtgttggctgcttcccgggccaccctgccgcagagtgcgcgagcgcaggagggtcgtatggggagactttttctgtctttttttccctccactccggaaacaaaaggggcaaatgcgccgggcggctccagagaggctcagtttgaaatccaggaagcccgcgaggccgcgcgcgcccgagggctggtgtttggctggagctgtgggcctggcgggtggacccttctgcgcgaggacccgagcctcggctcctgccagccccggaggcgcctgcagcctgttccgggttggcgccgcacggtgctcgctgttgggaatctcggctacctgtccggcagggaggagagtgggggccagaagcggggagcggaaagcccggccaccagctgcctcgacctcgtccactcctgaagtcggtttggttcttcgcacccctacacccagccctttggtttggaaagccagtataaggcgtgcaagcttaaatttttaaggcgttaaatagctactttgactcttcggggcgcctttggaacacaaaaggaagaacggaggggagaatggaatggttggaggctggagaggtgtggcttttggggagggtgttgttagaggccgcgaaagagtttgatcctcgaggtcactcgctaatctgttggcatatgtaggtgcctgtcccctgctctgggggccccagcaggagacccacactgcgttcaccttacggggaaccctggagtgggggttcccagagtctccccagccgtgcctctgcacgcagcccagtcacatggcccttgctcaagaaataataagcagggagggcaatgacagtccggagcgggggagggcctccccgttgagcacatcggccacctcgccttcagcagtgtggttttccgggccatcctttgttggacaaggatgggatcctgagtgattaaaccccagctgttccccaggaggaaactagggagtgagaaccaaaagtgtacatttatctctctgttatacatctctcccctgtggttccgggctggccccctggatgcaatggcctcacttctcctttcgacacctgctgtcctccactcccttcctggaagataggacaacccattagctccctgggtaacttgccctggggatggggcaggaagttgggggaagaggtacccagaggccaagtcctagctgctgagggagtgatttgttgaagagctgctttgggggcttttctactgccttttattagaagtggcatggcaggggaagtggaaagagcactggcctgatagtccagcacgggtttatgcctgagttttagacctggctcttctgcatagcatggaagattggtagagttgaagagtgcgagtcacttgggctggggggccccttggattagcctacttcatttactcgtgaaggcagcagagcccagaggggtgaggtgatttcagccttagaccctattggccaagtagaaaccagaggtcagatgtcctcattgtctgatctgtgttttctccaacatgatctggccaattcacttatcttttctgactcagtttccacataaataaagtgggattacttgcctgctcttcctcataggagctgtggtgaggatcaaaggaagcctcatttgtggaaagtgctccataaactcctgttaaaactaaagggctcacagtggctcgggagggagtctcccaagggttttacaatttgctggctatgtcccacgtgtgtgccacaaggagacgttagataccaggagccattgttggatgtttaaaacaccctggtcttaatatctcagccccagagtaaacatttgccttaccaaatccgcagctatcccacggtcactgtttacgctggaagaggccaaaggccacggcctgcgggatgaccagggctggagggggaaggctcctctgttgcagaggtatgccttgcccgttctcttctcccagctcccagaaccttgtgaaggctccagctgtaagccaggggtgctgccacaagcccaggccgccctggccttggagggttaaaagtgaagccctctggctattctctgttgtgttgggggttgcagggactctgggagggtgttgcttttgcagctgcactgagggctgtcttcagctcctcatctgtgccccctcccccatctcaggccgcccctctggcccaggccactgctctgtcccgcctctctggccagctgcaagtccacaggcctttgttccgtggctgcaaacccgccctactccatcctccctcctcagcagaagccctccagcgggggccctggcagctggaaatcacaactgccaggaggaaggggctactggagcccccagcggacctggcagatcctcatttcctcttgtcaagctcatctgggccccacaactcacctctggccagattcccacaccgtcttttctcatctctcctttcttctgctgaatggacggatcaccttttcctcccagtactcatgccccttagttctattttaaagtactctattcattcatttaatagttaaggagttagcacctactatgtatgaatgccagatgcagaagacacagcagtgaagaaaatatacaataattattgacccagtggagctgactttagcagaagtgacaataaacaagattgaaatagcaagtgtgttagtgataaacagaaataaaaaatatgatagggaaggtaggtgtgaattgtcatggaaggggtgaggtgacagtttagatagggtggccagggaggcttccaggaggaaggtacttttgaggtgatgcctgaaggcggtatttttcttcatcgctgccttttctaacttgaagcccagttcatcccactgtggcatcgaggaacagagtttggagttggacacaccttggtttcaaatccctggcttgacagctcactagccctgtggactttgatgtggtgctaaattcctttgagctgtgtttcttacccaacgtggagttagtcatcatacttaccacatgcggcatcatggcaatgtacagtgagataacgtatgttgaatgcttagcaaagactatagagaggttcgataaactatttctccaaccaaattctgcaggggtagcatgagatatttaatgtcattgctaaggactgtaggtgcaaagcttttcattttagatattgggcaggagtggggaattagagggaggggaaaatagaaaaccttggcaaaaactttctggttagggaggctttcctgccctaccctagattgcagatggctgaggacgtgggactcccaggtatgtcctatgcccacccccatcctacagataggatgacaggggcagccctgaccacccccctcttgctctggaattccccctgcttccagccagactcaatgaatcacaccttctccctgacctcccgactctgcctcacagctgggaaggctgtccacccctcccccagcctccggcaggtaaattatgcctggaggtcggaagcggagtggggcggggacaaggggtagggaaagtgagggagggggcagatggtgggtggagctgtcctaggaaagcccagaagggtggcaggaggattctggtggaggcttcgagatggctcggaagactttgaataagggttcgccagggaccagaatttaaagtaacagagtgacagacacaatgagaactcagggtcggctgcctaactcctagccgcttctacccagctgatctgctgagtctccgaccctctctgctggaaccacgggcctacaaagggaggggtttaatctaaagtaccgctgtcaaagtttgtggtgagtggcttcctggagaccctgccctagttcaggaagtgagagatgggcagtggaggatgaggcctagggaagtggtcatggccagttccacccccccgccccaccccccaagtatgtcgctgcacactcggcagccaggcaggccctgtgatgaaggaacttcctgggactgccagttggtgcctggagacgggtaaaagctagatgatctgatattagaggaagttgcaaagagggccctgaacagccccaagcatgttagtgttgggtgacctgaagtcaggagaaagaaaactggacaacgtggactaaactgatcagcagggggcccatctagagctgctggtagcccctctgtctgtcagctgcctggggataaaggttggccatgctaactgggttgctatctggggacaggaatggtgctggactcatctttgtgcccagacagcattgagaatggtacaaagtgtgatcaacagggagtgatgggcttcagccgtggtcccacccttagagtaatctgggcttgtggtctcatttgctacagcttttgttccatgggattagggagaagaaggtagtgttagggtcgagtccagccctaggtgggctgttgccatctgggaatgcaagcactagggagaagagggctttatacagttctggcggctggcctttggggagggagccctacgtaagctcaaggaatggatttttaaggacttgcactctctttcatgctgagcagacttgggctgaacacaacccaaatagggttctcgtgggcacagtggtagctgtgcatgcagccttttgtgaaacacagtttgagggtcctagaagttgatctgattattgccagaatcggagctgggactggaagggaaagatgcaggaggaatgaagtcgattttaccttgggaacagggtcccaaaaggagagatggtttctacaggtgccggaagctcttaaaaactcacatcctttacttcctaggctgtgagactgtgtgtgtgtgtgtgtgtgtgtgtgtgtgtgtgtgtagtattagaaaggaaccagtattctcatatagcttctattccttcagttcattgctacatccccagtgcctgttgtacagtaggattccaataagtatttgttgaataagtaagtaaaaccctactgtgtgacgagaccttaggaattaaggaaatgctcacactatgaatgttctgttcctgacagagaatgtccataagattctaagaagttaacctgtagtcagctgttctgacagtgggacaggaagccctgtattcctgcagcatgtaagaaggagacctacagtcattgggacctgtcttccaaagcttgctacacattttgctcccatgcaagttggccccaaagtggacagcagggtgtatttatagcgttggatatagttcttcccataatgtgttccataatatccaataacacctctcctaccctaaactcttatttggaactcagccacccagcacccttgcttatttgcatgtagccaagaaggtcgaggactcaaggtcctacatttttcttcatgccagtcttctcagaccctgtttaacttctacatataagctatgtcatgctatgttcaagctgggaagaagcagcaaatgaaagaggataaaggccgggcgcagtggctcatgcctgtaatctcaacactttgagaggctgatgccggtggatcacctgaggtcgggagtttgagaccagcttggccaacatggtgaaaccccgtctctattaaagataacaaaaattagctgggcatggtggcgggcacccgtaatcccagctactcgggaggctgaggcaggagaatcacttgaactcaggatgtggaggttgcagtgggccgagattgcgccattgcactccagcctgggcgacaagagcagaactctgtctcaaaagaaattaaaaaaataaaatgaaagaggataaagaaacaagcatagagggggaaaaatgactacagtgcagagttggcagtgagagcagactgagataaaaactccaggaaaagcaagtgctagcagaagtgccggggatctttttttttttggagggagggggtgtggagggaatgacttggcacaccttgggtgtctggggatcatcagtttgataatttatgctttgctggtaattgtgacccagagtcatcaagaaaaggttaaattatgttcccttgactctgtttaggaaggcagggaagtgtgtaacggatttttaaaagattcccagtcaggttggctaaaattttaagtgttgatacttaggtaataatatcactaatcctttaaataagaccaagtaggtggtttacccacttcacccaccccagatgaggaaaccaagtccccacgagttgggtaacttgctcaggatcgctcagctaatacttggcagggatggggtttgaacttttggagcccgctcttagccctaccccacactgttttgaaactctgcatgctcttgcaaatgctgctttttggatgccctctctctacagaggttccagctggccaaagtttgactgtgttacagtagagcctggatgagtccaatcttaattcggctccacccaagcagattgccagttatcccaaagggtgtttgcctcagttgaaacaagaatgctttttttttgtttttttttttttgagacggagtctcactctgttgcccaggctggagtgcagtggcatgatctcggctcactgcaagctccgtctcccgtgttcatgccattctcctgcctcagcctcccgagtagctgggactacaggcacccaccaccacgtctggctaatttttgtatttttagtacagacagggtttcaccttgttagccaggatggtctcgatctcctgaccttgtgatgcgcctgccttggcctcccaaagtgctggaattacaggtgtgagccattgcgcccggccaagagttctttatatattctggatacaagttcattgtcaagtatacgatttacagatattttttcccattctgtgatttgtcttttcactttcttggtagtgtgctgtgaaacacaaaagtttaaaattttgatgatgaagtacaatttattttttctttagttgctagtgcttttggtgttacacctaagaaaccattgctcactcaggttcataaagatttactcctatcttttcttctaagagtttgatagttttagctcttacatttaggtctgtgacccattttgacttttttgtatatggtttgaaataggtgtccagattcattcttttgcatgtgaagatctagcaccttttgttgaaaagactattctttctctattgaattgtcttggcacccttgttgaaaatcagttgccaataaatatgttgttttatttctgtaatctcaattctctttcattgatctatatgtctgcccttacaccggtaccatatagtcttgataactatagctttgtagtaagttttgaaatcaggttgtatcagccccccaacttggttctttttcaaggttgttttgggtattctgggtcccttgcttttccatatgaattttaggatcagcttgtcaatatctgcaaaaaaaaaatcagctatattttgatagagattgtattgcatctttagattggtttgttgagtattgccatattaacaatgttaaatgttccattccatgaacaaggaatgtcttttaggtcttctttaatttctttcaacagtgttttgtggttttcagcatacaagtcttacacttctttcgttaaatatattcctaagtattttattctttttgctgctattataaatgggagtcttaattccattttatgattgctcattgctagtgtacaggaataaaatagatttttgtgtgttgatcttgtattctggtacattgctgaacacttttattggttctaatagttttgtggtagattacttaggattttccatatacaagttcatgttatctatgaatagagattgttttatttcttccttttcaacccagatctcttctatttctttttcttgtctaattgccctggctggaactccagtatcgaatatagtggcaagactggatatccttgtcttcttactaatcttagtgaaaaagcattgtctttctccattgattatgatgtacctgtgggtttttcatggatgttctgtgtaaggttggggatattctcttctcttcctagattgttgagcgtttttatcatagaagagtgttggattttgtcaaaatttttttctgggtgtattgaagtgatcaggtgatttttacactttatcctattatcaacctgaattattttaattaatttttagatgttaacctaatcttgcatctctgggataaatcccacttggtcataatgtatggttgtggttgctagattcaatttgttagtattttgttgaggatttttgtgtctatattcataaggaatgtgggattgtaggtttcttttttctgatatcttgtctggtcctgatggcagggtaatactggcctcatagaatgagttgggaagtatttcctgctgtttttttgtggggtgagagtttgtgaagagttgatatgaattattctttaaatgtttggtagacttcaccagggaagccgtctagtcctgggcttttcttcattggaagttttaaagttactaatttaatctcttgtttagactttttctttctaaatctgtcagtggtttgtgcccttctagaaatttggctgtttcaacaaagttatccaattcattggcatatagttcatgacatttccttatcatcctttaagatattttttgtctttggtgttctgcatatatactatatacagtatgtctgaatgtgggcttatttgaagtttagcttggtgtgtgccttcaatctgaggactaaagtctatccttagttctagaaagttcatatacattatctctttgaaatttgcaccttcccccatttcctttttttttctctgtggacctctaagtctattaatgtttatatttcctatcttatttgtttgaattaaattcaggatgatttcttcagtttatctttcacttaactaattctctctttagctgtgtttaattttctatttaactattgggttttatatttcaatattgaatattttattttcatgtattgctttttctaattggcctgttccttaccccctatactaccatcttcttttattaagatttttatctcttttatatttccaatcatttaaactattcatctttaaacatcttttgtagacctattctttaatttctagttctttgagtgccagtttgttcaattttctgacttccttatgatggtttgtttccttgtgtggtttgaaatttctgtatcaggttcctcttcagtggttacagaggatgggatacttcaaagcaaggttttggaagcgtgcacttattggtgatgatgaggtctggggcatatgagacatgtgagtggatggctatggtggggtagaggaaaagactgttggaaggctcatcccccaaagcttcacatgtttggctgcttcttacaatacaggtctctctgctctagagtcacctctttaatgccttcccaggcctccttagctagtggaaattcccatctctcagagtattctgttttccctcctctatctttttcatagcacttacactttccaaaaatgtgttagttatttgtctacctttttgtggccgtcttgcttactggaatgtaagctccatgagaatgaggatgtgtcttattcactgctgtgtccctagcacgtggcacatggtttatactgtcaatacatgtgagtgaatttgagtagtcttcttttcacacaggaagtcatcccagccatgattctgaagctttcttctgggctgggtatgaccaggcagcggagaggaggtgaacagcttggccttcccttcccaaacttaatatctgtgctcccactggggatgcctttttctcccagcacagcggcccccaaaataccatccatgctgtgtgcttccaccttctggcatgtttttacacagtggccaaaatgagaagtagggatttgagtgccagaggacctggggggaaaaaagcacaaaacactggaagacctggttcttacctctaggaggttgttactgagttgaggcaatagaacactcagagaaaacagcttgggatacttgctactcactgagaccccgtgcaggttggtacccccactgcaagagtgtgtgggtggagaaggaaggcctgtgtcttggggttgtctactgctggttacgtactgtttttggaggcatctacaggtgagttatgaattcccaggtgactctatttggctcctttctgaggttgccccatactctaggaacttgtgagcaaaaagtgttacttgtaaaaaaagcaaaaagtgcatgagagcattcctatgaggtagggtgagagatggccttcttggcttcgtctctcgggccatgtgggaggttgtggagagaatggtgaaaggcacagggagtgtggattccagcaaaccctggctcctctacttccctgactgtatggccctgggtaccagagtgttgtgaggagattatatagagaatgtgttttgccttatgtctggtatactcgaataaatgctagctgaggttatttcagccaggcatttggagagccacttgtgcctcagtttcctgacctgtaaaatagggatggccacctgcctttcctctctgcccccactattgtgagggcagaagggttaattatccttcagcctcgagggcctggggtgggggaggtgctgcataaacagagcattgttgtgctggtgaatgatctggctttgttctgaagtcttcagtatttgattcctgcagttagtatcccctgtgcttaattgctggaggtttgtgcaggtcctcagccctgtggcgctcacctcccagggctgtggcctgggtccctacccagcggggacctgcagaattgtgtcgggaagttgcatttcctgggctagggccccccagcaatcaggaatgagagaaatgcagaaagtatgacccacacgcagaactggttctgaatagaacatttattgacgaagttttgcaggaggcggcgggcgctttaattcccgaggctgttggtggcagctcgctgctcaccccaagcctgttaactgctaggttgccggtgctggggacaatgcggctgcccggcccctcgccaccctcgtggtgcccggatgggagctctcctgaggaaagcggtaggtacccggctggggccaggccaggggatgggaatggggtgggatggggactctttcaactccgggcctctaagccttgccggacttcccccaggaaacccagccaatcacaggctttagggtaaaaggcaggtttttcccttgtgggttagacactgaggaccataaagggagcaggcataggtgagctgctcttcttagtggactgtcatgtgtctgggtgacacagcaagacagcccttttggaggcaactgtaaatggttctgccggggacttcagggggacttcatgtcgtgaacatttggagttgagtggttagagaaggtcatgtagggccctacacacacacacacacacacacacacacacaacacacacacacacaacacacacacacacaacacacacacacacacacacacacacacacacacacacacacacacacacacacaaagcagagttaatctcccacttcttcctgatgtttccttttcccagaatccacagagggtggttgttttggatcaaaccaagcgtcagctggtagagcagttgaaaggaggttattcccctgccctgtctcctccctggtgggcagcggaccccgaccctggcacccaccacttcatagttcagagcagcaggagtgtggaggtcggggcagatcgactgcaaatcaaggcctcacttttcaaggagtagacgctgcttcctcggccgtgtctctacacgtgtgcaccccagaattgggattgggtaatactgccccaccggtctgaattctggtccatgtacgctcccagctgaggcaggaagtgcccctcctctacccaggaactggttggatgagtttcttaggcgtctctggtgaggccccttagtaggggaagcggggaacatgggggatgggggaaggagctatgggtagagaggggccccctgggccctgtaggataggggaagtgtgtgtggccctgctggctgaagggctggccgcctttgggaatttacacgtgtgtgtgtgtgtgtgtgtgtgtgtgtgtgtgtgtgagtccataaggtctgctttggaaaatccactttcctaacttctctgggtcaggcaccaagcccaaggtcagagcccagggcaaagaaaggggatgtgttggagctcttctcttgctgtatcaccttcgaagaagaggcgaggcctgagggagggggaaggccagggttgtctacataactttctgggtttggatgctcatgcttggaattgggaagggagttgtgttttagggaattgccctggcagccttgcctccaagccaccattctgatgggcttgggaagggaaagtgagaactgggggaaggaaaaaacccttgggtagtaagatgcacacaaactcctcccccagcccagttgagagctgctggcctgaaattcctctgagagatttcttccatttaagaactggcatctcagttttctagggtaggtgttctcttcctgctcctagaggcagttaatttaaatgtagtttcatctcttgacgttcatattgggtctcatttcttccccctttgcaagggttggaatgggtctcattctttctagctaatgttccctcgatctctcgctcctcctcgaagctgtctctgaatagccagcaccttcctgggcttctgcattcttcttgaacactccctggctctagggacacctgcagccacagcccatatcatggtttggacctttttagggcacattctgacacctcgtctcatggagccccatttccacgtgtcttggtagttgttcttccagacctggcttggatctgtcctttcccacaaagccacgtggattccttccatctgtccttggcctgccttgcagcctggcctcttgttgccagttgcccggggcgtgggggtggtctgggtcctctcgggactcagctgctctcttggcagcaaatgcactcagatctcttcacctggcaaagcttactcgtcatttatgactcagctaagatgtcaccttctcctagaaagcttcctggtcccctaagtagcactagctactccttctgttagcacagtttatttattcatgcttttgtactaggactcaaggcattgttttgtgaatactctgtttatatggccatttttccttctgaagttcaagttcttcaaagacagggacaatgtctttttcatgtcatatccccaggccctggcattcatgttcaggagtgttgaatgaattcccaaactggaggcagtcttgaactcccatactgctcatgcctggattctctccctccttttcttacagatgccttgtcttgttttgccttatagcatataagctctgaagagtggagtctgtgtgtgacttgtcctaactgcagggctgccatgatgtctttgtgcacagtaggtgcttggtaaacagcttaggttggaagattactagggttatcttcaaatcagagagagattgaggcacaaagagcccgctgacttgctcctgatcatacagtggctaggcagagccagggtagtttggaggagtgctggctgtagtccctgggctctttcatacacattcttctgcttttcctttttttgatattcctcgtgacttaggaatgggtccgcactagagcctttcccagtaccttgctgttttgtcttatgccctggccctcccagatgtctaccctgcagatgggtttaaaacccacggaccagtgtcaaggatggtttttgttaatcacttgtgcttttgctctctcaagttgccttaacttctgctcttgctcaggcctgcggtgccccctggccctgtttctctccagctcccagtagtacatgccgtctctccgtgtggatcccagaggaatgcgcctctgggatctgctatagctgcgggattcggactcacttaatacttcatttcttggcttgacctcctgttgggtatgggtgtcagactacttttcctttccagctgaactgctgtgtgtctgcccttagaagatcatggtctatatggatgttgagatcatagaagatggataaacacacgggtggtgggggaaggttaggtcatgctggttcaccaagtttaacttgtatcattattattaatttgagatgtgggtcaaacatggtaggtacaaggcagaaaaatctcattgtcttgatgcttgcagaacaaataagtgatttatccgttatcatcatcaccaccaccaccattctcggtgggcttactgtgtgtcagatgtacgggttacttacttgtgtcatctcaaccttggagacaacccagtcaggttggcagtattactgtgcctattttcctcatgaggaacttgatgcttggtgaggtgaagtgacttgcccaaggccacatacagccaggaaaagtggagggcctggaagtcaaatggggtctgcctgactccacagcctgtggatgagtttactgcatttgacctctgtgggctctactgcatctgtgcatattctcttttctgccgaggaagcagagggacccagtgggggcccctccacacccacttggttcccaccgagattctccagtgcctttgaacctgaggcagtagtaaaatgcagcttcctcctacccacccaccccgctccagcctagaggcctcaaaacaagcagcccctgaaatggggatgaggccggaaagatggcgaatttgcagggctgggttcttgaactttgctggtaagtagcagcggtcctgtgaacctttttgacctcaagatgagagaggtggggcctctgggaactttggatctgtctgtgatttccagggggtaatttctagtaacaccttttagggctttctttggctcttccggttttggggcacattgcatagtgacaagttgtgctggcagccaagttacctctacactggctgtgaacaagagcaatttataataaacaatacttgcccccatttggctttagcatatgtttacatgaaacttcctggcagattgcttttcctgggacatttgcagggagaccagatcatcacagccccttttctaaacttggctactttccccttcctcccagtctcttgtggctggtcacctagtatgtagcccagcggggcagctatgccgtgctctagctccctgtctggggccaagtaggatgggactaccggggtgaatgagcagtcatcaatcctggcgcttcttggttgatcggaaacttgctggcagtgactaatgtggagactcattaggctaggaggaactggctttggtcttgacctcacccactgtttacctttctcttgactgtgtgagtggtgagctcatcccggcgccatctcagagtccttccagcaggcatttattgaacacctaatgtgccttgctctctggggctgaagggaaggtatgggaaagaaggcccagcccactgggttttactgtattgtccagaagagatgcatgtacatatcaagccccaagaccaatgctttaagtgatagggtgtttcgagttcagaggagtatattacttccctattgccactgtaacaaattctgcaatcttagtggcttaaatcaacacacatttgttgtcttaaagttctggaggtaagaagtcagactgggtttgcatggctgggttccttctgcaggatccagggcagaatttgtttccttgctcttcctagcttcccaggctgcctgtatccttggcttgtggccccttcctccatcttcaaagccagcagtgtagcatcttccagttcccttctctctgtccctctgcttttattgtcaaacttctgtctgactctgactcctgccggattcctcttacgaggagccttatgatcacatcaggcccaccgggctaatccaggataatcttccatcttaaaatccttgatttgatcacatctgccttctatgtgtcccttttgccatataaggtgacattcataggttgagggtcaggctgtagatatccttgggtgggggcattattcagcttacactagtgtgtatgttgggaaatggttgaggaggcctttctctgaaggagatgattgctaaatgtgtataggcagagggtctggggacacattccaggtttgggagacaacatgggcacatgttgggtaggtggggacaggggggtgtagatgaacagccctccctctgagctaggtgcctggctttcctttccttccaaggtcaggccgagggaactttctggacttcagttgcaggcccaggctttctcctggagtccatgtgggagggctcccctggcaacacaatccttttccttcctggcagctgtggtcctgctgcaagggacccagccagactacatgggccctgctgctcttaggtggtgggaaaatgcattcctgagggaaaatgaatttgaaccagctgggctgggtttgggtggcccagaaaccttggtcacactgttggcacagcctctgcaggcagtcacgttgctcacatgcacacaaagtcactccccggggagccttctctcgcgctttattacggtgctcagggctgctgaatctccaggagggatgggaggggtcagagtgaggaaactgctgggaaagggggcaagggtcccctaggagggggtcctcccctcccccaggagagcccctagggtgcagggagcagtgggaacacacaggcaagagctgggcctctggggacagtttgggagccgggtggcccagagtggtgccgagctgtgggtaagagcacagccgagggatttcaccatcttagttgagatcttagttgagagagatctctctctggaagttcacattgctcccacactgttttttctggaaaagttatagcttttctctattgcttccttctggcaccctttttgaagggattccgaaagtgccgtcttggggattgtttgggggaaggacaaaagccgctgggccaccctggctttgagagcccttggaatgtttagcagatgatgtagttgagggatgaaggccacacaggagggctgcgccatcgccgttcctgagtgaggactttctttcttcctttctttttttgtttttgagatggagtttcgctctcattgcctaggctggagtgcagtggtgcgatctcagctcactgcaacctcctgggttcaagcaattctcctgcctcagcctcgcgagtagctgggattacaggtgcatgccaccacacccggctaatttttgtatttttagtagagatggggtttcctcatattggtcaggctggtctcaaactcctctcaaactcctgaccaaaggtgatccgcccacctcggcctcccaaagtgctgggattacaggcgtgagccactgcgcctggccacgaggactttccctgtgtgcaggtgccgtgtggattcctccccagctggggcctttggagcagctgccccatggggaccctccttgctcgttttctgcctggctccaaagcagctgtggtgcggtgtggcttctcattcttgagtgtggggtgaagggcagtggatgaaatgacgacatcagcctctgaaccagaatgttttctggggagtctggtgtgcccaccagagggttcacccccaagtgtcctcttcccctctcctgccttgtcctcaactcactggcctgggagggagagccagtgggagtgggctgactcctgggcattccccaagaccagagacacagagttccagaaggctccccgtaatcctgtgggataggggaggagcagggtcccattgcctcagtgacaggagacctgaggacagaacactgaggctgttgtgggttatgagggtgtgccttttttctttcctgttgggtcagaatggggcatggtgctgaggcgtagtggggaggggaaggatgtggccccagtctgctgtgctcggaatccaggggcctgctgtagcctgcctgcctctgcacctgcaatattcagggaagctcctccagagggtaggtgtgggtggaggaagggtgtggtgtggtttaggcttaaatttaaagaaaaagaaaagaaacctccctctctccccctcttctgcccctggatccttaaaggtgtatgtctgagctgctgcttaggcccatcaaaaagaaagcctggctgggtgtggtggctcacacctgttaatcccagcactttaggaggctgaggcaggaggatcgcttgaggtcgaggctgcaatgagctgtgattgcaccactgcactccagcctgggtgacagagggagaccctgcctcaaaaaaagagaaaagtctttggggacctgctcaaagaaggtttcacaagtataggacttgagaaagagttttcttttttctttttttttgagatggagtctcatgctgtcacccaggctggagtacagtggcgcgatctcagctcactgaaacatctgccttccaggttcaagcgattcttctgcctcagccccccgagtagctgggattacaggcacctgccactatgcccagctaatttttgtatttttagtagagatggggtttcaccatgttggcctggccagtctcaaactcctgacctcaagtgatctgcccccctctgcctcccacagtgctgggattacaggcgtgagccatcatgcctggccgagaaagcgagttttctagaagactgattcactgattgatgactgactggattgattcatgttgcaagatggaagaggtcatggctggggcatacttaagagaactggagacccgtatgtggtaggatggggtaggcgtgggtacctggtttgagggtttggttgctgcctgcctcatcacctccttctctggcctcctacttccctagcagacagggtcttccgagatgtgtttgaagacctgagttctcatcctggcttgggggaatcttatagtatggagtggtgctcttcaggtaggaaggaaaggctgaccccgcccggggagcaccaggggaggcactttaactgtctctgtgggagtctgagctacacacacataatggttccaatccggtgtcttagggccagaatgcactccagctgagtgcagtgcactcagaatgcactctgagagcgatgcctcttatccgtcaccatcaaacggtgcctcctgacagtctgcactagtgtcctgctttgtactcagtgcctcatttgttcttcagccctccctttcttgggctcttggctcttttccagcaagtcctcctgcccaagagagagagagccttgtgatcgtgggtctcctggtcactacagggcttctctcgtcatccaagaagtttatagtccaatcctggtgacctcatactttctccctcttcctttctgcttacccatgacctgtgatcctttgaccgggaatctgtattttaccatattgttccagccagagaatgaatggccaaaggtcacatagtagcaggcccaaaaactgccctaaggaatcttgactcagtccttccgagtgtcatgtcataagccccaatccttcaggtcttcatatgtcccctgcagcttatgctgaagcaaagccatggcagccagggctgtgaccaatcctttgcttgtggccctgtctggtgtgtagtccattagggaggcagtgggcaggagagcatgaactctggagcctcagtgcctgagttcaagtccaggctctaccacttactacttctgtggcctcagtacctgcatgtataaaatgagggtagtaatagaacctaccttctggagttgttgcaaggggttaggcactttaatatatacagagcgctcagagcatttcagcagttggctgttatgctttgttttagccttaggagataggagcttagtttgcagacaggtagcctatgatcaatcagagagaaaacttctgtaagtagaaaagacatattagtttctgggtttgaagtgtgcttatgttgctatcctcttacagtgggatccccagagagggaccctcaaaaggtcccttttagagacaaatctccctaatggtgtgtgtgttggggtaggggtggggctgtgagtaatcttttgctttaagactgtgaactggctggctgtgaaatccatttgggagtggggccgtttccatttagcttccccagagaagctgactgaccccagatgtgatctgggaaaggtcttaggctgtaaatccctgcccctttgttccctgctgggatggtggtggtgggtgggtggggtgcctaactgcagtgcactttgaaggacatcagagtgccacagggctgggggttaagggctggggtggagcttgggtttttatctgtcagtgctggaatgacatggtgttgccctgcctgctggttctgtaaaaggcatagctgattaattgtaaaggcccttttgaggagggaggaaaaagcaacagccctacaattcccagggggctctcttctgagcagctcaaagagctttaccaaaatgatcctgctaattagccctctgggcattgcactgggctgcggaggggagcactgggctgccactgagtccccatctgcaagttgagaggctcatacagagctccttggaggtgaccccctccagtgagacacagtgacaaagtgctgtgctccagagcatcccggccaggttagcggcaggtggtaagtaggtcttgaggcgcttgatctgtacctcagtaaaagcatcagtttgttcaccattgttgttcatttgttaaattggcccttaagacccctgctttttagtaactaatggtgtagggcagagggtctcaaactagtcacactgtctcaggccagtgctacagtaggagaaacctgggaggtagtaagagaacacagaaagagttccccaggtttgggggatattggaaggttcctggagggggcgatgtctaattggagacctaaagattggatgtaaattacataggttgggggatggtactgtatggggtggatggggacgagataacgccaaggcagagagaacatttgcaaaagccggagacccaggggtgttggtttccaggttgaggcataggcacagaaaaccaggggtcagtgtcaagggttcccagagtaatggcagcttctagattcttctccttgtagctcaagtctctgccctttagtcatgtctggggtctagtcacttctgagccctagagctaggggtagaagactcgggtcagtaggggtgagagggatgcccaggaacttactgttttcctgtgaaatagcaatgaaatgtgtactctgcaaagtggcattggtgagctctaaggggtgggcatgggtgttgcatgggtgtccctgtccttcccaaaggctgcagcctgaagtagtctggccactccacccttccatcccccggctgctccaggtgggcctgcctgtgagccacaccatctgctttgggaataaagtccacctgaggctctgtttgcctcacctgggtgcagtttactgctttctctgctgcccccgcccagctgtgccaaggggagcttacagagactcactgatggcttagccctggggaatttcctggggcctgggatgagtcagaggcagcctgtaccaggtgctggggtggggctgcggagtcgggggataatgctggctcagccagtcagtatccagaaagtttcaggtttgtggtgaagccgccggtgcccctgaggttttgcagtcttagggagaatattacccctgttatgtgtcttgtcttaacattgtaagaaccagatctttgcccatccctgtacagtgaccccagcacaggccacagacaggggggcacttgggaagttcttcttcacaactgccattattatcaccatattgatggtgtatggagcacgtaccctatgccaggcatcatgctcagagctttacgaacagcaggtggcttcatctgggaggacacagccatggggtaggctgtatccatcctcattttacaggtgaggagctgaggctctgagggactaagtactgtgccccagcagtggggctgggctgtgaattccttagagggtacctggaccactgtgctggcaggtggacttgggcaccctcatcagtgctcatagagtctgagaacagggcccttcttgggattcagttttgttttgttaattgtgttaaatgtaaatacacataacataaaatttaccatcttcaccattttaagtgtacagttcagtgacagtaggtacattcatatcattgtgcaatgtcatcactgtctatccacagaaccttttcatcttctaaaactgaactctggatgcactaaataataccttcccaccccacctgcccccacccctggcaaccgtccctctgttctgtttctgtgggcattcagaggttgacccttcatctgtctgtcttgttgcagaatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggaggtgcgtgtcggaggccttgcggcacagtattctagcagaagcctgtttcaccctgggagggaagctctcaaaagacctgcttcccataaagtagttggagaactggggtctcccaccctcgctgactgcactgtgaaagctgttgacccctgaggcttccctaggaccttgggccagatcagtagcttgggccgacaggagtgagcatcgttgatagggtggatccccagcctgcctgggaagatggctctagagagcctgtgccacagagactgaatggagtgaagacatgggctctgggcctggccccatgcatcccctgccctgttgtttcctggctgtgcggagcctcaggttcctcctctgtaagaggaagcgacacctaccttgtaggtgaagggcacggaagggcagctgtgtggctgccactgaggaagccctctgccccactggctcagggcgtggattagtttcctagggctgccttaacaaatgaccacacactgggtggcttaaaacagcaaatgtgttctcactcagttcaggaggccagaagtccaaaaatcaatgtgttggctgggttggctcccttcagagcctctgagggagtaggcattctatgcctgtcatccagcttctggggtcctggcagtctttgacattgttggcctggagatgcggcccagcaccttcccatcacctttttctttgtgtctctctgtgtcctccttctcctcttataaggacagcagccactggatttggggcccaccctaaatcctatctgaagtcatcttgagatccttaactaatggcatccacaaagaccttatttccaaataaagtcacattctggggttccaagtggacatgaattttggggtggacactgtctcacagtaggcaatgtccgtgaagtggtgttacagcagggccgaaacgaggtgtggctagggaaggtagtgggcagggttgtgccgggggctaggttctgaccacctccctccacgcaggactacctcttgaagatcattgacacacccgggctgctgaagccagaacaggtcagcgccctctttgggaacatagaaaatatctacgcgctgaacaggtgtgtgaatgggcctgacactcaccatgttctgcctgcgaggcccacctcagggcctagggaggaaccctggatgtccctggtctcatgggcctgtgacatgtgggcctggggcctgatctctgaggacagggaagggttgtccatctctgtgccctgggctgatctgctttctctcaagggcagacggggaggtaatttgaggttgtgtgcatgttgggtccatcctgagccggtgccccctcaaggggctgctgggccctaccttgcacactggttctcttccctgtggaagagaaccttccctgtccttctcatcttcattttccatttgcacatctgttaatttcttatcctcctttccactgaccccaagggctccctggagatgatctgacctattagtggattgcacaacccaggcaagacacatgtgggaagccaaacaaggcctgaccaggggctgtgtcagggcaaaaggcatgggtctcctgcctgggaccacagactcccccgggaaagtgcactgctctggaggggcagggcttgagggaacagcggtgctaggacaggaagaatcgtatcccaggccccttaagatgggcagagggagctctggctgtgtaagctggagaagtctgggagggcagggtgcagggaggacttaggccaatggtgaggggttgggaaaagaggaggagcacagagggaggaggcagggagcagtgtttctaggggtgccaggactcacctgtctctccccatgtcccacatcctgggcgccctggctcctttgctagtccccattctctctccttcaccctttaatcctctgcttttgtgtgtttgactccttctgcctgcagaggagctgtgtcccctcccgaggtgggtatgggggtcccctcttcatctccctcttgttgagcctgtaggtctccctgacttcctgctttgtggctgctttgtgttggatactttctgtggttgctgcctggggcaggactccctctgaggctagaagccccagttctttagcaaagcaatagggctggctgtcagtcagggtttgggaggttggggagggggcagtgaggggcattgtcctctgactgcagagggtacagtggctgctctcccctcacccagccagctcctcagagacctggacagctgcaatagtgaccccgtggctgtggccagctgctttgtggaaagggtaagaagggctgggtccttgcctctgtcctaccttgctgagagctcagagagacaagaactgccagcataagaggacatctgagtcctggggattcctttccagggaaagtcctgggtgctctatcttgaatgagaagggtgttctgaggggagccagggctgctgggtggatgggatgtccttgacaaataggtataaagatggctctgtaggcatttgggaacaggggacagagggtgctctgggggccaggggcctatctgctaccaccatctttactgtcaaatgagaatctccctgaaatcactatttttgatctcttcttagagccaagagtttgatatctacactcagtattgcaacaattaccccaagtgagtaattggggtgagagggaaggcagagccatttggtgagtccagagccccccacttcctcatccaggccttccccaggtggtgactggcccttctcccactcccagctccgtggccgccctgacggaatgcatgcgggacaagcagcaggccaagttctttcgggaccggcaggagctgctacagcactcgctgcccttgggctcctacctgctgaagccagtccagcgcatcctcaagtaccacctgctgctccaggtagcccctcggtcctcccaagcacctagggcctggggagggcagggccttcgggtcaggggcacctaagcgtctatcttctgcgcaggaaattgccaagcattttgatgaagaagaggatggctttgaggtggtggaggatgccattgacaccatgacctgtgtggcctggtacatcaacgacatgaagaggaggcatgagcacgcggtccggctccaggtgctctggggctgggacgctgggggaggggcagggctgggtgggccaggcttccgctgggaagagggactgtggccaccctgctgggatgagctgggcagtggcattgggggagcctttgtggcagggtttgcagagcctcctaaggccccagtggcctgactctagggattggggcccctctgctgcaggagattcagtcactcctcatcaactggaaggggcccgacctgaccacctacggggagcttgtcctggagggcacattccgcgtgcatcgcgtgcgcaatgaaaggacctttttcctctttgacaaaacactgcttatcaccaagaagcggggcgatcactttgtctacaagggcaacatcccggtaaccaggccctgccccatctcctctgccatcttctctccttcccaaaggatctgggctccccttcttgtctgcttcttggggctccagcaccacccttctgagatcaccctccctgcttccccaggctgtcaaccttgtgcttgactgtcctttccctctgcccctagtgctcctccctgatgctgatcgaaagcaccagagactccctgtgcttcactgtcacccactacaagcacagcaagcagcagtacagcatccaggtgaggggaaggtggggctcaggggctagggaacaagatgcccaggggacacctgcgtgggactcctggctcctctgctcacctagctgccccaagccccagtgtctccatctgtgaggcaaggatcattgcaggcacctctcagggtcaaagtgaggagtcaggttaacctcacagaggccccagcatggccccactttttctccctgggtggaagcactgtccatgctagacagcttcaggcctgtaatgataaccactgggtccctttcccttgggtcctcccaggccaagacagtggaggagaaacggaactggactcaccacatcaagaggctcatcctagagaaccaccatgccaccattccccagaaggtgagttcccccagctcctgactgtgtgcaaggagaatgtgctcctctgagccagctctgcaaggtccattgggggctcaccttctggatttgggctccagtggacagtgagtgtcagtacagcagatgccccgggccttggtgcagcactgtggggtgtcctcgtacagcaacagtgggtcctatgggcagggaaggccggcacatggtaaggtaataaccaggtgtgtttccttccccttcaggccaaggaagccatcttggaaatggattcctattgtaagtgtacccttttctgcctgttttgtccctaatcgtgcacattgctaggtcaggctgcatcctggggaagctttacctgataattttattccaggagcagggagggcgggggtctcctgttaagggctggggggtgaactacatgattaaggatgctctcctgctgagcggtgggactctcagtgcctgaagctcccagctggaagatggagggagctctggaggctcctggccctggagctgggtgggtatagaggtctggctggttatggacagggtctagggtaggccaaggccaattgggaatcaaaagcttgatcgtctctctcctgggtgcagatcccaatcggtaccgctgcagcccagagcggctgaagaaggcttggtcctcccaggatgaggtgtccaccaatgtgcgccaggggcgccggcaatctggtaagagaagggctgtggaggcaggaggcctctccctcacacccttgcccagactggggaccgtctgcggcagtgtccagggctgtggctctcacctctgcggaaaccctgggaaaggctagagcggggctggacacacacctggggctcatcctctccctgtgctggtgctccccacaccaggtacccctgggccctcgttgcctaccaggtctggagcccacctttttcttacttttttcttttcttttcttttctttttcttttttttttttttttgagagatggagtcttgctctgttgcccaggctggagtgcagtggctcgatctcggctcactgcaacctctgcctcctgggttcaagcgattctcctgcctcagcttgccaagtagctgggactacaagcgtgcaccaccacacccaactaatttttgtattttttagtagagatgggatttcactatatgttggccaggctagtttcgaactcctggcctcaggtgatccgcccgtctcggactcccaaagtactgggattataggtgtgagccactgtacccgtccagcccacctttttcaaggccctaggaatacttgctcgctccggccttggcaccccttcttagccccctccctcctttgcctctctggaataccaacaccaagtcattcaggagtgacacttggacatggcggatgggcccagcccagtcctggaacaaccgagcagaagcaggacccggggaaaacgagttcagtggcaccaaacccagacaggaaatatttattttgggtctcaggaaaaggttccattttcctcccttgagttttcttccattcctggacttgctagggtgttcttggattattggaatgaatcgtctatttgaaaagagaaaaccttgcttttattctaaactccgtggtgatgggtgtgtgtgttttcaaaattggttttttcgttgctatttagtgcaaggcccaaggacaggtctggcttaagccaggtgtctgccaaacatatacccaaggtgggagttggggtgagaattgtctttaagaccctgggagagaaggattctaaagtgactgagagtggtgtcctggcttgggtcccacagatgtgttgggttttgattggtgatgacctgtgggtcccctgaatgtgtgtgtggattgacatgtgggtgttagccttcgagaaggtggagcagtggcttatagaaggcttttgtggttttatgttgttggtattgctctgggtggatcttgagccctaggccaccttgctatggttgcaaaagttttatggtttttatagttaaaagctccaaataggggtgttgctttcttctctctagccctctttcttttctcttctcttctcttttcttttcttctcctgtaattctcttcttgtcctcctcaacttgccataccttaaaatttgaagcttctagcacactgatgtgttcagcaagtgataacgttggtggtagtgatagtagctctatcctagtgttagcatcgaaactttagctatggatgtacaactctttgaatatacttaaagccgttgaattgtacactctaaataggtgaattgtatttgaattatatttcaataaagctgttacaaaaagcccccaaactttaggtgtccaaggcactcaggaaatgagccattttaaagagctgaagtttccacatggctgagatttttagcctgtaaatactaagagttggattttttcaaaaaatatttaaaaaatgttttaacagttatgaaattccctccctccctccctcccttccttccttccttctttccttccttccttccttccttgtctgtcacccaggctggagtgcagtggcaccatctctactcactgcaacctctgcctcccgggttcaagtgattctcctgcctcagccgcccgagtagctgggattacaggcacgcgtcaccacgcccagctagttttttttttgtatttttagtagaaacagggtttcaccatgttggtcaggctggtctcgaactcctgacctcaggtgatccacccgcctcggcctcacagagtgctgggattacaggcatgagccatcccgcctagctgaaatagacatctttctaaagcatgttttgtactcttgagccttttaaaacagaaggtgctggccaccgttgaacctttccttttctggagttaatgctacagcatcacttagggtgtgtgaactgccagatgcttgaggggccccagaggctgtgggttgccatagagacagcctgtgtttggtgtgtcgtgcccctcttcacggttcttctgtaacactgaagtatttgttttcattggtctaagtatgcttgtctgtagtagcccttcttcccctcctgtctgttagaaagcgatcgttcaggccaggtgtggtggctcactcctgtaatcctagcaccttgggaggctgaggtgggaggatcacttgagtccaggagttcaagaccagcctggacaacacagtgaggcctcatctctacaaaattaaaaagttagctaggcatggtggtgtgcacctatagtcctagctactctggaggctgaggtgggaggatcacttgagcctggaaggcagaggttgcagtgaatggatatcgtgcccctgcacccacccagcctggctgacagatgagaccttgttgcaaaaaaacaaaacaaaacaaaacaaaaaaagaaatcaatctgttgaacttgtgggaactgtagaccacaaaaagatcaggaaagtcactagggagggacttgggccacatgcaggcactttactgcctgggctcagccatctactctgacttccttgaggttttttctgcttctgcttcccactcagagagctgagatgagctgacaagtgtattctattgataattaagttctattgtttaatttaaattatgtctcacttattaaatattcttgataagttttaaaatgaaagaatagaacattttctacttttcactttaaaaacaattaggcatttacttacattgatacagatagtgtatgtatgttgtgtgtgtcagcagaaaagaggttcttcaacaggcctgcctgctgaggaacagcaagataccttggtagactttccttctgactccaggtgtgtagcaaatcatggcgatccctgggcctcccacttaccgccagctgggcaaggatatggataggcgaaggccgaggctctgtagaactggaccttgagacaaggtcctcttattcctgccctccagtctcaggtgtatcctcaaaaaggctggggtacacggtgatgacaccattggcctaatggatgtgttttgtatcctgtccccagagcctggtcactctccgtacagccgggcaactctccccagcggtcagcgaggcttcgtgatgcccagccttaagggccgtagaaagtcgggtgcgacctctgctttccagctgggatgctgtgaggggcttggcagtgggtgtagctgatgcgctgatatgctcattgccagggaggcaaggggcttgaggtggagccagggacctccggagatgttgctagttggtctgaagggggtagcatggaactgagtcccctccctatggctcctgcgcgagggccctgggccaggtgccctaatgcattgcatcatgggtggtactgctccggcagggctggtagtcacagcgggggtcctggagatggatgggcccgcctccctgtccgtaggtgcaagggggctcgccgacactgtggaaggcagcttccctggggcctatgactgcagggggccaagccagagtggactttgagctggtgatgggctggtggcgctgtgagcttgggacccagccaggcacagcagtttcctggcccgcgctgactctgctcatgctttcctcctcagagccaaccaaacacctgctcaggcaactcaacgagaaaggtgagtgtgtgaggtggccagccattcccagtgagcgggggaggaggagggaggaggggaagcagccgacaacctggggtgtgacctgagggtggaggattgtcagaatagtgtagagggaactctgcctccattccccccagaagagggcctcgcccctggctggctgaggagaggggctggagctctcccccatgcacaggcctcatgccctttcctccggaaacaatgagagccgagcaacaggcacagacctgcgctgctctgtggcccctgggcccctgctctgtcagtcattcttttgaaagcccaggagactaggtgagggttctgggagcaggagcccccagtgaggacttccccagggagctgtccagaggtctttttcctgcttactgatctcttcccctcccctcccctgcccctcgcccgtgtgctgggggacccggtggtgatgtctgcagcccgagcagcaggaatgaaggtaaaggccagtgggaggaggggactggctgacagaggagggtgggactgcccaggtcagcccccggccccttcagccctcattgtcttcattcattcaacaaatgcctactaagcacccactgtgtaccaggctgtgtggcttagggccacagagatgaataagacatgggccttgccctgggggcccttctgcaccctctgcctagaacagcaccctgctgggggcctgcccagtgtggacctactcagatttccctctccctagggtagacaagtaggcaggcctgtttgggttctgaagttttgaccaggtcccagcctttccaccatgagaatgcccacccctccctggaccccagtggcaacctgagttgggcatctaggtgtggctttctgtgtgaaggctccccccccgcagctgcctgcaggaggacgggaggttgcccaagaggctggtcacgagggggtcttgtgctctgaacagcatgcaggcagtgctggaaccctcctggactttgggcagccctcccgtactcggggcctgcagccagaggctgaaggggctacccaggaggaggaagaggaagaggaggaggtggtggaggaggaggaggaggaggaggaggaagagcaggcctttcaggtctctctggaggacctgacagggcatgaaggcaacgagaagggggctgggccggagcccccaggctcagaggaggaggaggaggagcaggaggagagcctggcggtggcggagcaggtagccgactttgccagctccctgctggccgccctccactgctggcactatcgggccaacgctttacttttctcccggggcgctatggtgaggtgtctcttcgatctcccctcctccttgcatgctccctgggatgtgcatgcccacccgagggccccctctgctgccctcctcaccccaccctgccctggttttactcctcccctcagcacttaacaccatcgctcgctgtcacaccctggtgagcccctggcatgctctgttccagtactgggcactaatcaatataacgcccaacaagcatgacaagtggggtggggtggtgggggcagggagaagctagcacacagtggggctggaaaggtcaagtccactttggagggacagaaaggtgggctgaggttttttgaagctgcatgcctgacaaggctttccgcagccccaggcctggcagttcaggttggctctggaatggctcaggtccaagactggctctcagctcagcccagccccttggggcgtgggaggcactgcccgtgttgggatgcagaagggatcagcttccagttgtcttggagttgatgactgacctctacctctgcagggaaaggggcgcagggagtctgaaagctccaggagcagcagaaggcccagtggccggtctccaaccagtactgagaagcgcatgagcttcgagtccatttcttccctgccagaggtgagcgaccagcaggtgggatggggatagtaggaagaacttggagtccagattttcaagtctgcaaatagggctttcaggcacaggctctcccactgggcccatgggaacagagattccccacctcccaggactctcagccctgcatgaagcctgtttggcctagagtatatggtttggtgagcagaccacccctttctatgaagtagagaaaggctcccctttgggcagatgcagtcccatgtcaagggcacgcagctagtggaaatgaaccaggtattaggctcctttcgttaggccaccttgtatgggttataaggccctgtccctgccagcatgccagacattgaaatcacacctgtggtcacctgggcaaagggtagagaactgatatctgttggacacctcctctgtaactgatgtgttatttcttcctactcttccccacaatggctctagaaggaaaagggcactgagtggttgatggcgtgcctaacactgagcagcttctgaggcgcggggctgagatcagacctggggctgggactcagaggcccactctcctcctcctgctgccctatgctgtctgtgggttgtaggaagcagcatcctttactttcccaaagttataagggaaagatcgtgagctacagcctggaccccatgttggaccccacagccaggactgagaagcctggatgatactggacaggaatgtagcatgatgtcttagcttgagctgctgtaacaaaatcccttactgctacgtgggtagcttagttattgctcacagttttggaggctggaaattctaaggtcaagatgccagcagaccctggggagggcttgccctctgcttcgtagatggtggcttcttgctgtgtcctcacatggcaaaggggcaaggaagctcccttgatcctcatttgtaagggatctgaccccactcatgaggatggagcccttgtgacctaatttcccaaaggccccccctctcattcccatcacactgggtgttagcctccacatggcaattttagagatacacagacattcagagcagagcaaattggggtgtcaaataataatacaatgagaaccacccattacaaagtttaaaagaagcagatgaaattaattttagtagtatattttatttaacccaatgtatacagagtattattctaacatgtaatcaacataaaaagttactgatatgttttatccctttttttatacagagtctttgcaatctggtgtgtattttatcccaagagcaggtttccatctggcctaaccccatttcgggtgctcagaaagccacagtggctggtggctcccatgttgaacagtgcaagtctagatcatgggtcttgctctgcagattctgaactagaacagaaggaattatgtccgatcttataattagtgtttgctcttatctccttaaagactgctctggaaagccgcgtatgtcatcagttctgtggttcaaattactttcaaggtggtcaagagggaattctcaagtttgctttcttccttgcccatttcctgggcatatgcagttgtgctgggcccacaggtactgggaggagccacattcctggtcctcatcctctgacgagattccagcatgtggctgtgttgctctctagaccctaatccacatgggaggccctgtcccctgaggaaaatgaaatggcctctcatgttgtgcaggtctgggtttgaaccctagaacctccaagtgaggagcctctagggctttggggagctgcctcaccatcagccatgctggttccatgacactgtgagaaccagcccctgggaacctggggccatgcccaacccactgttgtgtgttcccaccttgtccctgtagctcctaggctggctgccatcaaggtgttgccatcctgacccatctgcattcttactgttttccttggttttgaggacatgggcccagcacccccactgtacggtgactaaaggacacagtcatgttcctctaaggacccatcacctactcctaagtcgtgctcattctgattgccttgagtcctaaactacaggtccctgtcattgggccttgagcaggccatgctgtccccttgttccccggatcccatgaaggaggctttttactcatgtgagccttttctgctatgtttcaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctattatgaaaatgcagaacaccatgatgcaggcttcagcgtccgtcgccgggagagcctctcctacatccccaaaggactggtaagaaactccatctccaggttcaacagccttccccggccagacccagagccagtacctccagtggggagcaagagacaggtgggctcccggccgacttcgtgggccctgtttgagctcccaggaccaagccaggcagtcaaaggggacccacctcccatctcagatgctgagttccgcccatcttcagaaattgtgaagatctgggagggaatggagtcttccggagggagccctgggaaggggccaggccagggccaggccaatggctttgacctgcatgagccactcttcatcctggaggagcatgagctgggagccatcacagaggagtcggccactgcctccccggaaagctcctctcccactgaggggcgcagcccggcccacctggcccgggagctgaaagagctggtgaaggagctgagcagcagtacccagggggagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtatgacagaagcggcaagtgggcccttccccaagtctagggactgaagagtcaataaggagccacttggctcctcggggaaagtgacctctaaggaggctctaccaaagggagaagctggaccctgggcactaagggcacagggtgagccctggcagccagtccagtgctctgaggccaagcttgctctcttggttaagcccttttgatgccctctgctctggcccttcccatccagcagaggcttctggaggaagcatggccccaggcccctcctttagcaggatgggagcagaagctctccccctctgcctttgactcctgacccctttccactgccttttcttcattcttcctatggcccttcatgaaagaggctgtggatggtaagtgagatttctcccatcacacccaaaaccccaacaaccagccttgcctggaaagtgagttggggcctgctcagagcacccccttgcagctctgccctcccgccccatgcttcaggcagcttgctctctcctcataggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacccactatgtgtgaactccttcctaggcttggctggggtagggaaggttattcatgggccagggatgtcttagggagatggagacatggaggttgttccttccacactcaattgtcacttgggcttatgaaacataaggcacccgggtactggtgggggaggtggggcaggaggatgtgagggcgggctttttctttctgctgcctagactcccatgggcttctctgtctagcagcagcctgctgtcctgtctagggtagggggtcccgcatgccagccttttgctcttttccccaagggccagagttggaccaagaaaaagggaggtggtgaggtggatagactgtttttctcataagcagatgctcccagtatctggtgccttttgcgtttctctccggtccccaggaaacatcctagaagacaaggattttttttttttttttttttgagacagagtcttattctgtcacccaggctggagtgcaatggcgtgatcttggcttactgcaacctccgcctcccaggttcaagcaattctcgttgtctcagcctcccaggtcgctgggactacaggcatgagccaccacacccagctaattttttgtatttttagtagagacggggtttcgccgtgttgaccaggctggtctcgaacttctgacctcaggtgatccacccacctcggcctcccaaagtgctgggattacaggggtgagccactgcatgcggctgaaggtaaggattctaaactcggagactagaaatgtcctaaaggtgtctgcaacattggatgaggagtacaagtgcatttttctgggatgattcctccctttttatcacattctcagaagtatctttgattcagaagagttaggaatgcctccctatttcagttgggttttctgccctttctccacagaggtccagactcattttgcttaattttttttctagctggggcctgggaggtagaggcttcagggcctgggtggtagagctgcctgacaagtgttcagcagggctgctgggtcagggccctgtgggccttctgacccaacctgaagatgggtctgctaagtctaacaaggtcaagggaagatcagagggacccagattcttttttatcccccacttgaaacggagtcttgctctgtcgcccaggctggagcgcagtggtgcaatcttggctcactgcaacctccgcctccctgaccctcacactgtccagtgcccttgtggttactcagcatcatatcttgagactggcctggcaggagccagtgactgtggaatgaccacagaagattcagggcagctgccagaccaggggctatctctgccctgcgctgcttctgctcaagagaggttgtcactagcctctgatcttcccttgaagaacccgactggggctcttcagagggtggggcccaggaagttgtagttaaccccttccccaggcagtccttacacggccatctaggtatgcctgggaaccttgcaccaggtcggtggttctcactggctgcccattggaattatctggggagccttctggaaacgcagtgcttacattccatctccctagaccaacagaaactgccctctggaggtgaatcccaggcttagagattctgatgattctgcggtccagtgagtgctgagatctgtcctgagctctgtggggaggggcctggactgatcactgcttggaaatgattttgccctacagtaggccttcaagttgatcaaatgcatgaatgagcaagcttttcttggagtttgtgatgaagcccaggaaccgggtgcttgcagtcgtcccataaggctcccagggacaagctagagaatctggctgtccctctgtctccatggtgccagccctcttaggctcagttcaaagggagaggaggctagttaaataagaaactgagagaaacatggagcattattgatttattagaaaaactagtaaatgggtttcctctggttggtggaagcacggttgagcaggtggaggacaggacccagctggccccagggccagccccagattgcatggtctgtgcccaacagggttgcattcctctgcagccgccgcctcctcatttcctccctgagcttgtttgtccaagccaccaagccatgtggtcccgctggcttcatcctcctctggattcctgcccccctcccatgaagggaggaagaggattcagggtcagcctaggggaccctggctccctccgataggcaggaaggaggagggatgcggaggagaggctgagccttccacgggcctcctgttaggggtgttggtggaggccaggttggggagggaagcctaaggaccctccacacctcccacagccagagtcagttgaggctgggacaaaggggaaggagagagggaaggaggaccgcctgaccttgcccagaaggagcttcctctaaactgccctgggaaggaagcctggtatgctggtgtggactggagctgtgtcaacctcgtttgggaatactgtcaaaagactgtagagtagaataaggagagaaaaaaaaaaaaagaccttgctagggcactgggagagcttagccctggtgtggcacacacagggtctcccaaagctggatgcctgcattttcagtctagttggtcgaatgtcttggagcctgggtgacaggagggatgtgtggggagctggcaacagaatggtcacatgcagctggctgccctggaccaggccaggggacctggggtggtgagatgctagctcttccactagagcccttcctttctcgggtctgtggagttgcttgctggaaatgcctcacttcaggtgctgatttggcacacgtggaagggggagggtgggcccttgtccctaggctccctaaagactggcccagggaaacagttgagggagatgtttgccaccatctgcccttcagcaaggaacctgctctctgccccagaggaggacatgcctgcaagtgcaccaaaggcctactttattgctaggtgagtgcagtcacctcactgccttggtttccccagatacagaaagaggctggtgagtgatacacactaggttccctgtatagggtcatatgtaccaaagccaaatgaagaccttgctcaccagggcgggaacctggggatgtcaggctccatcggatgacgtcttccttcctgtggctcctgcctgctgcagttggtgtcaccctgacatatagtgtcagggccacagggtggaactgatttctgccggcactggtcagcactcagggttcctcagggggcctcattctggatgcctgcccctgtggcttctacctgaacctcacccacttcatctccatggaactaaggtccttctcacggggaaggtgatagaaacttgactgcaggccctggggactttcatggtttccttgggggaaaatgcctgctgccctccgccctcccccccacccccgacccgcttgactgctctcttggacctaaccctagtttgatactgggccagaactgtgttgctttcggagtagagtggtggggaaaatatggaatgagctttctcttcctccagaagtatgacctgagcagcaaggggaaggccattcctggggacgttggttgcagagcttctggtgctcagggctggagggtggtagatatttgacctctgtactcatgtgaccccctccccgccaagacctggggccaggacgtggagaagctgatcaaggggtaccacaccttcatggctctggccctgacatttgtcccagttgtgcaggagtagctgtcacatgggtggtgataccaagacatggctgcgtctgccaccccgagaaaacagatgatcaactttactgtctgcccagccattaccctccaaagtcccagctgcagacaggatgcaattgagcatttggctttgggatgctttactgcaggtgcggggggtatccatcttatatctgggggcccacactgtcccgtagggggcctatgtctgttggatattgctggtttggctgccactgggagtggggcgagggtcccagcattgagagggagagccttaggcagtgttgtgacgcacctgtcactccttcagatcagagccctgtgccctagccacggttttcaatgaggaatggtctgaccttgctgcccttcctgggaccgcctgtggtggcacaaagggtgctagaggcactcagccaggccctgccaaccgtgggagggtaccctttgatctggggggagaagcagagaggagggatgtggtggcccctgaagtgagagtcccagttctgcggaagcccagtgggaaggaggctggcagctcccaaggccctgcacccagtctggtcccctcagccccccagagcccctggcccagagctagggctttgtgggccacctgaaggctccttcctcatgcccctagggggctggccatgcatttccagtgtcttcttcctttcccctttccctggctgccaccaggtgggaggtgacccgaagcaagacttgctttaggaacgggcagcgtttgaagaaccccatcagccttctccagctcttttttttttttttttttggttgggggtaaggggcctgtgccccctcggctcaggaggagggtgggagaggagggcgtgtgcctcagagaaccgtttcctgcccccaggcctggaggccccaaaggcgccagaggagctgggagcccctgtccctggagcggagccagcgcgggcgagggcatggagggggcgtcggcccaggacacgcgggcgaaggcagcttttgcagtgcagcgtggggcccgggggcccggcccgcgactcgactcatctcgattcgaccggcgggcggcggcgagaggaggccaaggcctgggctgcccggtctctgcgcgtcccgactccgccgcgcccgccagccccacctgctacttctttttggggaagaagctgaatctcttctccttgtctttcttgccgaggctggcgtcggggccggagagggaaggcaggggcaggctctgcgccttgacgcggatgctctgggactcgttgatggcggtgctcacgccctgcagccaggacagcatctcctcctgcggggcggagggtcacggtggagtctggaggcccacagccccccacctcccgggccaggcaacaatggtgggggctcttgggactgccccttctgagggggcctccagggcaagcggcctggggtcctccacctacccccttcttagccaggtctgggctaggctgcccgcgcttacctcatccttgccatggaagagccactcgctgccattactcagcctaggaggacaaagggtttcctgtcatggagacacctctggagggggcgctgggcagagggctggctctgatcccacaataccctgagccgaacatccagacccctctcaggcagcccagcactttctgagaggtcaaagtctggaccatcagcctctttgatttgaaaaacccctgaggagcagctcaggcctggcactggtcccctacagagggcctctgccctgccactaatgccaaatcaagccatcaacccgagctttcaaaggccaggaaggcctcacctcagcttaaagacgtgcttcttcttcttgtagttggcagcaatctcacagatggcatgtctcagggccaggggttcctccccatggtagggcatccccagggccaggttcttggcatccttgtagaaggttagctcactgttcctgagcacacagtacaggttgttccaggacctgcaaagatgcagacaggcaggtcacccacatcctgatatggtatctctagagtcaattcctatagcttcaccattaaaaaaaattacaccatgtttgttctgatacatagtaacatgttttattgttaaaaaatcatctgcatgtaatttcattacaaaaaattagctattattaacattttatgtattccttctagtcttcacattttcgcatttttttttttactagtcacagatagctaaaactgggttatggatatattcaattttatatcgtgtttctaagcataacactaaatcatgagtatttctccatatcctcaaatatttctttttttgccaggcaagatggctaacacttgtaatcccagcactttgggaggccgaggcgggcggaccgcctgaggtcaggagttcaagaccagcctggcaaacgtggtaaaaccccatctctactaaaaatacaaaaattagccgggcttggtggcgcatgcctgcagtctcagctactcaggaggctgagacaggagaatcgcttgaacccgggaggcgaagcttgtagtgagccgagattgagccactgcacttcagcctgggtgacagagacgagacttagtctcaaaaaaaaagtatatatgtaatatatatttatatatacttttattatataatttatataatatttacatatttattatataacatatatacctattatgtataatatatatttatatgaaatatataaatatataaaatatgtatattacattatatatcatatactatataatacatattttatacatcatataatgtatattttatacattatatataatacattatatattatacattatgttatatattatatatgtagcaattatatattatataatatataacatttatagtatataacatttatatattatacataatatatataatatataatatttatatataatatacatatttttagacagagcctctgtcactcaggctagaatgcagtggtgcagtctcagctcactgcaacctccgcctcccaggttcaagcgattttcttgcctcagcctcccgagtagctgggactacaggcgcaagccaccacacccagctaatttttgtatttttagtagggacagggtttcaccacgttggccaggctggtctcaaactcctgacctcaggcgatccacccacctcagcctcccaaggtgctgggattacagtcctgagccaccacgcccggcccctatcctcaaatatttcttaaaataattttgaatagctatgtggaagactttcacaatccctttattgatgaaccttataatactggaaaatgtgcccataatttaaatagcaatgtgatgaacattcttacacataaatctgtgcctataattctgatcttaccttgaagtacacttatagaactattacgtcttaagaccaacagtaaaaaattaactttttacaatatttctacatccatcagtgtatttgattctcactaaagaactgtgaaggaatgaacagggttttgtttcagtgattgttttctgttttgatgagatgtgccaagtatactaaactttttaaaggaacaaattttacaaatagggctcatgtcggccgggcgtggtggctcacacctgtaatcccagcactttgggaggctgaggcaggcggatcatgcggtcaggagttcgagaccagcctgaccaacaaggtgaaaccccatttctactaaaaatgcaaaaaaaaaaaaaaaaattagccaggcgtggtggcacgtgcctgtaatcccagctactcaggaggctgaggcaggagaatcacttgaatctgggaggcggaggttgcagtgagccaaaattgagccagttcactccagccggggtgacagagtgagactctgtctaaacaaaacaaaacaaaacaaaacacaaaaaaagacaaatagggctcatgtcaactggcatgtttggtgagggaatcaaactgataacaggtgggctagcccgagccgcttcactcacacgtgggaagcatgttgctgcatttctacagcaacagactctgtttcctcctcctcttcatcctcctcttctgtctccctcctctcctctccctcttctcccttacttttgagggcaggaaggtggagaaactagtagggcacatagggaggaagttctggaaggtcagagagagaaactgacccatacaaagctggctgcaaagccattttacgaagccccatttctgactccgcgctcagggatctttcctctggcagaaaggcagttactaagaaggagctgggtctttggagaaagagcttgccttgaacaaatgacttaacctttccgagactctgttatccccttggaaaatagaaacatcaatgtcacaggattgttgggaagattttatcagtcctaatataatgcctggcacatagtagatgctcagtaaatgttagtttcccctttctgggtagactctccatttaagcaataaataaacctcttcagggcaattgggcccccaaatggttcctttttggaatttggaatccctttcgtgagtcccccagacacatcctgcatgctcatgctgccagctgtccctgggaatatggctggcttcaacctcctggtgctgccctattttcttgggaccctggactgctgctagaaagaggaggcccctgggggccccaggcagagacagccctagatagaccaaacccaaggacatgactgtttcagggtcaggaaaggacgcagcctttgagtcagttctcggggtcatagagtcaccagatgacagcattagaagggacctctggggggcaactaggccatgccccatccccatcactcccattttacagctgaggacaccgaggcctagactggtaaaaagcggggctcgaacaaggatgttgttagtgccaagacctacctaacctttagagctacctatccctagccctgggataataggataataacagctagtgttcaccaagtgcctactgtgtgccaggaacagtatctgtagtgaaaagacatactgttctcatcctctccttccaaatggggaaaccgatttaaagaggttgagtaacttgcatgaagacacaggatttgaattcaggaccagaactggagataggctttcccatcatgccaagtagccctcggggctggcccagaggggtgtctaggagctctcacaggccaaggcagaaggcacccctcccccagcacatgcccatgtcaccaaggctctgctagcagagagatccctgagagctgcccaacctaccctcagccagcagcctctcccgcactcacctgttggaagccttcttgttgggcccctccaggtcatgcttgcggcccaggtagccttccatctgcacactctgcccatggtcccgcggggccggcagcgttgcgggctcatcaccctcgctcagaggcgtatctaggaccttaaagaggggctccgtggtgggcctctcatccccagtggatttctgcccatccttgtgctgacccggcggtggtggctgctgcaggttctgaggccacgttccctcttcttccccctgctcagggcatagggaggagcacacctttctgggtactctggcttagagatggctgttctcagcaaaattgggaggtcagcagccaccctctccacacccccaagcctacttcctttctactcccacctcctggcccaccctggctctcccacaacctgctatgggtgcccccttgcttctctactctgcctgtgcttctggctccatttccaccccattctcccttcagagagctgcagggtggccccctctctccaatgtaacatagcaacggaaggttctcagagtgagccaaaggggcctgagtgattatttcattaaaggggtgtgagggggggcaggttccaatgctgctggcaaagctctggcccctccccttgctgcagccagacactcgtatgaggaaagttctgctgctaagacaagttcggcaaccacttatagtagaatgttgaatgggaactcttctggtactttcaaattgtgcctaaagccctaaaactaagggtaccaggtcctaagtctgcccgcccctgccaccttaca

SEQ ID NO: 375 - DNA, 45215 bp, Homo sapiens
aaaaataaaataataataataattgcattcgtaggccgggtgcagtggctcacacctgtaatctcagcagtttgggaggccaaggtgggtggatgacctgtggtcaggagttcaaaaccagcctgaccaacatggtgaaaccccatctctactaaaaataaaaaattagccgggcatggtagtgcacacctgtaatccctgctacttgggaggctgaggcaggagaattgcttgaacccggaaggcagaggttgcagtgagcagacatcgcgccattgcactacagcctgggcaacaagagcgaaaatccatctcaaaaaaaaaaacgcatttgcttcttagggggtttcagacatttaagagaatcctatgtattaaatgcaagattttttttttttttttaagatggagtcttgctcttgtcacccaggctggagtgcaatggcgcgatttcggctcactgcaacctctgcctcctgggttcaagcgattctgctgcctcagtctcctgagtagctgggattataggcgcttgccaccatgcccagctaatttgtatatttttagtagagacagggtttcaccatgttggtcagcctgttctcgaactcctgacctcaggtgatccacccgcctcggcctcctaaagtgctgggattacaggtatgagccactgtgcccagctaaatgaaagattttaattaaatgcttaaatgagtttaagtctaaaatcaatatttaggccgggcgcagtggctcacgcctgtaatcccagcactttgggaggctgaggtgggtggatcacaaggtcaggagatcgagaccatcctggctaacacggtgaaaccccatctctactaaaaatacagaaaaattagccaagcgtggtggtgggcacctgtagtcccagctactcaggaggctgaggcaggagaatggcgtgaacctgggaggcagaggttgcagtgagccgacatcacgccactgcactccagcctgggtgacagagaagactccgtctcaaaaaaataaataaataaataaataaataaataaataaataaataaaatcaataatgtgttttaatcagtttggattattaaatccataaatgtctatgtattagttgtgtacatagtgtataaatagaagaatatttaatgcttaaatgctatttgtttaataaattcataagagaaacaaaattacattaagtagaaataccttaatgacatttagacactgagagggtgtcccaggaaaagagaggggcacctgaacttgaaggctggtgacagatgtttaaggggccactaacataccagatagattttatcttcctagactcatcatctttgcacctattaatcatgaacagagttagttctcctgaattcatcatatgaaaatgtcacagtggacagagagactcaagagaagtgagttttgactgggtgagtcaagagggattatggtcctgagtagccagggagtgatttaagtacgggattcagagaaaggagggacagaggaagaggtgctaaagaaacaaccctctggccgggcggggtggctcacgcgtgtaatcccagcactttgggaggctgaggcgggcggatcacgaggtcaggagatcagaccatcctggccaacatggggaaaccccgtctctactgaaaaatacaaaaattagctggggatggtggcacatgcctgtaatcccagctactcgggaggctgaggcaggggaatcgcttgaaccagggagtcggaggttgtggtaagcagagatcacgccactgcactccagcctggcaacagagcgagactccgtctcaagaaaaaaaaaaaaaaaaagaaagaaagaaagagaaaaaaaaaacacctgctgcatcagtcacaactgccatcctgaggccaagaagaactaaatggtctcaaaattatttcacaacttgttgctaccacctttccacagtggggcttgtctagccagagaatcaaacattaattcactttaggctggtcatggtggctcatacctgtaatcccagcactttggaaggccgaggcaggaggatcacttgaggccaggagttcaagaccaacctgggcaacaagcgagacccccatctctacaaacaaacaaacaaacaaaagagtaagcacgtcatacacatcatagaattctaagaactgaagtaaccttgtaacatttagttcatggtaaatacataaaggaaactattattattatcacccaacagtgtgtgtgtaagtgaaaaatgtcttttttactgacaaatggctaagtgaatgctgtttgtttgagggatgaaatatttaaatgagaagccaactcaactcttcctcttgatcttagagtcattctctcaagtgtaactcccagtgcaaagcatcacatcaacttatcaatcgactgtgatgtcaactacagcctctgcaccagaccagccctcctctgtgggacgaagaactatcctgtggtcctgccaggactgcctcactgggacaacgcactgcattaggatctatcccttacgatggctcagggttttccagtctctaaggcaccttatcattatcttacctaaacttcctaataatcctgtgagggaggctggacatctgctttcatcccatgttacagatgagaaaacgaaggtccacagaggtcaatgacttgcctaaggtgacctggcacagaaagttgtgtggcagaaggggaacttctgtttcctaacttctggataagcgccctcctaggataggagaaatgaatgactcttgctactccagccaccacttccactaattaaccactaataaaaatgtaaaaatcagtatgccagcagtagtccctgttgcaaacattaggacctttctcatatcacagattactgaagacattccctctctttttgttgtagttgttgttgtttggtttttgggtgttgtttttgttgttgttgttgtttttctgagatggagtttccctcttgtcacctaggctggagtgcaatggtgcaatctcagctcactgcaacctctacctcccaggttcaagcgattctcctacctcagtctcccgagtagctgggattacaggcgcccaccaccacacctggctaactttttatttttagtagagacagggtagcaccatgttggccaggctggtcttgaactcctaatctcaggtgatccaccctccttagcctcccaaagtgctgggattacaggtgtaagccgcctttcttttcttttctttttttttcctttttagtcttgccctgtcacccaggctagagtgcagtggaatgatcatggctcactgcagcctcaacctcccaggctcgggtgatcctcccacctcagcctcccaagtagctggtaccacaggcataacaccatgccaagctaatattttattttttttaaagtttatttttgctcttatgatgatgattttttttttgagacagagtctcactctgttgcccaggctggagtgcagtggcacaatctcagctcactgcaacctccatctcccaagttcaagcaattcttatacctcagccttccctctagctgggattacaggcgtgcaacaccatgcctggctaatttttgtatttttagtagagatggggtttcaccacattggccaggctggtctccacctgccttggcctcccaaagtgttgggattacaggtgtgagccaccatgcccggcctactcttaattttttttttaagtgctcaagctaattttttaattactatttgtagagatgaggtctccctatgttgcccaggctggtctagaattcctgggctcaagtaatcctcctgcctcagctcccaaagtgctgaaattacagacatgagccaccatgcccagttccaccattttttaagcaacaactaacgttaatccaaagaccaccctgaggggactggccacatccccctgggaccctccactgttaaagtccatcttccctgagccatcagcaccaagcatcagatgaacttcactgccctggctcagtgttgcctgtgtgtgagcctcagctccccatcctctctgggcctcagtgtcttccctgtgcagtatgccccgcagtgcccacccaatggggttgttgtgaggatttgctggaagggtgtgtgtgcaagccccttgtccaggacctggcctatatgtaaatataataaaagttcgttgttatttctgttaattgcatattgtacttgaatactccctggacagataatgagaaaaatgaggtttgagtcaccacccctgtcacttgtaaccctgtgtgacttgcttaatccctctaaatctcagttcctccatctgtaaaaatctttttttttttttgagacggagtctcgctctgtcacccaggctggagtgcagtggcgcgatctcggctcactacaacctccaactcccgggttcaagcgattctccagcctcagcctcctaagtagctggcattacaggcaccatgcctggctaatttttgtgtttttagtagagatgaggtttcaccatgttccccatgttggactaggctgtctcgaactcctcaggtgatccgcctgcctcgttctcccaaagtgctgggattacaggtgtgagccaccgtgcctggccgcaaaaatcttataatgccttcctcacagagaataatgaaggttaaatgatgaaacgcacagagcattttaatgctgagaagggcttcatgaggttgttgaaaaatgtcagtgaggctctgggagggctacagccggagtgtagattagactctgggtgtagccgcatggctcaggaattgagtggaagaagagagatgatgagagagggggagggacagagagagaggatcagccattccttcgtgcctgctgagtgcctgccctggtccagaccctgttctttgtgctgggggtgcagcagtgaactaaagagacaaagcccctgtcctcgtggtgcttatgctctagtgagtctgtggaacagagcaggggactgttgacaccaaatttaaatgtgcgaataggaatgactatgcagaagaggccaccaggaagagggacagagagaaatgagactccaggcttgatagaatgaccttgggctggtggaagaggcaggtgctgaaaacaggcatggaaccccttgccctagggcagggagaaaccaagagagtccaagctgggaaaagaatcaggtgaggaggttgaggtgttgacgaagggagtgtgcttggtgatgggaaaggtgggctctgaggaaggtgttccaggaaggacttctcagtgtaggatggagccttatggcagacgctgggaccgggcatcttctccagaaatgcccatctgccactcaggcaggcaggcaggcagctccctaccccttgagttctggtgtttttcctactcctttctcccctcccacaagctgcccaactcccagggacctgactggatggagagtacatacacctggaccactgcaggcatggcacagggaagagagaatccagacccaaatcacctccaacccacacctgctgattcttccgtgcttttgtagcctgacccttcgctgccgtcactccaactcctgtgtgaggatgttgagctcctgggaaaaccgaagggagggcaggagagacaatactgtgaccaaaggctgagactgtgtcatcacttgggaatgaaagcatcaaatgccaccccaggtgggattgttggcttcaaggtttttttctccctttcctttctcccttttctcttttcctttatcgaggtctgctatttactcagcaactcttcaaagtctgtggttctgtgggacacaatgtgctaaatgatgcctgtaagggaggaggtcgatgtacctccacttccaagaagcttgactttccggggaagaaaagacaagtgaagcgtagacattgcgacttttggcttcctgtttctgtgagttgcaaggaatcctgtccacctggccctggagccgccttctgggacctcatccttgccccctgctgcaggtgccatctcaattagtcctgctgtccctcctccccctttcagattccagcacaattctggaacagctctcccacctggccggggtgagactgaggctccaccctcaagcacttgggcactgatcctttgtgaaggatggggatagcaagacagcgtctgcaggggcccctagagggccgtggggatggctagaaaacaggaatgaacagactcacttcagcttatgcccagactcacttcagcttatgcccagaaacaaagaaaccaaggagaagcaaattccataagtgcttttattttattggagatgagcaggggaggcactgaaaagtggggatagtgctggaaacatgctgacagggcctggattgagcccacacagcaaggggcgggagcaggactctaactcccaatgttgggtttccctctatcgtgctctagccccactgcaacctagggcttggaggattagggaagccagctgggatgttccaagaagagccaggagggcggaggactccaggaggaaatgggttattgatacctgggtatagatgaatattcccccagctgcctcctggataccgattaatattcccccagctgcctcctggataccgattaatatttccccagctgcctcctggataccgattaatatttccccagctggtacctgggggttgattattgataccccagattccctcagggtgtggcatgggcctcgttccccaaccagtcccagggcctccacctccccaggacacactgggattcagggtaccccaggggtgatcaggcagaaccctgtggatgagagaccagggagggcgttgggaaaggatttttcccccggctcccagtgaattagaacggggcagtcgtctggactccgagtcctggtggaggagtgaagccttgggtgagaggcctgtggcatcgggagaagactccccaggcaaagggccactgcccggagcgagggccgcagcactggagaggtaagagagttcttcaggcagcgcttcccccaggcggtcctcagccgcagcagccatcatctgccaaggatcctcagggggccaggaatccatggcaggcagcccccacgatggaggccacctctgcactgcagaacctcctgcaggtgggaagccatctgatgcaggcacgctgagcttcagaggaacccttgccaagtcattagacctagggtccagagcgggctgcggatgttcagagttagaggggccagtggaggaaggttgtccgagctgaggcaagttggtccccaagttttgggaaactttctcctccacaacaccgatgctccgggcaaagaggcctgagggaaagggaagataaagcaaccagtggtctccagtccccgagtccccagttccctttgcttcccctatgcctattcttccttttccctcagggacctaaatgtgtaccctcctgcctttacccctttccttaattcctgtttcctgggggacctccagtccctcctgcccaagggcatcacggcctccatacctgggagatgaagacagaccaggagcaggcccagaggagcgcagctccctgccacgcggccctgcatcctgctcagcacccgatctccctcagccccaagacagccagccctttatcctggtagtggggtgggggacagcagaaacaggctgggctagtggttgtgaagacaataaacctccacattccaccctcattcctaatgtggtctgtggcaacaggtgtcacttgaatgaatgtcccagaggaagctgggtgtctcccgccctggctcctttccttgacctccctgccccttcttggcccaggtgtcctggctcacagctcatccctggttgccagcctccccagccctgcttctctatacacaaggacctccaccctggggtcccactctcttaattgcctctctcagcaacagaaacacttgtttctttttgggagctggattgtttcctcccagcacccctttctcatgcatcctcatatctccttcaccttggccccaacctgcaggaggttctggggtgcagaagtggccccatctgaggagctgctcctacatgagaccctggatctagctagggaaatggacctggatgccatccttatgagatactgactaattcctgctgctgcagtgacaaattaccatgaaccgaatggcttacaacaacatggatttattactttacagttttggagatcagaagtctaaaacaggtctcagtggattaaaataaaggtgtcagcagggctgtgattctttctgggggcctcaggggaaaatccctttccctgctttttcaccttctagaggcatcctgtgttctttggctcatggtccccttcctccatctccaaagccaaaatcagccatttcttacactgtatcactcagacttcctcttctgcctcccatgtccacattaagggacctggtgactacactggacccacctgaataatccatgataatctctgtgaagtcagccgaatagcaaccttaatcccatctggaaccttaatttccctttgccatgtaacctaattcctacgttccagggattaggatgtggacatctttgatggtgttggggttgaagacatcattctgcctgctactggtggtcagatgtgccatagagtataagaaaccttgggagaaagtggctatttccaagtaacagtagaggagagcctttaaatgctgctgtcaaatggccaggacttgatccttgttgaagctgggcgatgagaatgtagagattcattaacagtttgttggcttttaaatatgtttgcaaattttattataaaaatgcaatggctttgttctctccatggcttccgggaggccccaggagtaggcttccctggctgcccaaggtctaaacatgagctgttggctgattctactgctgtgtcctccccacctgcccctgctggcttaaccactggaggagtgaagagctcctctccagaactggcagtggatggagcccagaggcctttttggatgacatgcatgagttttacacaagcttttaatttggagcacagcaggagactcgaggaaacaccacatcagagagccttctctccctgcaattcccattcatgaagcatctgaggacctcgattcctgccattggctgcagatcaggggccagatgctggaccaagggtgattcaatccctttctggtcaatgtaatacatttttgctgattccagacttggagtttcaacagttctaaattcaggaccagacagcaccaccctgataggagggaatgggttaagtgctacagtaggggtgaattcctttgcagccaagcagaggctctgagaggtggcctggggtggggggtggggctcctacagggacaagcacaatccactctgccctccttgggatgcgggaacttcgtccgcctcagcctctccctgcctgtctcaggacttaagtcgcatggaccccaccacacactccactttctctctcttctccagtggaagcgactcctctttcccactggggcactctgccttctcagccctcacctgagagccatgttgctcacactctcactctggaccccagcagagcagggagtgtgaagatggagagaccaccggcagctctgttctgccacaggctgggcctcttgatctaggccagtgagtcaccctgcttggctgcactccctgccctgctcccatcctctcagtcctttactctctccacccccagctccaggaacaacgcccaactggcctcctactcagctgacaggaatctggttggagttgttgtgtcccagccttcccaagcttccaggtgtcccagaaacccaggaaatcgagactcatgactcccagagaggatggcatctagaaggtgaggaatgctaatggtggaagaaaaggagtttgggtggggaggggaggggaggggagggagaggaaacactgagggccctaaataaggggaagggggaccccacggtgaatgaggaatgggaagagaatggatttcctggagcaatgagagaggagggaaatggcggaaggatctgggaggccaggcaatctctgctttcagttcaacaaatatttattgtcttcctcctctgtgggagcagctggaaggtagaagagaaacacagcccgcttttgaaggaaaatgaggaacacagagacctctagaggcgtaggaagagcaccacccagactctcagaggagacccaggactccaagaaggcaaaaagtctgcacctagtccccacagtttactgagccatctgtccaggatccagggacagcagggagcctgcttcaacctctgagggtgccccagtgtctccctcacccagggaatcatctgagcactgagggaagtggccacaggaaggggctgagataagggccttgagaggcaatgggtgtgttggggacggtgatctaggagggcgtggtgagctctgtaatggagggtggggtggaattgggagcgagagcccagtggcatattgggtgggttgactagatgtcgaagaaaggtcagtgaaaagtggccactgtttccagatgatggtttgactttgctttatttggtaaaggggaagaggaaggtataacttcttcaggcgtcagaggtgctctgagagcatttcaggggtttcccagttgagaagctgatgggggtgttactcaatggaccatttccacacagtagagggaattgtaaggggtggtgatctggctgaggggcactgtggtggaatgggaatttaaacagtaggagagaatcaagagaggagctttgaatctaccattttgagaagaggaaggaggaaggggtgataagagagagtctgcaaccttggggtagtggagaaagcagaaccactcttttgggaaggagggaaactgagctaaccctatgcctgggcactggacttctcccatatgggatatagtgtatgtgcttgtttgtgcccaaggcatgcacacacacaacagttgacttcttatggactgttgagtaactctccttggggtaggaaaacttcagggtcagctagctggggccccagaggcttcacttgggctaggatatcccggatggagcggcaggggatctttccagcactgctggagccacagggcttggcaccagcggagggatcaggatggggagagccatcggggcccccagtcagtgtcaaggaggagacagacatgcaagggtgaccagaagagctggacttgctgccacaaggctgaaggatgattttgccactggattgggaactggagctgctgctgaaggagccggtgcctggtggggagcaggggctctgggaagcactgccgcagggatggtagggtaaaccggagctgctggaaatgctagaactgctggggactcgagaactggagggagagcagggtcccttggagcccgtggagccgcctccacagagctggaccccaccagtccccactggctggaatgcaatggccgaggaagctgccgactggctggggatgatggggttgctggagaagtatttgccctcagagatggggggcccagctgcaaaggaagggacccctggagagcctttcacagggttctctttggtgaagtagcccacagggtagattttacccttactgtaggtcatgcctggaaccagataactgtcagaggagccacccaccacctcgtagccaccataggatttgtctacagaggtgattgggggacagggcttgcctggaaggccaccattgctacaggggggaccttgaaccactccaggggcaccagaaccgtgctggtccaccaccaccaccacaggcctctgaccccctgacacagagtgggagctggggatgtaggggccggagtgcgagacgatgggccctccactgcagggagagtcggggatgtccgaactacagggacgctggttggagctgacgctttggccactgctggataccccaaaggtctgggaagaggaagagctttgtccaggctgggaagggtttagtattccgcggtaagagttgtcattggttggcagagcagagccattccctacttggaagctgctgctgctgaactgaaagctgctgctgctgctcgaatgagagctgctgcttcccgagtgagagccgctgtttcccgagtgagagctgctgctccccagctgggaggaaccggatgcaccttgtagactagagccagatccggaggagtagctgacctgggaataccccgttcctggcttaaaagatcctgcagaaccaccctgggcaatgctggatccgctggagctaccactggagccaccaccagagcttctggcactggaaatggagctgccagaactgctggagccactgtagctactgaaaccgctggagtcacccttcccagtgaggcaggggtcgttaggggaggtgatacgcgtggggtccttacaagggtctgagaaggtgccaatgctcttagccaaggtccctgtggaggaaagcagtggttagtaagggccaaggaggcttggcttcctccctcacctttctgccttatctcagtcatcggcctctcgggtttctcccaagcagagcgcagggagagtttagggatggagaaaggaggaagaactggctattgtctctaaaggatattgaggtggccgaataaaggcatttctttgtttgggaagggtgggcaaacaccaaccagaaaaatagaaaattaggtgccaaagtgagtggcctcaaaggaatacattgaatataagagggggctgggcacagtggctcacgccggtaatcccagcactttgggaggccgaggtgggaggattgcatgcgccccagagttcaagaccagcctgggcaacatagaccccgtctgtattttgttttttaattaaaattttttttaaaaagaagagggaatggagaaggggcaggaacaagtaggtctaaaagaaaggaccctgaagagacagagaattggggaaactgaggctctgaggagtccaggcgtaaattcttaggggaaaaatcctgggccagacagtgggaccaaagggaagaagacaaaaggcaaaacaatggagggctgagaagtggagacacatatagaaggagacactggaaaaagacaaagctgggggcagaggggctgaaataaaggaaagggcactcgaggactaagatttggtcaccagcttcttcgtgagagcccaggctggggtcaggaatggaaaccctatttcctatctcagcactggccatgccagtaaagctgggtgggggccaggatgtggggtcactacctgttgcttcagaacctgctggtaccagtgtgtcaggacaccgcaccctgagccagccctgctctcgctggcccagcccagggaaccaggacgaaaccccacgaacctccgaggctcctggccacaatcagcttccctctctgagcacacctgcctctgtccagcccctcatctgacttctgctgccttgacttccctcagggatgtggagccacatctttccttatctttcctttcctttgctcaaaaccccaggcccaacttaccccgtggttcctccatgactctttcacctgcgttccttctgccttccctagcccctccaggtcccacgtgttacaaacagagccacatactagcaagttactgaacctctctgagctttagtttatacattcagaggggccaaattttccctgccttcccacagcattactatgaagaaaactaaatgagatcatccacctggaagttttttcttcttcttcttttttttttttttttttgtgagatggagtttcttgttgcccaggctaaagtgcaataacacggtctcagctcactgtaacctctgcctccttggtgcaagcgattctcctgcctcagcctcccaagtagctgggaccacaggtgcccgccaccacacccagctaattttttgtatttttagtagagagggggtttcaccatcttggccaggctggtcttgaactcctaacctcaggcgattcacctgccttggcctcctgaaatgttgggattacaggcacaagctatcatgtgcggccagatgttttagaaagtgtaaagcattatatattatgaattattactgccactcatcctgatccctccaccaacaaccagactgccatcctctgtgatgtccctgttctctcctcagaaagaaattctctgcatgcacctccacgccgaaccccagctgtgccaattcccttcagtcctctgcacgaatccaccatgcattgcctctctctttcgctattccctcagacaccaaccacccactagaccatgggaaggtcgcagaaattcctcaagggctataagtacccggtggtcaacaacacaggtccaggggttgcccggcctggggttgaaatcttggctttgctgccttctaatgcatgatcttgagctactttcctaacttctctgagcctcagtgtcctcatctgtagagtggaaatagcaaatctcctttcataccgttcttgtaatgatcaaaagtgctaatataggccgggtgtggtggctcatgcctgtaatcccagcaccttgggaggctgaggcgagcggatcacttgagtcaggagttcaagaccagcttgaccaaaatggtgaaaccctgtttctactaaaaatacaaaaaaaagaaaattagccaggtgtggtgatgggcacctgtagtcccagctactctagaggctgaggcatgagagtcgcttgaacctgagaggtggaagttgcagtgagccgagattacgccactgcactccagccttggagacagagtgggactccatctcacaaaaaaaaataaaaataaaagttctaatatataatccaaatgtgcttaaaacagagtctagcatataaaaaggctctaaaaatgatattattactattaaatgtccaatcattatcttgtagtgctcccataataaaaatcaccaccaccatttatataaacctctagaatttccaaagtacatatcacatacattatttaatttgagacacacagactagagttaggtgtcattaaccccacttcagagtttcagaaactggggctcaggaagtttaagaaacttacctgaggcgaccatacagtgaggagcaacccccagactcaaaaggcagattccagagcccctgcctgtccccttcgctgggtcctctcccggagtctccctcccgcctccctcctgttcccagggcccccagcctcctacctggcaggaggagaccagccagcagcagtgccatcatcccgtgcccacccacacgccccatccagggtgcccgagacgagcccatctcggactgcacggcctcctgactgatggcagctcaaggacacccgggtcctttatgccagagctggacattccctgggcaggagtcactgtggggagaggaggagaggtggagggggtgggtgccccaggggaagttggtgtggccgggaggagcgtggtaatcagcccggtgcatctgcctactcagcagcagcagtggctgcagtgtggggtacccatggccacggggctctaacgatcctgccacctgacaggcctggccccggctcctcattgcctaacccggaaccaggcgctctgccccacggccacccactctggggcggccactcttgccacgggacccagctgcctggctccttaactctcctgcctaccgtagcttggcctgtctctccatctgccctccactcgcagtcgtgggtgtttcagctttttcttccacacttgggtgcccgctccagccccacccacccaaccccaatgaggtcccattcacagcccctgatctgctccttccttaggaccccatcactccacctccactttcctccttcaaatatgagttctgcccccatcccccaggctccccctcccaccactccccaagtaccaggccagccacatacctattacgtgttccatcacctggggaactttctccttctcagaaatggggcaccacattcccaaaaccaactccctgacctgtcgcttctgggggcctctggggacggcatggtggcgggggtgggggggtgctgggagccagggctcagccaggggaggggcctgggctgatgacctctgtcaaagctgggccttggttactcacagggcactcacagcccctccccatggctggtaacccagacctcaagggtgagcaagaggctaagaaggctaattgggaaggtggtggccccatagcccatctgctggccctgggctggatgagcgagcaggaagcagcagccagctctgggcaggtcgaggagggccaggcaggctcccgggtcctcaaaggatgaaaggaggccaggagaaccggagccctgccatctgctgagagggtggtggcttctcctccattgcgttggcctccctcctgctctggcccctgccccgccccagccaattaattgctcactagtattgcgggagtatcagtatcggagggaggtgcctgggagtccagcaagctgccctctcctcccccaggcctcagacacccctgctcccctcacccaaactcacttcccaaacctcatctcctcacaaaggcagctctgtccctgggccccttggcctggtctctcccattccctctacctcctgaccgccctttaagttcagaccagcaggaggatggaaatgtttcctgtctgtgctgtccgatacggtagccactggccacatggagcaagtttaaccaccaaagatttggagctttaattttaattaattgtaatgatgtggttggccacgtgcagctagtggctgccatctagtcttgctcttgacttgctagtgacactcagaatgggagtgggaggaaagaggggctgagggagctgtggagagaggaagggataggacagggtcccctgaagggggctaatgccttgggaaaaacaaacaaacaaaaaacactggcttcagaatgaagatgacgtgggttcaagtcccagctaacctcttggctttgggcggctcttcaaacctttctgaacttccatctcctcatctgtgaaatgggggtattttaaataacacttatttcacaaggtttttgtgaacatcaaatgggaaattatcaaaaaggttaaatgggacaaggggtgcagtcccccagtaggaagcccagcaaatggagccctgcaggtgctcctgtcttcatccttccactgggggagacaaataggccagcttcacccccacagccccaggctccctttcctgagtctccagcccagccaatgctagcagagtgtcttctgctcccttcctgccttgtatagaggtgcaggcacaaatgtgagacagagataccatttaaagtgatgctgctcggctgggcacggtggctcacgcttgtaatcccagcactatgggaggccgatgcgggcggatcacttgaggccaggagttcgagatcagcctggccaacatggcgaaaccccgtctctaccaaaaatacaaaaaaaattagccaggcgtggtggtgggcgcctgtaatccctgctactcgggaggctgaggcaggagaatcacttgaaccctggaggcagaggttgcagtgagccaagattgcaccattgcactccagcctgggtgacaaaagggaaactccgtctcaaaaaataaagtgatgctgctctttccgaacatcatttcctcctgtgggcctccctagactctcaggcttggctccctggaggacctgggcaaggagggagggggcactggggtaatgaggggagtggcagagggcagggaggagtggactagaaggtgctgggccgtcccagggtgtgaggggagaaggcagcggaacagtggaatctgtggcttcttcttttccaacacaaacttcccctgaccagccagaggtagcaaagtttgtcttgttttctttgtcacattcctcctggctgccgtcagaacttggccaagacagccaggctggaggaggcacagtctctcctggcctcctgccaggtctccagccgcccacgtggactggcggtgcagccacgtccctcctcctggctactctctcctgtccactcctgtccaccccatcctgccaccctgggctgcccagttcctctactgtcctgcccacctgtgggcccttgagctctaatccgccgtgcttttggttttttactgaaaccctgccttctgtgctagattttactctggtgctcaccattaatctttctctcagtgcaggtggtggagacctaaagctaatggggcttaggagggaagaaaagggcatcagctgagtgcccacacaggccagggtcaccttcagtgaagctgccagtttggtgacgtccacagtagtgcaggcagctctgctgtgttctacagcaacagattctggccctgcccctgcccgtgcccgtgcattggaccgggtgagaaagtgtgggtggcgtagacactctacacccgagaaaatcaagctcaaagcacatgccttccataggcaaaaggtggggctcccagccatgtatcatgaagcaggcaggtcactgtcccctctggtcccctccacccctccagcagccctgtgctgctgtgtttgctgtgccagccttggcccccagtgcacgctcctctgctgtgttttggaagttgcactgagaaagaagagaaattgttccttgccctgaggagctgccatccagctggggacacacagcgtaagacagcagcctagagtggagaagcgggtaggcacttggcttcagggaggtggcaggactttccccgggccttgaggaatgatgagagaagcacagagcaggcagccagacgtggggccttgtggtgcttcaggtgtatttagaaccagcggatggcgtgggttggtgtgggacatgcatgtggaggacagtggtgtgggagaagggacaggctgcttggatcaggattgtagatgacctacaacaccaggttaaaagaatttggattctataggaattgcagtaaatgtgagagggtgcagggaaccaaacggctttgaatgatcacaaagggggctgaagcatggcgtgctatagtcccagctacccaggaggtggaggtgggaggaatccgaggccagctggggcaagttgagggactccataaagaggaggcttggggcacgagatccaccatgtactgactgcctgctgcaggcggacacggtgcctgggtatttaacatgagttgtcttgttcaatcttcacaacagccctacagggtaagtgctttttccccctgtttcacagatgagaaaactaagttgaaattatttgtccaaaccagctgctaacaagcaaaaatgtttgaaaaagattcaaacccaggcctgttggacttccaggcccacatagatcctattactctgcagctgacaccatgctataaatgaatggcagaggttcatggacaggcttaagaggctccctaaaccctgtaaggatgtgtgcaaaattccttatgtatatgaatatttctagagagaagatttctgctgtcaaagctggccaggtatggtggctcacgcctgtaatcccagcactctgggaggccaaggcaggtggatcacttgagctcaggaatttgaaaccagcctggccaacatggcaaaaccatctctactaaaaatacaaaaattagccgggtgcgggggcaggcacctgtaatcccagctactcaggaggctgaggcaggagaatcatttgaaccggcgaggcggaggctgcagtgagccgatttcatgccactgcactccagcctgggtgacagagtgagactccgtctcaaaaaaaaaaagtgaagaattcttaagtgaaggttactggctcatgaggtccctcctccacagctttcctcctctgggggcctgagagtcaggacagaagttctagcacaagtgtttcacataggggtccttggtagaccagggcttaggcttggaagaaggaaaatggagtgagcacgaggaagagaaaaagcctggaaaagcagcttattttgtgctgaggagagaaggaaaggggccacccagagctgctctggggctccagggcctgtgggctcctcccctcctttgttcctctctgcttggctccagcgagaggccgtttcctctcctctctctttctccatgacacccacgcttccctgtggactcacctctgcagccacaacaacaccctcctctccttggcgtggaagccagcgctcctggcccactcccagtaggggatgtcctctgagttgtttttcctgtgcggggaggggtggactgagtcatccacactcttcacctggttcctctggtgaccaagaacatagaaggagagggcacatccccaatcaggtgttccgaacatctctgcgaagactgaccctcctcagcccaggtgctcctatgggactggctacacttcttgactcagttttaatctctccttctctgccttcctgttgggaataccccctcacttctgtggcttctttcctgtagtagacgatcaagggtggaatctacagtccgtgagccctgacttcttgccttcgtctcaaatagactctgcagccagccatctatgcagcgccccagtggctttgaaatgcaacagaaaccatcacccccggaccgtgggctccatgccagtgggcaaagcacaggtgcgttcactgagttcccagcacatagctgtggcaggcacttggtgatattttgaaataaaagaatggaagaatgtgtccaggctgtgcttcccctttctaccttactcagggacatggtgccctcctctctggtttcctgccctgtgcccaccccccaccccctgcaagcacagctcttatgtgcaaagcccctgtaggtgctggagggattcactgatggccttggcggaggtggcagtgggcatgtgcacttggctctgacacagccactcatgcaacaccctgtgcaatctcggcctgggcctgtgtgtcctgccctcattcctcacgggtgactgtctcccctgagccactcttctctctattggattagctccttttatttccccctagggatgcaacacatttttatgaacaaacagcagtgttcacatggctgtgatgaggacgtactggggtttcccctggacatggcattcatctgatgccagtggtgggcaggaccgtgctgtatactttaaaaaaaccctagggggttctgttaggtgcccccactgcagcataacgagttgcccctagctgagaagccctgtcctggggcctgtccacaccatcctcttcctgagattattcctggtgtgggcggtgctcggctctacctttccttccttcttccctgcttggctcctggtccaatggctctctcctctatggaatggcctcctggagcttggctgggtcagcccccactttccactcttcccatgcctgtcctcaccctcccagcagccctgccagcctccgacgggcccagggcactgcagccggcacttgggagtgaagactggggccagagccaggctcacctttggccactgaatcctgaaagaggaggaatttggcaagtggggttctgcccaccaagctttcttccccccgctcccctgagtcttttcccttcacccccacttcccaaaagcagcagggagtcagctgtagggcagtcgctccctggccgaagccttcctggctgtttccgtcacaccctgaggccacccctcttatcttgcgaggagggaggcacacagaggctgtgattagctgtcacagtagcaagactgttcccctctctgtcctgcggagtgagtgtgagggaaaagagctctccttgtctgctcattatgtgcacctgttaaatagtcattctttccactagggctattagtggtttttattgttactggtcacccagaattagagtcacagcttcctcgacagggtgaaagagagcgccagggtgcagtctgaacgtgctctcgggagaggagaggccggaaagacttgtaccaggagggacttctaggctgggctggcccttggagcgcctaggaatgggactgtggtggcccatcttccctcctgtgttctgggctgtctgagtgcctctgggtgagagtcctcacaggagggagcttctcctactgcccagtgtctccctggcacctgaggcatcacccagcacacagaggtgaccaggaaacacagactcctgttagagaggcatctcgtgtcccgctctgttctcttgggccctgggactagaacatcttcaccagagaccggcgccgactccttggcagtgtgtaacattcagctcggtgccgaggtctgcccatgcaggactgatctccattctctcaatgaccctaggagacaggaattattattattattattattattattattttgagatggagtttcgctcgtagcccagcctggccaacatgatgaaaccccatctctactaaaaatacaaaaattagccgggtgtggtggtgaacacttgtaatcccagctacccgggaggctgagacaggagaatcacttgaacccgggaggtagaggttgcagtgagctgagatcgcaccactgcactccagcctgggcgacaagagcgaaactctgtctcaaaaaaacacacatacacacacacgtttgggaccatccctatttcctcgctctgcctaagctgcgtcacaccattcatcactaggtgacatcctactacagataccttgtaagcatctgtgtatctctctcctccctcactggaaggcagctccctgagggcagggccctgatccctttgactggctgtggtatcctctcctgtagaccgctggctcatgaaataatcagggagagaatgtgtaaatgatgatcgtgaggtccacttggacaggcagcctgtgcctgaattttcctgagggcttcagagcctgtctcgcctcgcctcacatgcctggctcaccttagaacggtcaccttgacggctaaagggacacctgtgtgccttgatggtggacccagggagtggatgacattagtgagggaaagagcaaaggctctggaggaaaacacctgagaggagtctctaggctgccctctggtggcagttcttggaacaagacctgagagccgctaccttggctctcagcattgcacgggagtttagaggttattaaagaaatccccctaaagtcccatcccaaggtcacatagagaacgaatggctaagtagcgacaagaacccaagtcacagtctgttgatctcactaccatgctatcctgcctgcccccatcacaggagttgagattatactgcaaaaggaaaggtggggatggggtggggactggggaatttggggagggaattgattactgcctctgaggatattagggggaaaaacccacaggaggtgcatttggcttaattcagcaagttttttgagttttgattcagtgccaggcacctggtgggcacttaattaaagattagcaggagaagaaaaatgtacagtaagagagcttaagtttataccaaagcgagtcttgggtctaataattttgaaacatgaaattggcagagaagttaggagtccctcctgggctcctacgtcagggtttgccccctctctaatttaactttttatcaaattttattgtcatgatgtatatgtttgtcctccctaaacacagagccccttgagggcagggaggactgaaactgcttcctgggactgtcaccatcacatagcaccccacagagcagatgctcaatgaatgttgattgtgtgggcaaatggatgaacaaatgaatggtttggagtttccctggccagagagcttcaaagcagggcagacaaccatctcttctgtctagtccaaagacatcattcgctgcccaaggctcagggctgtgcctggtgctttctcaaggtaacttagcttgtataattagattttaccgtgatactagttctaggttctttttttttcattggccaagcatttaataactatctgtcatgtccaaggttctgggctattgttctgtaaatctgtgatcctattctgttatttaattccgtgactctgtgttgacatagacgtgacggtgtccctggggcatttactcctaggtgagcttagccaaggcaggtagagaggaaccagcattgtctaatctgaatggataagccagcacaatgggtttccctctgcaaatacctccataccatccaggcccactcagtctcctccccagctaatgaagacagcctgtttgagtgccaaaatccactgcctattaataggtactaaaatctccaattgcctcatgcctcccccttctctttcccactcacctacctgccatgtcagcctgggaagaattggtttgcagccaggcagtcctccatccagtcttgactttggcacttgtgatatgacttgcacaggtgagttacctctctcagtgttggttcctcttctgtgaaatggggctaatcatttgctttattgagtgccttctaggctgggtactaggagagaaggaagggatacaaagaaagacaaggcacagttgctgtcttcaagaagctcatactttccaaggaaataaaggcatggaaacccacatagtgctgtggaattaaagaaggcagcatgctgtaaagagccccagctttttccctagacaacatcaggggctcagttcctttccctcctttctctcttctttaagaatttctcttagctggacatggtggcacatgcctgtggtcccagctactcaggacgctgtggtaggaggatcccttgagcccaggaggtcaaggctgcagtgagctgtaactgcacctctgcactgtccagcctgggcgacagagcaagaacctgtctcaaaaaataaaaaattaattaattaattaattttttttcctcctaactaattccacgttattggcttgagggtcagtttgaggggtccagacctccttcttcctttctatccttagcttcctgccacagtatacccagagatgtatgtgtttctccccaccctaggcacaattttttttttttttctgagacagctctgtcatccaagctggagtgcagtggtgcaatcatatctcactccagcttcaacctctcatgctcaggtgatcttcctgctgagtagctgggactacaggcatgcactaccatggcctggctaattgtttgttttttttttttgagatggagtctcactctgtcgtccaggctggagtgcagtggtgcgacctcggctcactgcaacgtccgcctcccgggttcacgccattctcctacctcagcctcccgagtagctgggactacaggcgcccgccaccactcccggctaattttttttgtatttttagtagagacagggtttcaccgtggtctcgatctcctgacctcgcgatccgcccacctcggcctcccaaagtgctgggattacaagcgtgagccactgcgcctggcaacctggccaaatgttaaacattttttttgtagaggtgaggtcacactatgttgcccacactggtatcaaactcctgagctcaagcgatcctcctgccttggcctcccaaagtgctaggattacaggtgtgagccactgtgcctggcccttttttaattttaattttttttttttttagagatggggtcttgctgtgttgcccaggctggctttgacctcctgagctcaagcaatcttccacctcagcctctggaatagctgggattacaggtgcgccctaccatgttcagctaacttattttgtttgttcagagacagggtcttgttatgttgcccaggcccaggcacagttctgatagaggagagagactttcagatatgagctcctgcacttggcaccaagatcttccctaattttcccccgacctgtctctccaacatgtctctctcttcttcgggttattttactccaatcattccgatctactctttgttaattgggcccttcattaaataatttagcctttcacaaaacacacattaagtgtgcatgacggcccaggcactgtattctctgtcagggttacacagatgaataaagagctgggatgggccaggcgcggtggcttatgcttgtaatcccagcactttgggaagccaaggctggtggatcacgaggtcgggagttcaagaccagcctggccaacatggtgaaaccccgtgtctactaaaaaaaaactacaaaaattagccaggtatggtggcgggtgcctgtaatcccagccatgtgggaggctgaggcaggagaattgctttaacccaggaggcggaggttgcagtgagccaagatcgtgccattgcactctagcctgggtgaaaagagcaagactccgtctcaaaaaaaaaaaaaaaaaaaaaaagagctgggatgatgtagtggttaaaatcagtgttgttagcatagcacagacctaaattgaaatcccagttctgccatttgtcccctgtgtgaccttgcatgggtcactgtacctctctaggcctgtttctgtcttctgtgaaatgatcatgatagcattgttatgcaaattaaacgagagcttaagctgtagagcatttaccaacagtgccctatggcacatgcgcagtagaaagtagttgcaatagtgtgtagcaaatactttgcatcctaggttggattccccagaagcaggccctgagacaaagattcaagtaaaagagatttatttaaaactaatgagaagttgggcagggtggctcacgcctataatcccaacactttgagaggcggaggcaggagggtttcttgagctcaggagtttgagaccaggttgggcaatatagtaagacccaatctctacaaaaaaaattagccagacgtggtggcatgcgcctgtgatccagctacttgggaggcttaggtgggaggatcgcttgggtccaggcttcagtgagctgtgatcgtgccactgtactccagcctgggcaacagagtgagaactgtctcaaaaataaataggccaggcacagtggctcatgcctgtaatctcgacactttgggaggccaaggcgggcagatcacctgaggtcaggagtttgagaccagcctggccaacatggtgaaaccctgtttctactaaaaatacaaaaattagctgggcatagtggcgcatgcctgtaatcccagctactcaggaagcagaggcaggagaatcgcttgaactcaggaggcggagattgcagtgggctgagatcacaccactgcattccagtctgggcaacgagagggagactccgtctcaaaaattgaataaataaataaataaataaataaaagtaatgaggggactgggcatgatggctcacacctgtaatcccagtgctttgggaggccaaggcaggaagattgcttgagtccaggagttccagaccagcctgggcaacatggcaagacatcatttctgcaagaaattaaaaaattagcccagtgagtggagtgcatctatagtaccagctactcagaaggctgaggcaggaggaccacttgagcccaggaggttgagactgcaatgagttatgattgtgccactgcactttagcctgggtgacagagtgagaccctgtcttaaaaaaaaaaaaaagtaatgagggtggggaggagtggaaagggagtgggaaagtgggacccaagcacatgagtggaaccaagctaagtctcatggagggctggggtactgacaccttcatatttgtccaccgttggttaaggtctgggggcgggctgggggagtgggagggtggtggcatgtgaggatgtgggagagaaaaatttccaagtgcttccagctctctgcccctggaaaaggtcccggcagaggcataggcggggctgttgggagtgatttagcactctgggagtccgtaggcacaaaaatggtaaaggggttcaagaagaaatgcgtagaacacagtccctgccccacaaggttcatggcctgggaagggaagacagacatgaataaatcattgccatagggtgactggggtgaagggcgttgggggtcgggtggggtgcgggaaggagtggtgtaggcagaggcatccctgaggagaaatgcagctggtttgggagaggacggccattccagacatagggaacagcacacacgaaggctgatgcacatacgcgcaagggctggtccctagagctggtggttctggccacgagagctcatcacctgggggcagcttttgtacctgcaccctgtatgaggctccgggtctgcccttcctggtccatcctccagacacactgcctgttcttctctcaggtcccgctccgggccctcctcccagaagcctcccctgactagtccagctcaccgtgactcttctgaactcacggcgtttactgccaaggctattacgttggcgctcgctcatgtcattattaggaaatatgcatttttactgtctttgatgttatttaaacttgcctgtaaattctgtctctctcaattttaagttctgagtagaaactacatatttttattatttatattcttatattctcccatggcacccggcattcgtggacacattgaggaagtaagataatgaatgaatgaatgggtgaatccagtccagcttggggcctatttaattctactaggctcaacctacaattcttatgtgttctcagattattcctaaaccctaagcttagttttgtttcattcggaccacatgtagtttttttttgttttttgttttctgagatggggtcttgctctgtcgcccaggctgcagtgcagtggcacgatcttggctcaccgcaacctctgcctcccaggttcaatggattctcctgcctcagcctcctgagaagctgggattacaggcgcccgccaccatgcccagctaatttttttgtatttttagtagagacagggattcaccatgttggtgaggctggtctcgaactcctgacctcaggtaatccacccgcctcagcctcccaaagtgctaggattacaggtgtgagccaccacgcctgatctcatgtgtagttttttggttttttatttgtttgtttttttgagatggagtctcgctctgtcgcccaggctggagtgcagtggcacgatctcggctcactgcaagctccacctcccaggttcacgccattctcctgtctcagcctcccgagtagctgggactacaggcgccggccaccatgcccggctaattttttttgtattttttagtagagactgggtttcaccatgttagccaggatggtctcgatctcctgacctcgtgattcgcccgccttggcctcccgaagtgctgggattacaggcgtgagccaccgcgcctggcctctcatatgtagtttttaatgagagttaccacataagcaaactgggttctaagtggtgaaatttaaggttatgcaacctcagtttcttttaacccctcttcatccctaaccctggtcggatacttgattgacagtagaccattgggatctctgagctcctgtccttctaacctgattgcctctttaaaggattttgaaaaactatgtcccttgcacatttgtattgttttgagacacggtctcactctgttgcccagactggagtgcagtggtgccatcttggctcactatagcctcaacctcccagggtcaagcaatcttcccacctcagcctcctgagtagctgggactacaggtgcgggccaccacatctggctaatttcttaaattttctgtagaaacagttttgccatgttgcctaggctggtctcaaactcctggccacaagcaatccacccgattcggcctcccgaagtgctggtattacaggcatgagccaccttgcccagccccttgcacatttttaagtcaacatttaacatttgtaataatttaatagcattccaaagggtatgcttttcaaggaattgcaaatacatgttaaaaatcacatcactatttatgtatttatttatttatttattatttttgagatggagtctcactctgtctcccaggctggagtgcagtggtgcgatctcggctcactgcaacctctgcctcccaggttcaagcaattctcatgccctagcttcccgagtagctgggatgcccagctaagttttttgtatttttagtagagacagagtttcaccattgtccaggctggtcttgaattgctgacctcaagtgatctgcctacctcagcctcccaaatgctgggattacaggcgtgagccaccatgcctggccatgtcagtttttaaaattaaaaacaatttgttgtgctcagtctgtcggagactgcacgtcactctaagtgtagcaaattgaatataatgccatagaactttcatatctgttagcatccttttaaaaaatacgtgaacaagcccttgaacaagtgttagaaacagttattctatttgtattgcaattattgcagttaaccaaaactaggaatattcacaaggattaaacataaaaagttggtcaggcgcggtggctcgtgcctgtaatctcagcactttgggaggccaagatgggccgatcacttgagctccggagtttgagacaagcccgggcaacacggtaaaaccccatctctaaaaacaaaacaaaactaaactaaacaaatacaaaaaattagtcaggggtggtgcacctgtagtctcagctacgccagaggctgagataggaggattgcttgagcccaggaggttgaagctatacgagccatgatcgtgccactgcactccagcctggatgacagatggagaccctgtctcaaacaaacacacaaaaagacatgaaaagtaacttattgaaaatgcatctcttggccaggcgtggtggtttacacctgtaatcctagcactttgggaggccagggcaagcagatcccatgagatcaggaattcgagaccagcctggccaacatggcaaaatcccatctctactaaaaatagaaaacttatctgggtgtggtggcacacacctgtaatcccagctactcgggaggttgaggcaggagaatcacttgaatccaggaggcgaaggttgcagtgagctgatatctgtcgtgccactgcactccagcctgggcgacagagagataatacgtctcaaaaaaaaaaaaaaagaaaagaaagaaaatgaatctcttaatgagatgggaaaggttgatttgtttcctattgacctttggcggctctgggaagggcactctggtcaggcccaggacaagcaggagattcattctagcggggggcacatattaatctggaaactgattcccttaaaactggtcctgccgacacacccctgggaaggtttgcatataccactaggggtatccaagccataggccattaaacagagatgaaacttgccttcccattctttaatatagtgttctcagaaagggagaaatgtgggcctgaatgttattgtgacttgcatagtgacatttccaaccctcctcctgctaagccccagagccttacatgctggacatgggcaagataggaactcaagttacttccaggtctccgtaagtttaggactgtgaagagggcatcctaatagtcaaaaacataagtgttggccgggcacggtggctcacgcctgtaatcccagccctttgggaggccgaggtgggcagatcacgatgtcaggagttcgagaccagcctggccaacatggtgaaaccccatctctactaaaatacaaaaattagccgggcatggtggtgcgcacctgtaatcccagctactcagaaggctgaggcaggagaatggcttgaacccgggaggcggaggttgcagtgagccgagatcgtgccattgcactccagcctgggcatagagtgagactccgtctaaaaaaaaaagaaagaaaaagaagaaagaggccgggcgctgtggctcacgcgtgtaatcccagcactttgggaggcccaggcgggcagatcacgaggtcaggagatcgagaccactctggctaacacggtgaaaccccgcctctactaaaaaatacaaaaaattagcctggcgtggtggcgggcgcctgtagtcccagctactcgggaggctgaggcagaatagcgtgaacccgggaggcggagcttgcagtgagccgagatcgtgccactgtactccagcctgggcgacagagcgagacttcgtctcaaaaaaagaaaaaaacaaataaataaaaataaataaaaaagaccctaagtgttagttaaagcagcagcctagattcagaattaagaaaacatgatttttatttttccgtttcatggaagcagcagctgtctactgatagttcctgccgccggccaccaggtggcagaagggaacacagtaccatagccctgccccagcgatcgcgcgggcaggaagaccgggtgggaggtaggtgcggccgaggcctggaggcgaggtaggagagtaggcttaggctgtcagaggaaaaaacgggcgatgtgaggactaagtatggatctcaggaggggacaggaaatattgagaacaccaccttacgggttcagaataaaaccgagggaatgaggaagaggtttaaggagacaggctaaattgggaagaattcacggggaatcagagggtggagagggcgtgggtgcctggagatgcctgggaacagaacggctgaggggactccattatctgtactcttcccggggtgggtctaggtctggctcctcctgaggtcggttgtccacctcaggggcaggaggccaggggttttctgggggctggggtcctgccggccaagggtcgtcaggccggggaggttgaggaggatccgttctaggcggttcagggagccagactccagtttcaggcaggtctctccagggacgactggggcgggtaggcggaggatcttcaaagagagggggtgcccctggccaagggtcaccggggactggggggccctgaggcaatgttggggagcctgcctcctctcggtcctctgcgggtgggtgagaggggtggccctcgctgcctgagatgcctgtaaaggaggaaggagaaaggtaagaggtggtgagggcttctctccccagccccacccagccccagccccaggaggaggagcctgtctggatggacgcagcctgaactgacccacaaacagaccaaaaaagtcactctcaaagagctctcggtaggtttgtaaatacttaactgatggtaaaatgtcatgaacccctacccccgatggatctgaaccgttcacttgacccactttaaactgaccagacttctccaaataagctccatccacccctggttggggtaccccactagctttgtcctcaggccaacctgcaacccaaagtgggttacaccttggcccccaggcacacagaccccagctttacaaggaccccagctccttaacacagatcccagctccgaggaaactcgtcccccccacgttaatcctgaccgactttgccacatggagccagcaaaccatttctggtgagagccaaatgcaccttctgcaccatgtcccccacccaatgtgtccagaaagccatttctggtgagccagatgcaccttctgcgtcccctgaattcctgtccccaaccccatgcgtccagttcacctccgccatcttgagtatccctcatcaccccaaactgcagtccctgcctctgttcccacctcacctctggtgtgcaggcaaaggaccaggatccccaggagcttccagttgaggatcatggctatgtactggcccccaaagctggggtgggctgagtctgggtgcctgggaaccccaagaggctttataggggaggagtggaggagggaccagcccagtggcacaggaataccatcagaacagaactggtcaaacccgttgggaaggcctgggctgatgtgtcacccctgaaggtggcgtcccttattttagtcctccagcccaggacccagctgcctgctctccctatcatgacccagagcctgcgtcaccccaccctggttttcacaccctccatccacatcctggagcagtcaatacccacttggcatctccgtaatcacagagatgtccaccttcatcccttgcaactattggaagccaaagaatgggagcaaaccacgcgatgggcgttgggaagcaccgtaattacagggttgggaggcaggatgcctgcgctgagggaggaggtgcttttcaaacctgggatgcagctgggacagtgtcagctactaccccagcctccccactcacccccgcactgaaagctccccctggggcttcgtgctttcctgggcacttcccttcccccatgggatccaggcatcctgctctccaccatgtccttcttcaggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctcccaggttgttccctgcctggtccgctaccccacagtaaggaacaccttattatgcaatggcgtgatctcatctgttccctccagggctcacccagaaaccttcgttacactcctccaccatccacctgcaagcccctccacaccctgtccaaacccagcccatcatcctgagccaccatctcccctgagcctccccaacacccttctaattggcccccttgctcccactgtttatccctccccctcacacaaagcctgtcctccaccagcaaaagaggtcttaaaatatacatcacgcgggcctggtgtggtggctcgcgcctgtaatcccagcactttgggaggccgaagcgggcggatcacctgaggtcgggagttcaagaccagcctgaccaacatggagaaaccccgtctctactaaaaatacaaaaatattagccggacatggtggcacatgcctgtaatcccagctactcaagaggctgaggcaggagaatcgcttgaacccaggaggcagaggttgtggtgagctgagatcacaccattgcactccagcctgggcaacgagtgaaattccgtctcaaaaaaaaaaaacatatatatatatatatatatatcaggccaggcgtagtggctcatgccagcactttgggaagctgacacaggaggaccgcttgagctcaggagttgtgtgcgctgcttcacctgcagcaagactgtgggcaacacgtgggaggcctacctggggctgctgcagtccaagtacgctgatggggacgccctgggcctgaagcgccacagccgctgcctgccgcatgctgctggcccacgtggacctgatgcggaaactgctcaattatgccctcctggggaagtgacctggttagacccacccatctgctgcgctgggtgccgggagcaatcgctgaccacagtgcgtggatatgtgtacctcactctggaagggaccatccagtaagtccctcaggaaaaaaaatgtacaccaaatcatgttgcgtcttccctttgtttggggagtgaggacaggttctcgctctcttaggctggggtgcagtggtgcgatcacagctcattgcagcctcaacctcttgggctcaaacaatcctcccaactcagcctctggagtaactaggaccatgggtgcacgccaccatgccctccaatgttttttatttttattttttatatagatggagtctccctatgttggctggtctcaaactcctgggctcaagcgatccgctcacctcggcctcccaaaaaagtgctgggattcagctactccggaggctgaggcaggagaattgcttgaacctgggaggtggaggttgcagtgagctgagattgtgccactgcactccagcctggcaacaagagcaaaactgtctcaaaaaaaaaaagtgctgggattacaggcaggagccacaacaccgggcccccttccctgtttttttttttttttttttaattcttcttctttttttgaggctgagtctcgctctgtcacccaggctggagtgcagtggcatgatcacggctcactgcaacctccacctcccgtgtccaagcaattctcctgtgtcagcctcctgagtagctgggactacaggctcacaccaccacacctggctaattttttgtattttagtagagacgaagtttcaccatgttgcccaggctggtctcaaactcctgagctcaggtgatccgcgtgcctcagcctcccaaagtgtcaggattacaggcgtgagccaccacacctggctttcttccccgtttttaaagaagtactccaatggctttctattgacttacagtaaaatccaaacttggccacatctcggcctcgcagcagcatccttgagcattctctacagagacctcctggcctccacaggagcccacttcaggcaggcctctgcacaaggtcccctgctcagaggcctctccccagagtcagtttctatcatatcatcgtactgtactttctcttcaagcacttatttgaaacgatctcgttcatctgtttaggtcccatctgctcgctcgctctcccactaggatgtaggctctcagggtccaagtggcccccaggctaatacagtgcctagctctgacattcctgttgaacgagtgaatgtttcatcttccccactcctagcatttatcatcttccagaagaaaagagttttaaaacaaaagttgagaataaagaaaagcaggagcttcccaaacatttccaaagctgcctagaaaaaggatttgaaaaggtgccacccatagagagagctatgggtgggaccacttctcacaatctccaagagagatggctgcagggagaattcccacagattcccagaaataacatttccaaacaatggctccttctgtagtcgtctttatttagagcagaattcagactcagctggtatcccccagggcaaccccaggatggggaagggctggtctgtccccacccacttctccaggatcctcccagcccccaggctggctttccctccaactgtcagctgcttagctgctcatctggggattggagctggagcatctgtcaaggttgtctccttgacaaacagcttcctctttggaaatggcttcactcaggtcctgcaggtcatcgagcaggacagagagggaccctgggaaggaagacagcagatgagcaccagacaagggaaggtgctcgtggttacagaggaaacagggctggcacaggaaatgaggaatgggagagaggaggctctttggtccaagctgggcatcgctaaaagaggctaagggcctcgaaggaccgcagagaacaacactcatcatgcgagagtctgaagaggagattcctgaagtgcgcgcatttgtcccttgtccctttgtgcttggcccaagaccttttatggactccctggtgggcactgctgctgctacaggtgcagatgctgaacactctggaggcctggggctggacaccacagatttcttcttatccagtagggaaggaagaactgtcaacagtcgctgctgcttgtaacgggagaggagaccttcctgctgcaaggtggcctgggaaggagagggttaaacctagcccggatagagcctccctcaccatcctctttccacacctctagcccaggaaccagcccaggatgggccctagtgtctgcctgtctgccctcctgtctcctaccagcatgaggttcttatccctctctagctcctgcaagcgccgggccagtcgctgcccctcctccttccgggcctcctcctgcagacgcctgagttcctggctccgctccttttcctgggcggctctgcgctgaatctggcgtaaggagaccactacagagaggccaaggcacagaggaggcaggtgtgagtcaggccagaggcagccaggcaccatgaagacaggaacaaacgctgggtcaccaactctgtggcttggggaggctgttctgctctgtggatctgtctcttctgtacagttggaggggtgggctgatgctctaggagcctgggaatctgaacctaagtatcttcctcatccctgaaccatcctggagttcctcaggggaaatctgaacatgaactgggttagattttgtgcaattagtgttcactgtcttaaagtgtgatgattgcagctatataggagaatttactggctttgggagatgcggctgaacaacttatgtttacaacttacttaggcgtggtggctcacgcctataatcccagcactttgggatgccaaggcgggcggatcacgaggttaggagctcgagaccatcctggccaacatggtgtaatcccgtctctactgcaaatacaaaaactagctgggcatggtggtgggcgcctgtaatcccagctacttgggaggctgagccaggagaatggcttgaacccgggaggcagaggtcacagtgagccaagatcatgccactgcactccagctggtgacagaggaagactctgtctcaaacaacaacaacaacaaaacattaaatgattacaacttaaagtgattcaaaagatgtacaaatatgtgtgtatatagataagagaccaaatgtggcaaatgttaactgctatatttagttagagaagatacattcattacacaattctttttttgacacatggtctttctctatcacccaggcttgagtgcagtggcacaatcttggctcactgcagcctcgacctcccgggttcatgtagtcttcccacatcagcctcacaagtaagcttggggtacaggtgcccaccaccaggcctagctaatttttgtatttttagtcgagacagggtttcgccatgttgtccaggctggcctcaaactcctgacctcaggtgatacacccacctcggcctcccaaagtgcttggattacaggcataagccaccgcgaccggccatatgctgtttcttaatctggtgctggctacatgggtgtgttcacgatgtgataattcatctgtgctactcctggataccttcattacttcctgtaatgaagctttgaacacactttgaggggaaaataataaccttatgtcttaacacttccttcttcctggaaggccctatccaccctggcaaggctcaccggccttggcatgctccctccgagcctcgttcagcctcctctctgtgtctgagagttgctcccgcagccgagtttccacttcagccaccttttcttgcagggctggggtgaaagtgcagacggggcatatcagcaggagctttgattcgcagttcccaccccaccctccaagggaagcacccatttccctctcgacaccttgcccgtagagttcctgctgctgggtcagctcctgccgcagactggcagcctcctctgtgctctcctgctggccctggcgtgctacctccagctgcagccccaagctagccagggactcctgggtctgctgcagctcctgctccagctgctgggccaccttgctcagctgctgccgctctgcctcccctaaaaggagggggtgctgggtcaggcctctcccagcaccctagacaccgggtttttcctcatcctctccaccccctggcaaccaggtgtaccttgctcccgagcccggcccacctcctgctggatgaggcgggcactcagctgcagttctgcatccaggcggttccgttcttcccgcaactgctgcaactcaaggctcacgtctgtgaccggtggtggtaggggacagctgggacggggaagagaaagagtcagaagaaatcacccagctgcctgatcccaaagcccccatcccacctcagtcctcatggttttgggggtcccagcagccaatgccctaaagccccatccacctcaaagtgcccaaacttcacctctcctggcgcagctgagcaagggcaagctttcgagcaatcaggcctggaggggaaaaagcagggagaaaaagagatgaagtttgcatgggagaaagtggggacagggagtaagggaaaaagagatgcaaggactggtgaaaggaggaaggtgaatggatgtgggatcagagagagctgggtcaggaagaagaaagtccgagctggtggggtgggggcaggacgtggctcgcagttgtcctacgcaccccgaatggtgtggaccttgcggacagcatagctgagtcggttgttgaggctgggaagctgggcggcagccccttccaccttagccatggtggtctcgagccagatctgagagctggagagggcacaagtcactgatcctccatgcctcccctcattcccaaaggacttgctgtgccttgtatagacaactccctctaatcctgtcccattatacaagtacagaacgcacagcttccgtcaattatctaaaggacccttgccccaagaatgcattaaatgactatctttttaagcaacctgttaagcttatttctcacaactgtgttttgctcactatcgtgtatcaaagagtaaagttatcctctctgatcaggggcagtggctcctgcctgtaatcccagcactttgggaggccgaggcgggcggatcacctgaagtcaggaattggagactagcctggccaacatggtgaaactctctctacttaaaaacacaaaaattagccgggcatggtggctcatgcctgtaatcccagctactccagaagctgaggcacgagaatcacttgaacctaggaggtggaggttccagtgagccaagatcgcacccctgccctcaagactgggtgacagagcgagactccatctcaaaaaaacaaaagaaaacaaagttatcctctccaagcccaggagtgtcgatctagcaccaatgacgggcaggtccacatgctttaccagctggctgtgccagaagtaggaccaacctggctcatgaaaactgagcagcttaaacaggccccaggaggaggccaaggagtgtctggggccgggctggggtttcctcaggagagtccaggtctgcacccacagaaaaacacatgatgatgaaggcttgcagctgcatccccagcagcacagcaaagttcactttgatctggaaattgttccagtagatgcttccaacacctaccacagcccttattaaagtctccaattacctagagacaatctaataaacccagcaacaatcagagtttggactgctttaagcctggaggactttcggcaaatgcatcattacacagaccatttctgtgatcgcctggtaccaaagtcaaaccctgtccacagtgcatctttctgttctcctggaggtagggggcacccgcgatggattgaacctgggtggtaggtcattataactagtttaattccgtgcaagtttgaaatttttcataatttttaaagctaaattagtccctaaggtacaaatccaagagaaggaagtgatgggcaaggactcatcctgcatcttaatttcgctaaaccaaaaattatctttatctaaattaacccatcaagaagagcctcacgataacaataaacatttacaagccagagactgtgctaagaactacctgccggccaggcacggtggctcaagcctgtaatcccagcactttgggaggccgaggcgggcggatcacgaggtcagaagtttgagaccagcctggccaacacagtgaaaccctgtctctactaaaaatacaaaaaagtagccgggtgtggtggtgtgcacctgtaatcccagctactcaggaggctgaggcaggaaaatcgtgtgaacccgggaggcagaggttgcagtgagctgagatcgtgccattgcactccagcctgggtgacagtgcgagactctgtctcaaaaaaaaaaaaaaaaaaaaaaagaactacctgccttgggtacctcagtgtctaaggctgaggggaagtcatcaccagcacaaagaagctttgctgttttcttagaggtttttctgaaggtcatacaacaattgtaggtaatgaaacaactaggaagttggtaggagagacaaaggctggcaattgatttagaaggaaactaactggcttacattttagatggaatagtaagcaagttaagtatataataagcaagtaagtatatagctttaaataaatagactaggccaggtgcagtggctcacacctataattccagcactttgggaggctgaggtgggtggatcacctgaggtcaggagttcaagaccagcctggccaacatggtgaaaccccgtccctactaaaaatgcaaaaattagccgggtgtagtggaggacactggtggaggatgcctgtaatccagctactcgggaggctgaggcaggagaatcacttgaaccagggaggtgaggttgcagtgagccaagattgcgccattgcactccagcctgggtgacagagcgagactttgtctcaaaataaataaataaatagactaaatttttctccagtgaaacggattgcccgtaaaattttagaaaaaaaaaggaagatgaagtgtctacactctccatccttgaacaatactgcaagtaaagatcctcccgggtgctctatttagctcaagccattactagactgaactgcaggaggaagcaaggcctcacctccagccaaacatgcaacgggaaattcataacaagcaatcaggtatgaatgcagaaggggcttccccaggaaaagaaacgaacacaggaacattgatagagctaaatctgcccagccctgtagcctccagtggccactttccagcccctcttgcctgaggatcctcagcaacaaggtgcccaggaacctgaggtggcagaaacactactccacccacccctccatccctgatacctgctgacagcattgaccacaagcctcagctgctcctcggctgaggctgtctgctgctgccaccgacgcctggcctcctgagcacggctcagctccaactgcaggccctggggaggatgcagcaaaggacagggtccctccctaagtcctggctgcagccccggaacaggggctcccttgccctccccgagtctctagtaggctgacaccaaccttggcacccatacgctccacctccacctctgcggctttgtcctgcagggatcgctgcaggatggcctgctcctggctctgggatgtcactttttcctggagtgaggccacctgggggaggagagagagctaggcagggccctctagagctaaaagatgaggggggcactggaagcaaagtggcaggtgcagagatctctgtaagaatgccatgcaggggctggggggagggggggcgggcgacgggggtgggttgcagcacggtggctcacacctgtaatcccagcactttgggaggccgaggcagatggatcacttgaggtcaggggttcaagatcagcctgaccaacatggtgaaagcctgtctctactaaaaatacaaaaattagctgagcgtgatggcatgtgcctgtaatcccagctactcgggaggctgaggcaggagaatcacttgaacctgggaggcggaggttgcagtgagctgagatcaggccactgcactccagcctggtgacaagaacaagactccttctcaaaaaaaaaaaaaaaaaaaaaagaaaagaaaaagaatgaatgccacgcagggagacagaagcttaggttctgaggatggaatctgagcccagtgttccatgttccacattccatgtgcccactcaaagatgggaatagcccttgacccaccccacaagacccaccaactgaccatgccactctcctcagatgctgtcacctcctcagagaggctgtctctgagcatcctacctgaggctgactcaccccacagtctctccgtcacattatcttttgaatttttcttactactttctttttttttgagaaaagatctcgctttgtcacccaggctagagtgcagtgatgggatcacagttcactgtggcctcgcctcgacctcccagcctcaggtgatcctcccacctcatcctccagagtagctgggactacaggaatgagccactatgaccggctaattttttgtatttttagtagagacgggatttcacatgttgcccaggctggtctcgaactcctgacctccagtgatccacctgcctcggtctcccaaactgttggcattacttgactgggcacggtggctcacacctgtaatcccatcactttgggaggctgaggcaggtgaatcacctgaggtcaggagttcaagaccaaagtgatcgcattataggtgtgagccactgcacctggcttcaatctttctatcgcacatataattacccaacattatctgtttacttgcgtgttctgtgtctctgttctagaatgcaagctccacattttagttttgttcagggctgtgtgcccagcatgtggcaaccactcaataaacactggttgaatggatgccaccttcatggaaggagcaaggtgctgggagggaataccgggagaaaagagagtgca

SEQ ID NO: 376 - DNA, 118233 bp, Homo sapiens
ttccctggcaatacttgtctcagtgatgggctttcttttcttttctttttttttttttttttgagacagaattttgcttttgttgcccaggctggagtgcaatggtgagatcttggctcactgcaacctccgcctcccgggttcaagtgattctcttgtctcagcctcccgagtagctgggattacaggtgcatgccaccacgcctggctaattttcgcattttagtagagatggagtttcatcatattggtcaggctggtctcaaactcctgacctcaggtgatctgcctgccttggcctctgaaagtgctgggattacaggcgtgagccattttgtgcccagcagtgattggctttctatgcagccagcaacaagaccaagatagaactcctggtgtttcagtaacaattcccctggagattatgatttcactggtcaagggtggagcctaggaatcagtattgttaacacgtctctcagataatcctgtccttgctcattaggaaactgcaactctaaaataaacatcaaattttgtcattgtagatctatttaaaattaaaacctcttcagtggctccctgatgtggtttagatttgtgtccctacccaaatctcatgtcaaactgtaatccccagtgttggaagagggtgtcagtttccaatctgagctggggtccaagaggagttggtggatgggtggcgggtagctgaaaaaacactctagggagtataggcagttgggacatggccttattatctctctctctcctacagagtcagcagagcagttatattttcacagacaatagtggctcaaagccaggtatgagctcacacaaacaggatacatcaaaatggctacataaatgtgattacatactgcatgcaattgtgcacctgtggtcccaacctgctgtcatgctgtactggatgtctgcctcagcccactcctgactgaagcacagccattttccttacagaggggcctggtggaaggtgattggatcatggaggcatatttccctctttctgttctcgtgatagtgatttctcacaagatctggtagtttaaaagtgtgtagcccctccccctgctctctcttcctcctgctccggccacataagatgtgcctccttccttttcaccttccgccaatgattgtaagtttcctaaggcctctccagccagcttcctgtacagcccacagaactgtaagccaattaaacctcttttcttataaattacccagtttcaggtatttatttatagccgtgagagaacaaactaatacagaaaattggtactggaaagtaggggcattgctgtaaagatacctgaatatatggaagcagctttggaattgggtaatgggcagaggttggaatggtttggagggctcggaagaagacagaaagttgagaggaagtttggaacttcctagagacttgttaaattgtgacctaaatgctgaaagtgatctggacaatgaagtccaggctgaggtggtctcagatggagatgaggaacttattgggaactggagtaaaggtcactcttgctatgctttagcaaagacactggagctttgatccagtgccctagagatctgtggagctttgaacttgagagagatgatatagggtatctggtggaagaaatttctaggcagcaaagcattagagatgtggtctggctgcttctaatagtgtatgcttatacgcgtgaataaagagttgatctacaactggaacttatatttaaaaggcaagcagagcatgaaagtgtggaaaatttgcagcctggccatgtggtagaaaagaaaaacccttgggaggccgaggcgggtggattacttgaggtcaggagttagagaccagcctggacaatgtggtaaaactaaaaatacaaaaattagccggacatgttggcacatgcctatagtcccacctacttgggagggtgaggcaggagaatcgcttgaacctggagggcggaggttgcagtgagccaagatcacgccattgcactccagcctgggcaacaagagggaaactccgtctcgaaagaaaaaaaaaaacaacaaaaaacaaaacccattttcaggacgggaattcaagctagctatagaaatttgcagaagtaaagaggagccaagtgctaatagctaagacaatgaggaaaaggtctcaaaggcatttcagagaactttgcagcagccccacccagaaaagtgggggcagaggcctaggagggaagaatggttttgcaagccaggcccagggtcctgctgccctgcgccttgcctccccagccatgcttccagtacaacctgtggaacaatgaaccaatgaaacctttctgttttgttgttgttgttgttgctttttgagacggagtctcactctgtcgcccaggctggagtgcaatggcatgatcttggctcactgcaacctccgcctcccaagttcaagtaattctcctgcctcggcctccctcccgaatagcctggataacaggctgtcaggcctctgagctgaagctcagccattataacccctgtgacctgcacatacacatctaggtggcctgcaggagccaagaagtctggagcagcaaaagaaaaaaactacaaagaagtaaaacagcgagttcctgccttaactgattaactaacattacaatattttattattgtgacttgtccctgccctaccttagctgatcaatcaactttgtgacattcttcttctggacaatgagtcttatgatctctccaccatgcaccttgtaaacccctcctctgctaacaatagataaccaccttttgctataattttccattacctacccaactcctataaagcaacccattccctatctcccttcgctgactctcttttcggactcagcccacttgcacccaagtgaataaacagctttattgctcacacaaagcctgtttggtcgtctcttcacacggactcacttgacacaggcgtccaccaccacggtcggctaatttttgtatttttaatagagacagggtttcaccatgttggccaggctggtctcgaactcctgacctcaagtgatccacctgcctcggcctcccaaaatgttgggattataggtgtgagccaccgtgcctggctgaaacctcctttctggtaaattacccagtttcagggtttttttttttttttttgatacggagtctcagtcttgtcacccaggctggagtgcagtggctcaatcttgggtcactgcaacctccgccttctgggttcaagctattctcctgcctcagtctcctgaataggtagcacacgcctgtagttccagctacttgggaggctgaggctggtggattgcttgaacccaggaggtggaggttgcagatgacaccactgcactccagcctgggtaacagtgagagtccatcttaaaaaaaaaaaaaaaaaaaaaaagaaaatttccccaggtgcagccaatgttgagaaccaccagaaataatcaagcctgagctgtttaacctggtgttgaaaacccaaccatgaaagcctcctgcctgccgaaatagccccattttctatgacacttgtgcatatgcacgctacagtccagctttgccagattatcttcaaatagggtcatctaaggatttaaaacattaaattacctgtaattcccaaacctatggtactttcacacatctaggtctttccacagtttattctcactttgtcttgaatacttttactgtcctggcaaacagttattttcccacaaggatgaaactactggctgagcacagtggctcatgtctgtaatcccagcacttggggaggcagaggcaggcggatcacttgaggtcaggagttcaagaccagcctgaccaacatggtgaaacccgtctctacttaaaaatacaaaagttagccgggcatgatggcaggtgcctgtaatcccagctactcaggaggcagaggcaggacaattgcttgaacccgggaggtggaggttgtagtcagccaagattgtgctactgcactccagcctgggcaatagagcaagactctccttttagaggttcctctggcacatgtgctgaggtagagtaaaacacttccttctttgtgctaaactacccctcttggcacagagctgtattactatacttatcatatgaggggctagcaatattatatcttgagtacaggtactatgtctggttcatctttatatcccttgcacctagccgagggtaggaacagagtaggcagccaataaatgctttttggcttagtgaaagcactcacaaggaacaaaattaaaacaagcaggaacattaccctttttataaaaaatctgaatataatctaatcatctaaccacactttttttttttttgtttgtagagacaggtgtctcactatgtttcttaggatggtcttcaactcttggcctcaagtgatccttctgccttggcctcccaaagtgctgggattagaggcatgagtcaccacacttggcccacattaagatcttaattaggaaagaatttttaaggccaggtttgtggctcatgcctgtaatcccagcactttgggaggccaaggcaggtttgagaccagcttggccaacatggtgaaaccctgtctctactaataaaaatacaaaaaattagctgggcgtggtggtgggagcctgtaatccccgctactgaggaggctgaggcagaattgcttgaacccaggaggcagaggttgcagtgagccgagatcacaccattacactccagcctgggcaacaagtgcgagacgccctctcaagaaaaaaaaaaaaaaagaatttttaagctgtaggtctcatgtggagaaatacaccttgaaagcactccaaagagagtaatgagccatttccttaattaactataacgtagttcacatgttcattccaaggccttgaaataatcctgtttcttcatatgtatctgatatggcttggctgtgtccccattcaaaactcattttgaattgtaactcccacaattcccatgtgtcgtgggaggaacctggtggcaggtgattgaattacgggggcaagtctttcctgggctgttctcatgatagtgaatacatctcaagaaatctgatggttttaaaaatgggagtttccctgcacaaactctctctctgcctgctgccacccatgtaagatgtgacttgctccttgcctttcaccatgattgtgaggcctccccagccaggtgaaactgtaagtccgttaaaccttttttactttcgtcttgggtatgtctttatcagcagcatgaaaatagactaatacagtaattttggtaccagaagtggggtgctgctgaaaagatacctgaatatgtggaagtgactttggaactgggaaataggcagaggttggaacaatttggagggtcagaagaagacaggaaaatgtgggacagttttgaatttcctagaaacttgctgaatggctttgatcaaaatgctgataataatatggacaatgaaattcagcatgaagtgctcttagatggagataagaaacttgttgtgaactggagcaaaggtgactcttgttatgttttagcagatctactggtggcattttgcccctgccctagagatctgtggaactttgaacttcagagagatgatttaaggtatctggtggaagaaatttctaagcagcaaagcattcaagaggtgacttgggtgctgttaaaggcattgttatttttatttttattttttgagatggagtcttgctctgtcgctagctggagtgcagtggcacgatctcagctcactgcaacctctgcctcccgggttcaagcatttctcctgcctcagccttctgagtagctgggattacatgagtgcaccaccacacccagctaatttttgtattttttagtggagacagggtttcatcatgttggccaggatggtctcgatctcctgaccttgtgatctgcccaccttggcctcccaaagtgctgagataacaggtgtgagccactgtgcccggttggcattcagttttataagggaagcagagcataaaagttcagaaaatttgcagactgacaatgtgatagaaatgaaaatcctggctgggcatggtggctcacgcctgtaatcccagcactttgggaagccaaggcaggtggattacctgaggttgggagttcaagaccagcctgaccaaaatggagaaaccccatctctactaaaaatagaaaattagccgggcttggtggtgcatgcctctagtcccagccacttgggaggctgaggcaggagaatcacttgaacctgggaggtggaggttgtggtgagctgagtttgcgccactgtactccagcctgggcaacaagagcaaaactccatctcaaaacaaaaaacaaacaaacaaagaaaatcccattttctgaggagaaattcaagctggctgcagaaatttgcataagcaatgaggagctgaatgttaatcaccaagacaatggggaaaatgtcttcagggcatgtcagaggtcttcatcacatccccccgacattcacaggcctggaggtttaagaggaaaaagtggttttgtgggctgggcccagaatccccttgctggttgcagcctgggaacttggtgccctacgtcctagctgctccagccgtgactgaaggggtcaatgtagagcttgggccatggcttcagagcatgtacgcctcaagccttggcagctttcacatggtgtgcacagaagtcaaaattgaggtttgggaacctctgcctagatttcagaggatgcatgaaaatgcctggatatccaggcagaagtttgttgcagggacagggctctcatggagaacctctgctagggcagtgtggaaaagagatgtggggttggagtccccacaaagagtcgctactggggcactgcctagtggagctgagagaagagggccactgtcctccagaccccagaatgatagatccactgatagcttgcactgtgtgcctggaaaaatcgcagacactcaacaccatcctgtgaaagcagccgggagggaagctgggaggtaaagccacaggggtggagctgcccaagaccatgggaacccacctcttgcattagcatgacctggatgtaaaacatggagtcaaaagaggtcattttggagcttttaagatttgactgccccactcaatttcagacttgcatggggcatgtagcccctttgttttggccaatttttctcatttgaaatggctgtatttacccagtgcccatgcccctgttgtagctaggaagtaacttacttgcttttgattttacaggctcatagatggaagtgacttgccttatctcagatgagatgttgaactgtggaggtttgagttaatgctgaaataagactttaggggactgttaggaaggcatgattggttttgaaatctgaggatgtgagatttgggaggggccaggggcagaatgatatggtttggctgtgtccccacccaaatctcattgtgaattgtaactcccacaattcccatatgttgtgggagaaacccagtgggaggtgattgaattatcgggtcaggtctttcctgggctcttctcctgatagtgaatgtgtctcatgagatctgattcttttaaaaacgggagtttccgctgggcatggtggctcatgcctgtaatcccagcactttaggaagctgaggcaggtggatcatgaggtcaagagatcgagaccatcctggccaacatggtgaaactccatctctacaaaaatacaaaaattagctgggcgtggtggcacacgcctgtagtcccagctacctgggaggctgaggcaggagaatcacttgaacccgggaggcagaggttgcagtgagccaagatcccaccactgcactccagcctggtgacagtgcaagactctgtctcaaaaacaaacaaataaacaaacaaacaaacaaaaaacaggagtttccctgcacaagctctctttgcctgccaccatccatgtaagatatgacttgctcctccttgccttttgccatggttgtgaggcctcccagccacgtggaactgtaagtccattaaacctctttttcttcccagtctcggttggatatttctttatcagcagtatgaaaatggactaatatagtatctaagacttaaaaaaaaatttaaggtgaaatcaagacttaaaaaaaaatttaaggtgaaatctacataacacaaaattaaccatttttaaatgtccaatacagtggcatttagtaaattcacaatgttatgcaactacaccacctctatcaagttccaaaatagtttcatcactccccccccaaaaaactctgtatccattaagcagttatttttcattttccccctagaccctggaaaccacaggaacattaacttttaagttattctaaggaattttagagacatagatattaaaacagacagatttcagatggctgtgcaactgcttccagtcatacagaaaagagttttttttcaataatctcaattccaatttttattagccattctatgtacattgataccaagtcctgaaaactgataaaaacatgtccagaatttctttttttccttttctgagaaagggtcttgccctctcacctaggatggagtgtagtggtgcaatcacagctcactgcagcctcagaatctcccagtctcaagtgatcctctcatgtcagtctcctgagtagctgggactacaggcacatgccatcacacccaactaatttttttattttttgtagagatgagggctatgttgcccaggttagtcttgaactcctggactgaagcaatcctcctgcctcagcctcccaaagtgttgggattataggcatgagccacaggacctggcccatggtttcttatacagtcaatgtacaaatgctcatttatattttgcacaataatgaagataaaaataacaattatagcaacatacaaatatgtacaaagattccagacagactttgttttttggcttataacaatgtgtagatactacacaaagaatgaggatgtaattttcatttacaagcaaaatgtgaccaaaatcccttttcttcttaaaattgaaaaatgaaattcttgagaatactaattagtgacggccaaatcttagactattttaaattagccatggttaaacataggtgagttaaacattgtgcctttccaaaattaaggtttgcagttagaaacataaacatttgataaaacttctcaaaattaattatgagtggcttattcatgtcctttggattccagacacacactagaaaaagtaaacgttaaagaggtgatattttggaaagcatccctagtactgaaaagcatccctagcactgaaaaaagcatccctagtactgaaaagcatccctaacactgaaaaaagcatccctagtactgaaaaacatcttcaggagtactcagtactccctagtacatccctagtactgaaaaaagcatccctaatactgaaaagcatccctagtactaaaaaacatcttcaggagtacccagtggtcaaacactagcaggaaactcatgatgcactaacaatactgagaacaaagtgtgggaagtaataagcagctattttactgatgtattaaatatattagaattatgaggcatgagatgatatttatgtgatttttaaaaggtttaaaatattcttagggactcaattagatattgagaatgactgataactatgatctcaaaaacagtatatcacacataatcatggtgttaccttactaataggaatttagtttttaataactaactgaattttattttactggcttcagaagcagctgcctattttgagaactacatgagttaatacgatcatatataattaagttaatgtcacagaaaccaaaatgataatagtttacaaaagaagaaagtgccccatttattgggttgtgacatcaggctgagatggcttagggctggaaagcaaggatgagtgtagcactggggctcaggtacaaatctgtttataaagctcaaggagagaaaaggcacgagaaggggtgagacaactctgaatggcggtggtacctggatgtggaattaccacagtgggccagagacaggatggtatataaccctctggccaggtactatgggaaccaaccccttccttcaatattaaattaagaatacaaatatctcaaagcatgctatcaaaagtagattatttatcctcatattacagaacacagaaggagacatttatttttaaaagagagctaaaaagttatggggtttctccttatttcatcttgaaaactcaaggagcaaacattaaaaaaaattccctatttatatatatatatatattttttgagatggagttttactcttgttgcccaggctggagtgcagtggcgcaaccttggctcaccacaacctccgcttcctgggttcaagcaattctgcctcagcctcccaagtagctgggattacaggcatgcgccaccacacccggctaattttgtatttttagtagagatggggtttctccatgttggtcaggctggtctcgaactcctgacctccggtgatctgcccgccttggcctcccaaagtcctgggattacaggcgtgagccacagcgcctggccggactattagtatttttaaaaggcacttaaaatattcctttccaatccaactcaaaatacatctctgtcaactacattttggataaatattttaaaaagcacataatttttgtgcaattttttcttataacccagtgatatttatcatctatagggctaaaaggtttgaaggacagagctccaactttctgcagaacaatctgaaagtgcttttatcatagaaacaagaacaacattaatgatttgctctttcactgacaacatcctgtagtcgtttcagtaaaacgtcatcattttcttgacagacgcgtttggcaggggattctgcatcactatcgatggctattactcgcttcttggttctctgctcaccttgccttatcatgttgttgatatctttcaaactctgtgcagaaatagagaacgtgtgtgagtaaaagagggagaggggaaatggcagcaaacaaccaagctaattgttttttcctgtgctctatcctctatccaaatcttaacactgggataaggactctttttaaaacttagaacaacctaataagggatggcttgaactaatcttttcaggtggtttaaaaattagatttaaggccaggtgtggtggcctgtaataccagcactttgggaggccaagatggttcaatcacttgagcccaggagtttcagaccagcctgggcaacatggcaaacctggtctctacaaaaaatacaaaaattagccaggtgtggtggcttgtgcctgtagtctcagctactcgggaggttaaggagcatcacctgagcctggggaggttgaagctgcagtgagcagtgatcatgcctgggaaacagagtgagaccttgtctcaaaaaccaaaccaagaatagaaaaataagcttcccgtctccctcctctccctctccctcctctccctccctcctctccctctccctcctctccctctccctctccccacggtctccctctccctctctttccacggtctccccctgatgccgagccaaagctggactgtactgctgccatctcggctcactgcaacctccctgcctgattctcctgcctcagcctgccgagtgcctgcgattgcaggcacgcgccgccacgcctgactggttttcgtatttttttggtggagatggggtttcgctgtgttggccgggccggtctccagctcctaaccgcgagtgatccgccagcctcggcctcccgaggtgccgggatggcagacggagtcgcgtttactcagtgctcaatggtgcccaggctggagtgcagtggcgtgatctcggctcgctacaacctccacttcccagctgcctgccttggccccgcaaagtgccgagattgcagactctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcaatgtggggagcgcctctgccctgctgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtcttcgcctggcagccaccccgtctgggagggaggtgggggtcagccccccacccggccagccgccccgtccagaagggaggtgggggggttagccccccgcccggccagccgccccatccaggagggaggtgggggggtcatccctctgcccagccagctgcccgtccgggagggaggtggggggggtcagcccccccgcccggccagccgccccgtccgggaggtgaggggcgcctctgcccggccgcccctactgggaagtgaggagcccctctgcccggccagccgccccgtccaggaaggatgtgggggggtcagccccgggcccggccagccgccacatccgggaggtgaggggcgcctctgcccggccgcccctactgggaagagaggagcccctctgcccggccagccgccccgtccgggagggaggcggggaggtcagccccccgcccggccagccgccccgtccaggagggaggcgggggggtcagccccccgcccggccagccgccccgtccgggaggtgaggggcgcctctgcctggccgcccctactgggacgtgaggagcccctctgcccggccagccgccccgtccaggagggaggtgggggggtcagccccccgcccggccagccgccccatccgggaggtgaggggcgcctctgcccggccgcccctactgggaagagaggagcccctctgcctggccagccgccccatccgggagggaggtggggggggtcagccccccacccggccagccgccccatccgggagggaggcggggaggtcagccccccgcctggccagtcgccctgtcccggagggaggcgggggggtcagccccccgcccggccagccgccccgtccgggaggtgaggggcgcctctgcccggccgcccctgcccggccgcccctactgggaagtgaggagcccctctgcccggccaccaccccgtctgggaggtgtactcaacagctcattgagaaccggccatgatgacaatggcggttttgtggaatagaaaggggggaaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctatgtccactcagggttgaatggattaagggtggtgcaagatgtgctttgttaaacagatgcttgaaggcagcatgctcgttaagagtcatcaccactccctaatctcaagtacccagggacacaaacactgcggaaggctgcagggtcctctgcctaggaaaaccagagacctttgttcacttatctgctgaccttccctccactattgtcctgtgaccctgccaaatccccctctgcgagaaacacccaagaatgatcaataaaaaagaaaaaaaatggaaaaaaaaaaaaaaagaaaaataagcttcccattatgcaagagtcctatggcctttgtgctttcctaccctgtgaactaagagtctaaatctgtgaaaagatgtccatgaggtagagttgaattaaaatagcaggttgcagaacaataaaaaaaaaaaaaaaaaaaaaaaacaaaccaaaccaatccaaaccaaaacaactgaatttactgtataacagtagctctcgatgtgtagtacccagaccagaagcagcagaagcatctagaattttttattttttgagacagtctctctctgttgcccaggctggagtgcagggcatgatcttggctcactgcaagctctgcctcctgggctcaagctattctcctgcctcagcctccctagctgggactacaggcacatgccaccatgcctggctatttttttgtctttttagtagagacagggttttgccatgttggccaggctggtcttgaactcctggcctcaagtgttcccccaccttgggctcccaaaatgctagaattacaggtgtgagccaccgtgcctagccttatctgttttttttttttttttttttttttgagactaagtcttgctcttgtcgcccaggctggagtgcaatggcacgatctcggctcactgcaacctctgcctcctgggttcaagcgattctcctgcctcagcctcccaagtagctgggattacaggtgcccaccaccatgcccggctaatttttgtatttttagagacggggtttcaccatgttggccaggctggtcttgaactcctgatctcgtgatctgcctgcctcggcctcccaaagtgctgggattacaggcatgagccaccgtgcccggccctaatctgttttaacaagccctcccaatgattttaaagctccctacagtttgagatcttcttccttagagtaatgattttcaacattttttttttttgagacagagtctcgttctgtcgcccaggctggagtgcaaaggggtgatctcggctcactgcaacctccgcctgccgggttcaagtgattctcctgcctcagcctccacagcagagtagctgagattataggtgcgcaccaccatgcctggctaattttttgtatttttagtaaagacggggtttcaccatgttgcccaggctggtcttgaactcctgagctcaggcaatctgcccgccttggcctcccaaagtgctaggattacaggcttgagtcactgtgtccagtcaggtatattatcttagccaactttgtcaagtatagtaggaactctgtagttatctgtataactgaataggaaagtaataagaaggagccactgtatttggacagagttacaatctgccccactacaatttcttccagtttatactgattctgacttctggagacatactgaacatatctgcttgatagtccatgaagtctctgaaaacagcaatcatgtccataccacatcttcaccactgaacaaggataaggatggagatgatcacagagttgtctatgtacgtaagaggaggcttgtgttttcagacatcttcctatcctgggtgccatctaccaaatgcactttcacttccaatgcctttctttcaacttgacatcccccaggtctgaccacttgcaggtgttgccttactggtcccttctcaagatcttgcttgaacaggaaaacatgctggactttcaaagtgaactccacaaataccatgtcaataataatggattaaactacctcaaactgaatatactgctcttgatgagaggagacatgccatagttaacatttcatattttattagtatagtagtaacttggccaaaaaagaaaaaaaaaaaaagaggcaggattaacagttactgactgttaatctgaaatccaacttttagcctattcaccttaccttagaagggctgccattgaacttgtacagcagagcgcttcttggtgtaaggcctgacccattcttgtgcggggaaatataaatggagtgctgctgggaaatgcggcgtggtgagcctggctgttgtttaatatgtggaaaaggagagagtggtggagcatccatctaaaataacccaaaagtcagattttttagataaaagtttttctttgtttttgaatcccatatttttattcttatggtatcttctagttagaaaacagttatactgtaaaaagctcatttatggttgagaaaaaaaatgatcctttacttcttcttttttttttttaacaacaatagataaactagaatttattttcctgaatctttttttttttttgagatggagtatctcttgctcttgttgcccaggctggagtgcgatggcgcaatctaggctcactgcaacctctgcctcccaggttcaagcaattctcctccctcagcctcccaagtagctgggattacaggcatgtgctgggattacaggcatgtgccaccacgcccggttaattttgtatttttaatagagatgaccatgttggccaggctggtctcgaactcctgacctcaggtgatccacccaccttggcctcccaaagtgctgggattacaggtgtgagccactatgcccggcctattttcctggatctttcaggaagtcctataactagtattaagaattctggccaggcacagtggctcacacctgtaatgccagcactttgggaggctgagatgggcggatcacctgaggtcaggagtttgagaccagcctggccaacatggtgaaactccgtctccactaaaaatgcaaaaattagctgggcgtggtggcatatgcctgtaatccgagctatttgggaggctgaggcactagaattgcttgaacccaggaggcagaggtgttgcagtgagcccagattgtgccactgcactccatcctgggtgacagaccaagactctgcctcaaaaaaaaaaaaaaaaaaaaaagaattctggggccgggtgcagtggctcactcctataatcccagcactttgggaggccaaggtgctcggatcacttgaggccaggaattggagaccagcctggccaacatggtgaaaccccacttcagcctcctgagtagctcctaaaaatataaaaattagccaggtgtggtggcgtgcgcctatagtccctgccactcgggaggctgagcatgacagttgtttgaacccggggacagaggctgcagtgagctgcgattatgtcactgcactcctcctggggtgacagagtgagactctgtctcaaaagaaaaaaaaaattctggacaagacaccaggagttaagccacgagcatgagaacctcatattcatgcttaaaaagtaaggacaggctgggcgcggtggctcatgcctgtaatcccaacactttgggaggctgaggcgggtggatcatgaggtcaggagttcaagaccagcctggccaagatggtgaaactctgtctctactaaaaatacgaaaatcagctgggcgtggtgacaggcgcctgtaatgccagctactcaggaggctgagttacagaattgcctgaacccaggaggcagaggttgcagtgagctgagattgtgccacttgcactccagcctgggcaacagagcgagactccttctcaaaaaaaaaaaaaaaaagtagggacaaagagtaaccaatcttctaacacttgctgtaacaagctctctctacacacatacctgctcacaaccaaagcagtagcagagagaataaaagaggcagagaattctattagccagcaggatgattccaacgtggaaaaaatctgttaatgaaatgggaaagacttcatatggaaatggaaaagatttataaataagttggatgagcaaggatttcatttttaatatcctgtataatggaaataaattaagatggtagagatattccgagtatagcacatgacagaggggaagtgaaactgaagcaggatgaacagttatgacctctgaggatagtcatagaccatattccatgaaaagaggaagaacagaaatctacagaggcacatagatacatagaaacagctattggctgtccggctgcagcttctgctagggccttcttttcttttttttttttctttctttttttttttttttttttgaggcagggtcttgctctgttgcccagactggagtgtggtggtgcgattgtggctcattgcagccttgacctcctgggcccaagcgatccacctaccttagcttgctgagtagttgggactaaaggtgtgtaccagccactacacggctagtttttagtttttttttttaagagacagggtcttcctgtgtttctaggctggtctcaaatttctgggctcaagcaatcctccaggcttagcttcccaaagtgctgggattacaggcatgagccacagcacctgacctccttttgttttttttttgagacagagtttccctcttgtcacccaggctggagtgcagtggcgcgatctctgctcactgcaacctccgctttctgggttcaagtgattctcctgcctcagcctcccgagtagctgggattacaggtgcctgccaccacgcccagctaatttttggtagagatgggatttcaccatgttggccaggctggtctcaaactcctgacctctggtgatccgcccgcctaggcctcccaaagtgctgagattacaggcatgagccaccacacctggccccttttgtctttgacttgagaaaaacattaatctcacaatataacaacagaaaaatttaccaaatttgctgggtgcagtggctcatgcctgtaatcccagcactctgggaggccgaggtgggcggatcacaaggtcaggagttcaagaccagcctggccaacatggtgaaaccctgtctctactaaagatacaaaaaattagccaggtgtggtgacacactcctgtaatcctagctactagggaggctgaggcaggagaatcacttgagcccgggaggcagaggttgcagttgagctgagatcgcaccactgcacgccagcctgggtgacagggtgagactgtctcaaaaaaaaaaaaaaaaagaaaacaaaaaaaacaaattagttgttttaatattcatgttcccatcaagttcttacccatatgtatacggaatttctagcaacataatcatggtatagataaaattcatgccaggcgtggtggttcacacctgtgatcccatcactttaggaggctgaggtgggtagattgcttgagtccaggagttcaagaccagcctggccaacatggtgaaaccccgtatctactaaaaatacaaaaaaattagctaggcgtgggggcatgtggctgtcgtaccagctatttgggaggctggggtgggaggatcgcttgaggcctggaagcaagggttgcagtgagcccagatctcgccactgcactctagcctgggcaacagatcccatgatttcctctggtctctgttgtaccatagccttaatcactgattaagttactggacatgctctgattaattgctagtaattttacttggacatatttatctagcaaaataaacttatagtaatccaactatgacagcaaataataataaagtagtaaaacatagaacataccatatggtcctgattcgccaagtcgtatttcagtgcaaatgacttcactcttcctacatatattgtattgtaaaattttataagatcacctctttcctctttcactggtccactggaacagtcaggtgtttttgtagcatcttctaagtctgttaaaaagaatgcaatgttgtgatacaaagcatactttttatttttttgagacagggtctcactttgtcacccagggtggagtgcagtggtgcaatcttggctcactgcagccctgacctcctggattcaagtgatcctcccatctcagcctcctgagtagctgggaccacaggcacgtgccaccatgcctggctattttttatttttagtagagacggggttttgccatgttgcccaggatggtttccaactcctgggctcaagtgatccaccagcctcagcctctcaaagtgctgggattacaggcatgagccaccatgcccagccacaaagcatactttaatatacaagttggtgatttaaatgacctttctacaatattaaaaaaaacccacaaatctttatgtagagaaattaatattttcagagaaggttcagcaatccatctgtattacttataagtcaaattggaatctagagaaatgcaaacatatgaactgaaggtggtgctcttttctctagattccacttcagaatgttttcacaaccatagctgttgagctcactgtcactagtggctcttagaggggtaacagccctgggctggtgtttagctaagttctacagtatgggaggcagtggcaaacctcagcttcagacaactaaaaggcctgcagatattcttcttgtgtctttgagaaaggtggaaagattctaaaaggtaaagcatatcctgagaggttaaggaagaagcaaaatgaattacatttatttctctgcaaatacatggcaggtgacaggtgttctaagagccttattgtaccacatacaacaggaaccctgatcaggaaccagtgttcaggttttactgagcaccctcaattgtaaaataacagcttaccccaacatagtttcctacttaatggtgcaactctgggatagcttgtgaaaccaggcagaactttgtcctactattttttggggaaggaagagtattacagggtattacaaactatcatttacttgtatacacaagaaccatgtgctaagaaaaccactaccaattaaaaagaatttagcacatatatgaaaaaagctctcattctcaatacactggcctacaaacattgagaacatgggtagaagcaatgccttcaccttaggaaaaccagaaaacacaaacatggttcaaaaaccaaacagccccaggggatgtcagtcttaatttggatgtctttttcacttctgctatttctaaaggatcttgacgagggtgggaggggaggggagctatgtggttaaataaagttgaggaaatgctgtatattatattggaaattcagaaattcatgttagtataaggctctgagaagtactgcagttggggaaaaaaaataactctcatgttcactttaattccatacttccccagttttttgtgtatagtctctcttcccccaaaacactttttttttttttgagacggagtcttgctctgtcacccagcctggagtgcagtggtgcaatctcggctcactgcagtctctgcccgctgggatccagcgactctcctgcctcagcctcctgggtagctgggattacagaagcatgccaccacgtctggctaatttttgtattttcagtagagatggtgtttcgccagctggaaaggctggtctcgaactcctgacctcaggtgatctgcccgccttggcctcccaaagtgctgggattacaggcgtgagccactgcgcctggaccccccaaaacacttatactaccattctgggaaacactgtttcaaaggatactggcttgttaacagctcttctaggttattctcattatatggatcaattaaaattatttttttgttttgtttttatgaaaggttcttgatcctcttgcctcagtctcccgagtagctgggactacaggtgcacgctgccacaccgagctaatttttttttactttttgtagagacagggtctccctatgttttctaggctggtctctaactcctgggctcaagtgatcctcccaccttggcctctcaaagtgctgggattacagacatgagcgaacacgcctggtctaaaattatttaatgtcctccttagattagaaatttcttgagacagagactatagtgtctctatatttctgtgtcattccaattccagctgttaatactaacataaggtaaggagctatactttacttgaatgaaccaaacatttaaaattgtgggaggctgggtgtggtgaaaccctgtctctataaaaatttttttaaaaattaaagaaatttaaaaactaggtgtggtggcatgcacctttagccctagctacttgggaggctgagatgacaggatcgcttgaacccaggaaatcaaggttgcagtgagctatgattgccccattacattccagcctgggcaacagagcaagatctcatctctaaaattaaaaaaaaactgaagaaaaaaaagacatttaaaaaaacatacttggccgggtatggtggctcatgcctgtaattccagcactttgggaggctgaggtgggaggatcacttgagcccaagagttcaagaccagtctgggcaacacagtgagaccccatctcggtctcccaaagtgctgggattacaggtgtgagccaccatgtccggccagaaatgggtttttactgatgaaaatagtgaatgtttattaagtgtgactaatgctaaaaaagccatactcattaatacaataaatttgatattgcttataaataatagctattactaaggccttactatgaacaagccctgtattaaatattatatatatgcatatatgtatacatagttgtgtattgcataatgatgggttatcttctcagaaatgcattgttgaaatgattttgtcatgagaatactatagaatatacttacacaaacctagattgtatggccaactacacacctaggctggatggtatagtatattgctcctaaggtacaaacctgtacagcatgttactgtattgaataccacaggcaattgtatcacaatggcaagtatttgtgcatctaaatatatctaaacatagaaaaggtacagtaaaaatacagcactataatcttataggaccactgttgtatgtgtggaccatcacggactcaaacatcattatatggcacatgactatgtgtgtgtgtgtgtgtgtgtgtgtgtgtccacacatacatacatatacatataattatcttttttatttttagagacaagatcttgctctatcacccaggctgaagtgcagtggtgcaatcatagtgcactccaatctcaaattcctggattcaagtgatcttcctgcctcagcctcccaagtagttgggactacaggtgtgagccaccatgcccagctaattttttattttcattttttgcagacaggggtcttgctgtgttgctcatgctggtctttaatttccgggctcaagggatcctcctgcctcagccttccaaagtgctgggattacaggcatgagccacaacactcagcctaaatataattctttttaatccttaaaacaagtttctaaggaagcaatgtaaagttttcaattaactacaatacacttgagtacagtgttatgtttgtgttacttaggttaagctataacctgggtctcacaagtattctaatcaagactgccactctggagcagtctgctaacatgacattgaagaattcacagcccatgaggagtgagctggtgttttaatcaggaaattcattctccactccaacagtttctgctaggcatatctcagtcaatgaccaatgctttgctcattaacatactcaaggtcagaatttttttttttttttttttgagaaagagtcttgctctgttgcctaggctggagtgcagtggcacaatctcagctcactgcaacctcagcccccagggttcaagcaattctcttgcctcagcctccgaagtggcagggattacaagtgcttaccaccatgcctggctaatttttgtatttttagtaaagatggggtttcaccatgtcggcaagactggtctcaaactcctgacctcaagtgatctgcccgcctcggtctcccaaagtgctgggattacaggtgtgagccaccatgtacagccagaaatgggtttttactgatgaaaataatgaatgtttattaagtgtgactaatgctaaaaatgagctcatgttcaggaaatcaaaagtatttaagataagcagattggttaaaatatttgactccctctcccactccctctccccacggtctccctctccctctctttccacggtctccctctgatgccgagccgaagctggactgtactgctgccatctcggctcactgcaacctccctgcctcagcctgcccagtgcctgcgattgcaggcgcgcgctgtcacgcctgactggttttcgtatttttttggtggagacggggtttcgctgtgttggctgggccggtctccagctcctaaccgcgagtgatccgccagcctcggcctgccgaggtgccgggattgcagacggagtctggttcactcagtgctcaatggtgcccaggctggagtgcagtggcgtgatctcggctcgctacaacctccacctcccagccgcctggccttggcctcccaaagtgccgagattgcagcctctgcccggccgccaccccgtctgggaagtgaggagcgtctctgcctggccgcccatcgtctgggatgtgaggagcccctctgcctggctgcccagtctggaaaatgaggagcatctctgcccggccgccatcccatctaggaagtgaggagcgcctcttcccggccgccatcccatctacgaagtgaggagcgtctctgcccggccgcccatcgtctgagatgtggggagcgcctctgccccgccgccccgtctgggatgtgaggagcgcctctacccggccgcgaccccgtctgggaggtgaggagcgtctctgcccagccgccccgtctgagaagtgaggagcccctccgcccagcagccaccccgtctgggaagtgaggagcgtctccgcccggcagccaccccgtccgggagggaggtgggggtcaacccccgccaggccagccgccccgtccgggagggaggtgggggggtcagccccccgcctggccagccacccagtccgggagggaggtgggggggtcagccccctgcccggccagccaccccgtcagggaggtgaggggcgcctctgcctggccgcccctactgggaagtgaggagcccctctgcccggccagccgccccgtccgggagggaggtggggggttcagcccccccgccagccagccgccccgtccgggagggaggtgggggggtcagccccccgcccggccagtcaccccgttggggaggtgaggggcgcctctgccctgctgcccctaccgggaagtgaggagcccctctgcccggccaccaccccgtctgggaggtgtacccaacagctcattgagaacaggccatgatgagaatggcggttttgtggaatagaaaggggggaaaggtggggaaaagatttgagaaatcggatggttgccgtgtctgtgtagaaagaggtagacatgggagacttctcattttgttctgtactaagaaaaattattctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaaaagtcatcaccactccctaatctcaagtaccccgggacacaaacactgcggaaggccgcagggtcctctgcctaggaaaaccagagacctttgttcacttgtttatctgctgaccttccctccactattgtcctatgaccctgccaaatctccctctgcgagaaacacccaagaatgatcaataaaaaaaaaaaaaaaaaaaatttgagacactaccctcaatagccatgaaagggatgaaagatccagtgaagtctctcagctttactcttagggataataatgttaaggctaaaagctctgagaagtcctgtgtccagccctgaattctgatccacggtatttgcttgatggtagccttaaggttgactgaatcctgcatctgaaatcttggcacctgttcttgagcaaatcttttctatgggtgctggtcagacatagaactgggatatatgaacttactgcataggatatataaattgtgtgtgtgctttttaaacagtaattattttacaactcataatgaatttgtttatagaaccagaactgtttttcccaagttggtgttctttggtgtgtccaaatctgggtcatagcatctaaccatagctctaagaactggaaggtgacttatctgaatatagacttgtctgactgtatatcctcctacataactttctctcttttttttttttttttttgagacagggtcttgctctgtctggagtacagcggcaagatcatggctcactgcagccttgacatcctgggctcaagccaacctcccaattcagcctcctgagtagcttggactacagaagcccaccaccatgtgtggctattttaaaaaattttttgtagcaataggctgtcactatgttacccacaatggtcttgaactcctgggttcaagccaccctcctggcttggcctcccaaagtgctgggattgtagatgtaagccactgtgttctctctttttgagtgccagaattcctgagttcattatcactggatattctccctgccctgtgccaccaccactgtacaggatctgtaacaatggttgtttgcttacttgctaataaatatatctagttaataaccgtatgtaaggcagtgtgcggtgactcacgcctgtaatcccagcactttgggaggccaaggcagatggatcacttgaacccaggagttcaagactggccttggcaacatggtgaaaccccatctctacaaaaaatataaaaattagccaggacgtggctgagtcgagaatcactcgggcctgggaggtcaaggctgcagtgagctgtgactgtgccactgtactccagcctgggtgacagagcaagacatggtctcaaaacaaacaaacaaaaggtcaggtgcagtggctgacgcctgtaatcccagcactttgggaggccaaggcgggtggaatacctgagatcaggagttcaagaccagcctggccaacatagcaaaaccccatctctactaaaaatacaaaaattagctgggcctggtggcaggtgcctgtaatcccagctactcgggaggctgaggcaggagaatcacttgaacctgggaggcggaggttgcagtgagccgagatcgcaccattgcactccagcctgggcaacaagagtgagactgtatctcaaaaaaaaaaaaaaaaaaaagaaagaaagaaagaaattgtgtagcagaatttgatctgaaacctatatatacaggaagtggcaaactctcagtcacccaagtttctttggcagatacttatcaaaaagaaaacaaaacagaaaacgacatcgtctattatcttttgcttacttctactctctggaacttcactgctcttgtagctcagatacttgctagcagttagtttctcatagaaaaaacacaaaacaggcaagtgatccacagctttctagctaacctctgatgtctggttttgtaggaacagaaaaaccaccctggataggtaagcaacatgtataacaaatatagaaaatggctttttttgttgttgttttttttttttgagatggagtctcactctgtcgcccagggtagagtgcagtggcgcgatctccgctcactgcaagctccacctcctgggctcatgcccttctcctacctcagcctctggagcagctgggactacaggcgcccgccaccacgcccggagaattttttgtatttttagtggagacgaggtttcaccgtgttagccaggatggtctggatctcctgacctcatgatccacctgcctcggcctcccaaagtgctgggattacaggcgtgagccaccgcacccgggcttgtttgtttttttgagatagagtctagctctgtcgcccagactggagtgcagtggcaggatcttggctcactgcaacctctgccgcccaagttcaagtgattctcctgcctcagcctcctgagtagctgggattacaggtgtctgccactgcacctggtaatttttgtagttttagtagagacgggtttcaccatcttggccaggctggtcttgaactcctgattttgtgatccacccgcctcggcctcccaaagtactggattacaggcgtgagccaccgtgcccagcggtttttttttttttttttttttcttgagatggagtctcacgctgtcacccaggctggagtgcagtggtgtgatcttggctcactgcaacctctgcctcctgggttcaagcaattcttgtgcctcagcctcctaagtagctgggattacaggtgctcaccaccatgcccagctaatttttgtatttttagtagagacaaggtttcgccatgttggccaggctggtctcgaactcctgacctcagatgatccacccaccttggcctcccaaagtgctgggattacaggtgtgagccaccacacccggctagggttactgtcttatatactcctcgttgccttgaaaaggctccagaataatacacttatgtaaaaagaattgagtttggcctattatcctcaaacggagtcagattctaggacattattaaaagatctttttggtgaatgaaatcttaaaagtttatatcccagtggacaccataatgattatggatatttttataatttaaaaatttgctttaattcatcagattttctcttaagaatttatcctaaggatgtggcctaaagattaagctacaaatgatgctcatcacagagctgtgcataattagaagcaacctggccaggcatggtggcttacacctgtcatcccagcactttgggaggccatggtagggagactgcttgagcccaggagttggagaccagcctgggcaacatggcaaaatcccacctctacaaaaaattagttgggtgtggcacaagactgagatgaaaggagcaccggaggtcagggctgcagtgagccatgattgtgccactgcatgcctgcctgggtaacagagtaagatcctgtctcagaaaagaaaagaaaagaaaaaataaaagagaaaggagggcaggggagggggagaggagggggatggggatgggaagaagagaggaaaggagaggagaggagaggggagaggagagaagacgagacgagacgagacaagacgagacaagaaaaggagaaatgacctaaatgtctcacactgtggcattaaagaaatcacagtacctaggcttagcacagtggctcatgcctgtaatcctagtactttgggaggccaaggtgggcggatcacttgagctcacgatttcgagaccagcctgagcaaacatggcaaaatcccgtctctacaaaaaatataaaaattcgccagggtgatggtgcatgcctgcagttccagctactcgggaggctgaggtggaaggattgattgagcctgggatgtccatgctgcagtgagtcatgatcataccactgcacttcagtgtaggtgacagaacaaaaccctatctcaaaaaaaaaaaatcatagtatatacacatgtatatattacatacacctgaaatacatggaaagatgagacaagggaaaggaggtaggcagaagaggtgtatgaatactaaccatttgatttttctttctttgaaaaaaaaagattactagtgcctgaagtcttagcatgatggtggcaagagggtgcagtcttgcctgtggtagcagaattacctataagtaatacttatatgaacaggacattttcttgtgtgtgtgtgtgtgtgtgtgtgtgtgtgtgacagagtctcactttgccgccaggctggagtgcagtggcgtgatctcagctcactgcaacctccgcctcctggtttcaagcgattctcctgcctcaggctcctgagtagctgggactacaggcgtataccaccacacctagctaatttttgtattttttttttaagtagagatggggtttcaccatgttggccaggatggccttgatctcttgaactcgtgatccacccgccttggcctcccaaagtgctggaattacaggtgtgagccaccatgcccagccgggacattttcttaacagactcctcgggaagattactgtcagctaccttgttttccctgtcattcagattttagaattttattaagtctcttttacgtgtttcattaacatgtataagtagactagaaaacttcttccaaaacacaattaacaggggacaaattaatggtttcaataaactataccagcacattctaatctcaaacttatttgttttcaaaacatatgcattgtccacctcacctccttatgattcacatttccatgttgtctgacacccactgtattatgtacagtgtgatccaatgtgttttacatataatatgttaaattggataacttaccacaatctatcatttcaaagtcatcatttatatttttattatatgccacaacttctcttggaatacttttcagcagaacacttctatatacctacatgccagaggggaagaaaaggacagctcagtcacagaggtacaggttaaacaaaatcaaagtgagaagagcaaaatatcaaaccaattaaaaactatttgtctgtataagtgatactcaagggtaaaatgttattagctctagtaagtatagattataacacataccataaaagaggggatactggagaagagcctaccatctaagatgggcttagtttataaaacagaagaaatagcaactaaagactgatgatcaggttttactaaatgaaagcaactttaaagacctgaatttggtcaggtgcagtggctcacacctgtaatcccagcactttgggaggctgaggtgggtggatcacttgaggccaggcgttcaagaccagctggccaacatggtgaaagcccatctctactaaaaatacaaaaattatctgggtgtggtagcgcacagttgtaattccagctactagggaggctgaggcagaactgcttgaactcagtgggtggaggttgcattgagctgagatcgcaccactgcactccagcctggacaacagagcaagactctgctcaaatacaaaacaaaataaaacaaacaaacaaaaaacaaaagacctgaattaattcctccttcttcttaattccttacacaacaatcaattggtcttttttttctttttttttttagagacagggtctcactctatggctcagactggagtgcagtggcacaatcatggctcactgtagccttgacctcctgggctcaggcaatctgtctgccttggcctccttaactggtgggattacaggcgtgagccactgcgcctggaccagagtcatttgttcttaatgcagcttgtttttctgcccccagcccattcccatctcctttcagatggccacatgaaaatcttttcccttccctgcccctaaactatttctcacctctgagatagctggaaaggcatgatccattcccccttgtactgtattataggttactggtattaagaagatattcagggaaccatggcttggcccattcttgactcacactaacctcaccttaatgatcttcaaggacaatctagagctttctaggctctgttcctgagggattttcctgaagaagcccagaaactcttagcttatcacaggatataacaaatacctgtacttggttcttcaaatgtctctatattgcttgctataatgtattttagggcttaaacaaagctctcttagaaggggatataactactaatactgaggccacatctctattttggtctgcagtctaggccactacctctctctttctgtctacaatttccagggccagagaagaggccattatgcttcctaagagcagagcaactaggttcttgaatgatcaaacccttaaggtaatttacttgtgttcttcaggtacaataataacaacaatatgacatgaacattcattaaatgcttattgtgtgccagtccactctgctaccatgactgaaaggtttcatggaattttcaccacggtcagaacaatataatcagaaatgtttaacatctattcaaagatgcaaacattaggatgcttagcagatggcaaaagaagctgtagttaggttaatgaatcctcaaatttcactgggtttaaatatcattaaaaaataaagtcatataattaaagaatattattattattatacataacttttttttttttttttttgagacagagtctcgctctgtcggccaggctggagtgcagtggaatgctcttggctcaccgcaacctctgcctcctgggctcaatcaattctcctgcctcagcctcccgagtagcagggattataggcgtgtgacaccacgcctggctaatttttgtatttttagtagagacagggttttaccatattggccaggctggtctcgaactcctgacctcaggtaatccacctgcctccacctcccaaagtgctgggattacaggcgtgagacaccgcacccagccattatacatatctttcattaaatgaacaaatggaatggcagaacttatgagaagtatatgaaagtatatggatgagtcggaaacagtcagacttcctggcttctattgaaactgtccttcaatgaaattatctcttgagtttaatgttatccattaaaacagaaaatctgaagtatattaaaactataaaataagtttaccttttatataacttgtcagtggaaaagagtaaatctatttttggacagtaggaaaaataatgtaactcacgtgactattagcttggggctgattcctataacttttcataatttcttgaaaagttctttcttcttttgttacctaaggaaaataaaaaccgcatttatcaactgctttttgaaagaaaaatggctctgaacaaaacttcaattataagttggcactgagagcaaccttgcagaaaaccattaaccccaggccagtccatgactaaaaaccactaacatttatgattttttctacctttaaagttcaggctttgtggcctgtggggactcacttaatagtttcattaatcaaaaagcagtgaaactgctatggtgtgactctactgaaaatccatttctttatataaaaaaagatataagaaaactcagatctgtttaattccctgcagtctccagttttattaatttttaagtacttacttaaaagtaaattaaccacatacgaaggattaaaaatatcttacagtgatgattctcaatcaaactgagtggctattacaggattaggttttaacatttcaggacagactgtagggtttctaatgcttagacagaagtcacagtggtggccaaaaggaagaaaatggattagtgatccaaaaaggaattccttctgggatctctgtgatcataaacttcacttaagtcactcttttcccctgcttcactgtccattagtgctaaacctgttctctataatgatgagctagaaatggcaaagcctgaactctaacagtcttctggaaaacacacgattagttagtaacatttatcttttaattttttaattcttttttttttttttgagatagagtctcagtctgtcatccaggctggagtgcagtggcatgatcttggctcactgcaacctctgcctcccggtttcaagtgattctcctgcctcagcctcccgagtagctaggactacaggcgcgtgccaccatgcccagctaatttttgtatttttagtagagacagcgtttcactgtgttagccaggatggtcttgatctcctgacctcgtgatctgcctgccttggcctcccaaagtgctgggattacaggcatgagcctgcgcccggcccttcaggttgagttttctaactgcaacttcatcattctgcaaatcagcaagatacacttcaaacacatgactcttgaagctatcagatgcaatttggttccttgagtcctggtaactagtgtctttccagtatttcttgtattgaacatagtcggtgcttttttacatcaaaccaatctttcttaaaaaatgaatcaaccattttcttctttgctccctttttgttgccttttgtatggtgcattttctcgtcaaccaccatagtgctgcagtaacaattattaagacctattttttacagagatttcaaagaggcattgtgggaggaggggtcacaaaggagtttaaaaacatatgctctgtctcaaaaagctgaaaaatcaagtcttaactgtatacatctgctaggactgccagtgtggccagtacagtcaagacaaatgattgtatcagatatatgagaattttaaaaaacaagcaagatatgttattccatgacttaaaacacgttgtagcaactagaaagtaaaatgctcttctgaggcagcacaataaatcacgagaaagcaatatgcgatatggtacagaaacttttatttttcttgagacagggtcttgctctattgcccaggctgaggtacagtgtcatgatctcggctcactgcagccttggcctcctgggctcaagagatcctcccacctcagtctcccaagtagctgggcctataggtgcaagccacaatgcccagctgatttttatattttttatagagatgaggtttcaccatgttgcccaagctggtctcgaaatcctgggctcaagctatctgctcaccttgacctccgaaagtgctaggattatacgtgtgagccaccatgcccagcctcttctcccaatttatacattacctttgccatgatataaaaggcacaaaggaggagctgatccaaatgcctgtctttcattagatcaggacagtgaactaaagtgaattcaaaacacgtccatatcttccttcgtaactcatttgaaacatccagttttagacatagatcacgtaagcgtacacttgccaaatgatagacctaaaatagaaggtaacacattgatgcaaaacaccaagtaaatcatttctcaaatttttatgtcttaccaagaccaagattaaaaaacataggctgttgatatactaaattaaataaaatttctgttctatagcactagttcactgctatggcaggaggatatagattaaagcaaaactacttgaaaaaattttttaaagatgtcatctattactctatgctgccaactatgtaaagtaagaaaaaatgaaatataggatttacctgcatcatgacaattatgaacatataatttttccttttttttttttcttaggtggattctcgctctgtcacccaggctggagtgcagtggcacaatcttggctcactgcaacctctgccttctgcattcaagcaattctcctgcctcagcctcccgagtaactgggcttacaggtgcatgccaccacgcctagctaaatttttgtatttttagtagagacagggcttcatcatgttggccaggctggtctttaactcttgacctcaagtaatccatgcactgcagcctcccaaagtactgggattacaggtgtgagccactgtgcccggctcgaatgcataatttttcaaagctcagaagtctctgtctattctctttgggttcaggtaaaattgctagggggtctaacatgccaaataataaatgaaatatttgactccaaaaatgagtcagaaagcaaaaccatttaaaaaattgctcctatattctacactttttaggagcacaatgggaacgaaacaggaatgttaaaataagtaagatacaaagttgttgttttttttaaagcctgtgaaaataaattcagttcaattccctggccctagatcctgcaagattgtttttttattttaagacttgataaccgtgatgtggtattcctaaaccagactattctattcaaactatttttttttttttttttttgagacggagtctcactctgtagcctaagttggagtgcagtggcatgatcttggctcactgcaacctccacctccgggctcaagtgatgcttgtgtctcagcctcccgagtagctgggactacaggcaagtgccaccacgcctggctaatttttttttttttgtatttgagtagagatggggtttcaccatgttgcctagggtggtctcgaactcctgagctcaggtgatctgctggcctcggcctcccaaagtgctgggattacaggcatgagtcactgcgcctggcccaaactatgtctttaaatttccagatggaaaaaaaaagttaccccttacagaaaattatctttggcagaaaaatacctacaaaccgagcttaaaaactaatttaagctactcagtgatctaatataaagagagacaaacagttgactccaaagccaccagtgatttattttacagcaaacaaattttctgcatcctctccccttgtttctggtccagccatgctcagtaaatagtagggtaagagcagagagaaagatgctagaactttatattcatgaaaggagaagataagatatatagtcctagctagaataattaaaaataatatgtagttaagtaatacttggtaaagtatcttttacagagctgatccaatgcttacaggatacacatacgctggaaggcttttgattctaacattcacagtaaattctatttaggcatagaacaccagcatcacactgagttcagcatagataatcgttataatttactcaatgaatggttattttgaatttattatagattcagacatttcagttccttttatattttctagcttctaatctatgagcaggttataattaaatgaaaggaaaaggatgttagattctaaaacaacattcaaaataaagaattcaccaaaaagtcttatttctgtcaaacttaggttaattatcagaggcaataatttgccattttgaaaattaaaaatggtaagtaaatggggaaactgctatattttcaagctctgttgttaaaacagtccttaggcataggagggggtgaagggacagaggagagaagccagtaaaggtggtgaaaagagcaagactctccctcaaccatcccaactgccaaccaaagcagctctgctttcatatattttgtttatacttctgaagactatttcattcaaagaagggatttccctaaaagatgaaattccttggagaatcagttgctccaaaacccacaatgtaatgaaaataaatgagctataattgaaaggaacagaagacaaagaatggttgtagaagctataaatgagttgttttccagtgtctgtctcctcttctgcaataacagaacccttaacatttacacccaccttcctgtaataaagactatatttgcccctttgaaaattctgcctgggcacggtggctcacatctgtaatcccagcacattgggagggtgaggtggacggactggttgagtccaggagtttgaaaccatcctaagcaacatagcgaaaccccttctctacaaaaaattaaaaaataagctgggtgtggtagcctgtgcctatagtcccagctactcaggaggctgaggtgagaggatcgcttgagcccgggaggttgaggctgcagtgagccatgatcttgccactgcacccctgcacgggtgacagagcaagaccttgtctccaaaaagaaaaaaaaaaacattctacaagtggctatatgactaagtgggaaataaacagcattggtgtatgtaacttctaggacaggttctgaaggtgaggaggcatgctctttttctttctgctggctagaatgcagatatgatatctggaagggaagcagtcatcatggactgagttagaaaccttgtgttgaaaatggccaaaaaaaccttgaagggacctgggttttttttttttttgagatggagtcttgctctgtcacccaggctggagtgcggtggcgtgatctcggctcactgcaacctccgcctcccaggttcacgccattctcctgcttcagcctcccgagtagctaggactacaggtgcctgctaccatgcctgggtaatttttttgtattttaagtagagatggggtttcaccatgttagccaggatggtctcgaactcctgacctcatgatccgcccgtcttggcctcccaaagtgctaggattataggcgtgagccaccgacctggccaggacctgggttcttaatggtcgtggtaaccacagcagtcccatactatttacacagactttatgtgaaagataaattctcttgtttaagctactattattttcaaacagctaaactgaaatctaagaaataaatagataatcactatgcccgaggtcagaaaacacattagaggtactgtgaaagaaataggatttgatataaaaatgtaaaaaataatcctcatgttttatcttaatgtaaaattatctaattcagagtgtgggctgagaccttccatgacatcaagtgacaaaagaatggagaaaaacatgattgaggaagagtataaattaaagaagatttatttagcatagagaaaaaaggacatataaaaaattattgccgggcgcagtggctcatgcctgtaatcccagcactttgagaggccaagacgggtggatcacgaggtcagaagttcaagatcagcctggccaagatgatgaaatcccatctctactaaaaatacaaaaattagccgggtgtggtggcacacacatgtaatcccagctactcaggaggctgaggcaggagaattgcttgaacccgggcggcagaggttgcagtgagccaagatcgtgccactgcactccagcctgggtgacagagcaagactccatctcaaaaaaaaaaaaaattattaggctgggcgcagtggctcacacctgtaatactagtactttgggaggctgaggtggtggatcactaggtcaggagatcgagactgttctggccaacgtggtgaaaccctgtctctactaaaaataaaaaaattagctgggcatggtggtgcgtccctgtaatcccagctactcgggaggctgaggcagagaattgcttgaactagggagtcagaggttgcagtgagctgagattgcaccactgcactccagcctggtgacagagtgagactccatcttaaaaaaaaacaacaaaaaaaaacaacaaaaaaaaaccaaaaaattattacaagaacaattagttgggcatggtggctcacacctgttgtaatcccagcactttgggaggctgaggtgggaggatcgcttgagcccaggagttcaagatgaacctgggaaacacagcgagactccatttctaccaaaaaaaaaaaaaatttagctgggtggggtggtgcatgcctgtggtcctactactcaggaggcaggaggatctcttgagcttgggaggtagactgcagtgagacatgatcgtgcctatgcactctagtctgggcgacagagcaagaccctgtctcaaaataataataaaaaaagaatgattagtagagaaatacacttaaatttgcctgtagacccaggtactcggagggtaatgaaagaggatcacttgagcctaggagtttgggctctagcgtgctataactgtgcctgtgaatagtcactgtactccaacctgggcaatagaatgggctagccaaccatctagctgtgggatgcactgcagtcatgtttggttataaatatctgattaacatgtctatcttatcagaagctgatgattcaaaatgtgctcgtaagagataggacaaattcaagttatgtctaaggtcaaccgtttttagtccctttccattaatattaaaataatttaggcattataataagaactggtcatatgctaatttaaagggtaacacattagatttattttatttatttttgagttttggagacgggatcttactctgttgcttgggctggagtgtagtagcaccttcttagctcactgcagcctcgaaatcatgggctcatgttatcctcccacttcagcctcctgagtagctgggactacaggcatgggccactatgctggctaattttttaattttttggtagagactgggtctcgctatgttgcccaggctggtcttgaactgcaagcctcaagtaaccctcctggcttggcctctgaaaatactgagattacaggcataagccaccatgcctggcctagatttataataaaaattatgagtaacagctgggcatggtggcgcatgcctgtaatcccagcactttgggaggctgtggtgggcagatcacctgaggtcaggagtttgagaccaggctggccaatatggtgaaaccacgtctctactaaaaatacaaaaattagccaggtgtggtggtggacacctatagtcccagctacttgggagggtgaggcaggtgaatcgcttgaacctgggagacagaagctgtagtgagccgagatcacgctactgcattccagcttggtagacagagtaagactgtctcaaaaataaataaataaataatggcttgggtggtgactcacacagtaatcccagtgctttgggaggtcaaagagggaggatcacttgaacccaggagttcaaggctacagtgtgccatgatcatgccactgcactgtagcttgggtaacagagcaagaccttgtctctaaaaataataataataaaaaatatatagccttctcacagtatcccagcaatctttagaatgattcttcgctaattaaaattcacccatgagatccaacatgtatttgtcccacagtgaactccattctacggcaacataacacaaaagagtttcagtaaattccagaggctggccaactacttactcaaagttagaaaagaatacaagctggcaaaaaacataagttagatctgaaaacagaatcaaaccctgtgagcctgagtctaaacttatagctcaccaggatcataatgttctcttgaaaggtcaaatgtattttttaagtggctaaaggtacattacttgatagcaaagccagacaaagaaagcataagaaaaaatacagaccactatctcttacgaatattggcgcaaaaatcctcaactaaatactagtaaaacaaattcaacagcatatgaagagggttatacaccatgaccaagtagaacttatttttagaaggtaaggataatttaaaacaaggaaatcattcagtataacacaccatattaaaaggacaaagggaaaatggccacataatcatttcaagtgatacaggaaagcatttgacaaaatttaacaccctttcatgataaaaatactcaaaaagctaggaagagaaggaaactacctaaacataataaaggatatacagtaatcccttggtatacacaggagatttcttccaggagcccctgcatatacctgaatgtatgcatactcaagtcctgcatttggccctgtagaatccccatgtacaaaaagatggccctctatatacacaggtttcacatccctcaaatactgtattttcattctgtgttggctgaaaaaaatctgtatataagtggacttgtacagtgcaaaaacatgttgttcaagggtcaactgtatataaaaaacccacagttaacatcatactcaaattgaaaacctgaaaggtgttcctctaagatcaggagtaagacaaggatgtttgctttcaccacttttattcaacatagaacgggaattcctagctagagcaataaggcaggaaaaagaaatccaaattgcaaagaaagaagtaaaattatctttgttcacagatgacataatcttgtgtatggaaaactcaaaaaacctaaagaatccataaaaactgatagaattaataaacaaatcagcaaagctgcaagaaaatcaatacaacaacatctcttgtgttcctttacattaatgaacaatctaaaaaatgaaattaagacaattctacttacttattacttacaatagcatcaaaaagaatacttaggaataatcttaagcaaggacttgtcttgcaaaagacatatacagaaaactacaaaatgttgctgaaagaaattaaagaagacgcaaatgaaaagacatcctatgatcatggactggaagacttgacattcttaagatgtcaacactagccaatgcgatctccatattcaatgcaatctctgtcaaaattccacaatgtttttgcagaaagagaaaaatccatcctaaaactcatacagactctcaagaaatcttaaatagctaaaacaatcttaagaaagaaaaacaaagttggaggtctcacacctcctgattttaaaacttatgacacaaagctatggttatcaaaacagtgtggtactgaatacagatagacatatagtccaatgaatagaatagagagcccagaattaaacccccatatctatgctcaagtgacttttcaacaaggattctaagctcattcaatgggaaagggcagtctttcaacaaatcgtgctgggaaaaatggatatccatgtgcaaaagaatgactttagacccttatctaacaccatatacaaaaattaaaatgggctgggcgtggtggctcacggctgtaatcccagcactttgggaggctgaggtgggcagatcacttaagctcacgagttgagaccagcctgggcaacatggtgaaaccccgtctctacaaaaaagttcaaaaacaggcccggcgtggtggctcacacctgtaatcccagcactttgggaggccaaggtgggtggatcacctgaggtcagtagtttgaaaccagccaaaccagcacggtgaaacctcgtctctactaaaaatacaaaaattagccaggcgtggtggcatattcctgtagtcccagctactcaggaggctgagaaaggagaattgcttgaacccgggaggcaggggttgcagtgagccgagattgcgctactgcactccagcctgggcaacagagtgagactctgtctcaaaaaaaaaaaaaacaaaaacaaaaaacccaaaaaacgaaaattagctgggcatggtggcacatgcctgtagtcctagctgctcagagggtcgaggtgggaggatcatctgaacctgggaggcggaggctgcagtgagctgtgactgcgtgactgcactccagcctgggtgataaagtgagactctgtctcaaaaaaaaatagacataataaatataagagctaaaaactataaaactcttagacgaaaacataggggaaaagttttataatactggatttggcaatgatttcttgtgtatgacaccaaaagcacagacaaaaaatgaaaagaataaattgactttattaagattaaaaactttcatgtgtcaagaacactatcaacggaatgaaaaggcaacccacagaatgggagaaaatacttgtaaatagtatattttataggagattaatatctagaatacataaagaactcctacaatttaacaaaaacaaaacccaaaactcataattaaaaaaatgggcaaaagactcgaatagacatttctataatgaagatatatagatgggcaaaagcacatgaaaagatactcaatattactaatcattagggaaatgaaaattgaaactatagtaagatgtctctttatacccattggatggccattatcaaaaaaacaaacaaaccagaaaacacgaaacgttggcaacgatgagaagaacttggaacacttgtgccttgctagtggtaatgtaaaatggtccacccactgtggaaaatggtacggtggttcctcagaaaatgaaatactaaattactctcccatttctgggaatatacccaaaggaattgaaagcagagacttgaatagatatttgttgctatttttttttcttcttaagacagggcctcgttctgttgcccaggctggagcgcagtggtgtgatctcgactcactgtagcctcaacctcctgggctcatgtgatcctcccacctcagcctccaaaatagccaagactataggcatctgccaccatacctggctgcttttttttttttttttttttaaaatagagatagggtctcactgtgtcgcccagggtggtctcaaacccctgggttcaagtgatcctcctgcctcggcctcataaagtgctgggtttacaggcatgagcaaccacgcctggtttgaacagacacctgtacacaaatgttcatagcagcataactcacaatagccaaaaggtagaagcaacccaaatgcccatcagcagatgaatgaataaacaaaatgtggtattaaaaaaaagtatattcatatgatggaatattttttcttttgttctttttttctcttcttcatacaatggaatattattcagccttgaaaaggaaggaaattctggcacaagctataatatgaatgaacctagaagacattacgctaagccagtcacaaaaacaaacaaatatcgtatgacttcactcataggaagaacctagagtagtcaaattcacagaaacagaaagtagaatagtagttgccagaagctggggaaagggagaaatggatacagaatttcagaatgggaagacgaaaaagttctggagatagacggtagtaataaagctgcacaacaatgtgaatgtatttaataccattgaactgtacacttaaaaatggttaaaatggtaaattttgtgttatgtatattagaaaaaaaaaagaccaaagtctgtctctgttactcaatctttcttccattgattaaacaaattcttctaaagtgctataaaaacacatacctttctgtaaaatagtgctaaggacccagttctctttggcctgtttattccagttgaatgtacctcttgtgctttagtcagattggtctgttttggagaagcaccaattaatgaatgagcagtaagtgatacaggactcttgactttggactcctgatttgtattcatggaaagaggtatcagtgtgatctctccagcatcatttgcgacacctgaatgtataagcattattagaaataatctgcatatgttctaggaaagttgtcaactatatatattttgacaattatatatacatatatctgtgtgtataagaaggctacaaaatagtaattctaggttatgactgaattctttttttttttttttttgagacagggtctcacttggtcactcaggctggagtgcagtggcgccatctcagctcactgtggcctcgacctcctgggctcaagtgatcctcccatttcaacccccgcaaatagctgagactacaggtgcaagccactatgcctggtaaattttttttttttttttttgagatggagtcttgctctgtcgcccaggctggagtgcagtggcgtgatctcggctcactgcaacctctgcctcccgggttcaattctcctgccttagcctcctgagtagctggaactacaggcacatgctaccacacccggctaatttttaaaatatttttagtagacacagggtttcaccatgttagccaggatggtctcgatctcctgacctcatgatctgccctcctcggcctcccaaagtgctgggattacaggagtgagctactgtgcccggcttgtattttttttttagagatgggagttttgccatgttgcccaggttagtctcgaactcgtcagctcaagccatctgcctgccttggcctcccaaaatgctaggattacaggcatgagccactgcagctggactttttttttttttttttgagacagtctcactctgtcacccaggtgggagtgcagtggcctcatcttggctcactgagacctctgcctcccaggttcaagcaattctcctgcctcagcctcctgaatagttgggactacaggcatgcgccaccacacccggctaatgttttttctctatttttagtagagacggggtttcaccacgttggccaggctggtctcaaactcctgacctcaagtgatccacctgcctcagcctcccaaagtgctgggattataggtgtgagccactgtgcctggcgccccccgggcccccttttttttttctttttctttttttttttgacaatgtcttgctctgttgtcctggctggagtacagtagcgtgatcatggctcactgtagcctcaaattcctgggctcaagtgattctcctgcctcagcctcctaagtagctgggaccataggcatacatcaccatgcccagctaatttaattttttgtagagataggatattgctatgttgcccagtctgggtctcaaactcctgggctaaagtgatcctcttgccttggtctcccaaagtgctgggattacaggtgaaagctaccatgccccgcataaatccttattttctagaaacaagaatattcggttttgtttttatactttaaatttatggaaaaaaaagcaaattttgttctctattttgtatttgcctgggatacatttatagtttaaatttattggaaaaaaaagcatttttttttttaacattttgagcacttgagctgttagtcaaaaaacagaatttttgctcaatacatacatattggaaagctcagataagaacattttaaaagtagtttgagacctgggcaacatggtaaaacctcatctgtaccacaaatagaaaaaattagctgggagtggtggcacttgcctgtggtcccagctactcaggaggctgaggtgggacgatcacttgagcctgggagcagaggttgcagtgagatgagatcatgctgctgtactccaatgtgggtgacagagtgagatcctgtctcaaaaaataaaaaaagaagaaaagaaaaagtaaaataagtctaaacaaacagagagggtagtaaatttataaaatttaaaaataaaaaaaaaaccactataggttcaaaacaaaaaggtggggcacagaggatttatagggcagtgaaactactctgtatggagctatagtgacagatacatgtcattatacgttctcaaaatcaataaactattcaccaagagtgaaccctaatgtaaactatgggcattgggtaatgtgtcagtaatgtaggttcatcaactgtaacaaatgtagcattctggtgtggaatactgataatgagggaggctttatatgcctctggttggggaagggggactatgagaaatgtctgtaccttcctctgaattttgctgtgaatctacaactgctctaaaaaattcaaatctatttaaaaaaaaaaagtataggttcaagaaaaaataatgagttagaaaaaccatgtgatctaatccactaagacatttcttaaatttttatctcagaaaaagtacaaaacaaatgcactataacgttaccatgtaatggaattgtaactttatgtcctgttgttcctgttactggggctgtggccattgttagaagagtttgaccaggtaaaattgatacattttcagcagtaatgcttgaagaaggagcgattttcaattttgttccttctgttatgatcttgtccataagcatttcctttggggggtcctctccaaagagtcttctcttagcactccctgcggtaggagaactgtagcgttcatggacagaaattggagacaatggttgcatatctaaaaaaaaataataaatttaaaacagaaatgtattccaaaataataaattaggtttactcattcactcaacagatagtgagttacttatgctgggcactagctagatatgaataacatggcctttgccctcatggaatatgtagtctactgggagaaagaggcatgaaataagtcactacgataaaacgtgaaaattatgatcactcatcttcctggtttcttgaacctctgcctacattaaaggagcaaaacattaaggacaaagtagaggttgagaggtagaatgaagtgagcactaaattttagtagtagtccaatatctcccaatcttacctagtagagagcacctgagaagaagggaagcaaaagcaaaaatcaggaatttgggtcacagttttgcctctttgtgaatatttgcactccaagcagtttaaggcggtagctctggctttctaatttagtagatatggaatcatctttagtaaatctatcagaagatatgagtaaagatgatataaatctgcttaccttgccttaatctgagggttggcagtactgtgttgatcaaaaataaagtaaggattatggattttgcctctcttcctgtgctatcctttcacaggatctgctttccattccctctctaccagctgcacgggtttttctagccccttacaaccctacatcttttctacatcttttttcacaattcttccctcaaccaattattccttacaggtaggtcaataatatgcttttaaaacaaaagtatttatttatttatgagatggagtcttgctctgtcacccaggctggagtgcagtggcacgattttggcctactgtgacctctgcctcttgggttcaagcgattctcctgcctcagcctcccaagtagctgggactacaggcatgtgccaccatgcctggctaatttttctatttttagtagagacagggttttgccatgttggccaggctggtcttgaactcctgacctcaggtgatccacctgcctcatttgggattacaagcttcagccaccgtgcccggccttcattatttatttttacattcactagataattagatagtcatgtaatctattttcttttctttttttttttttttttgagatggagtctcgctctgttgcccaggctggagtgcagtggtatgatctcagctcactgcaagctccgcctcccaggttcacgccattctcctgcctcagcctcctgagtagctggaactacaggcaaccgccaccatgcccggctaattttttgtatttttagtagagatggggtttcaccgtgttagccaggatggtctcgatctcctgacctcgtgatctgcccgcctcggcctcccaaagtgctgggattacaggcgtgagccactgcgcctggccctgtaatctattttcaaaacatgttcaaaaggtatgaaaatgacccctggcaatgatttagaagctctctgtattagtgaggtgattgggaaaatagttatagtttaataaaaatctccgtaattcttgggcttatgaaagcagcttttacttctcctgtcttcagtaaacaagtgcaaatttctatagttgtttccattactcttttacaagagtccatgtgaatgccttatatctaagaaatccacgcaagcccttgaatctgactaggcatgtttaaaggtgacatttcaaggcaagactcgagttgaagccataaagttagctgcaaatccattgaaatgatcttttcttagcacagtactggaacagctatggtggatgctcaataagaatgtaatgaatatacaaatgtaaagcggatccaaatttagaaacatgacaatctgtcaaggtacagaaaagatgctcacttagttataaattatatgagaggaaggtggcaagcacagtttaaactattcttgctaagtttttaaaaaagaaaataattctcaatatttcgtaagttttaaattatagtatactaaatatttttactattttttcatttctctaaacattaataactgacagaaagaagagccttttttttaacattttgacaagattcgtaaagatcaaaaaacaattataataattataattattcccactgattaaaatgactgagtattcacatcttatgcaatcttgttttttttttttggagacggagtctcactctgtcgaccaggctggagtgcagtggcacaatctcggctcactgcaacctccgcctcctgggttcaagcaattctcttgcctcactcttgcctcagcctcccaagtagctgggactataggcgcatgctgccatgcttgcctaattttttgtattttactagggaccagttttcactgtgttgcccgggctggtcttgaactcctgacctcgtgatctgcccgcctcggcctcccaaagtgctaggattacgggtgtaagccactgcgcccggccattgttttttttttttttttttttttgagatgcagtcttgctctgtccccaggctggagtacagtggtgcgatctccgctcactgcaaactccatcccttgggttcaagcaattctactgccttagctgcctgagcagctgggattacaggtgtacaccaccatgcctggctaatttttgtatttttagtagagacagggtttcaccatgttggccaggctggtctcaaactcttgacctcagatgatccacctgcctcggcctcccaaactgctgggattacaggcgtgagccactgtgcctgaccttatgcaatcttttttttttttttttttgggtcggagactcgctctttcgcccaggctggagggcaatggcacgatctttgctcactgcaacctctgcctcccaggttcaagtgattccctgcctcagcctcccgagtagctgggattacaggcacctgccaccatgcctggctaatttttgtatttttagtagagatagggtttctccatcttggccaggctggtcttgaactcctgacctcatgattgacctgcctcagcctcccaaagtgctgggattacaggaatgagccactgtgcctggccttttttttttttttttttttctgaaacagagtctcgctctgtccgccaggctggggtccagtggtgtgatcttggctcactgcaacctctgcctcccgggttcaagtgattctcctgcctcaacctcctgagtagctgggattacaggcacccgccaccacacccagctaatttttgtgtttttggtagagatggggtttcaccatgttggccaggctggtctcaaactcctgacctcaggtgatccgcctgccttggcctcccaaagtgctgggattacaggtgtgagccaccgcacctggcctgcagtcatttttatgatcctgcattgcatgtaaagcaaagattgcagacagacaaacacacatacacaatcacacagagtccaaaaatggatgtaccgtactatgtaacctgaatacttgttcatctaagatttgttaagggatactatgtggtcaggagattttaactgatttttaaaaatccaagcgctatataatccacaagatacacacatcagctcgctacatcacaagagaaaataaggaagaatgaactaaaatctttccattggtaagtctcaaaatgaactattttaagaataaaaataactagtttattagatgaacttaagcattccaaagagaatacaaattttattttgctttaaatgtttttctacagagacatacacaggcaaaggaagaatataaatttgggaaatttggaaaagtaggtatttagcttagtgatatggtttggctgtgtccccacccaaatctcatcttgactgtagttcccataattcccacgtgtcatgggagggaccaggtgggaggtcactgaatcatgggggtgggtctttcccatgctgttctcctgatagtgaataagtctcatgagatctgatggttttatcaagaggagttcccctgcacaagctctcttgcctgctgccatgtaagatgtgcctttgctcttccctttgccttccaccatgatcgtgaggcctccccagccatgtggaactgtgagtaaatcaaacctctttcctttataaattacccaattttgggtatgtctttattagcagtgtgagaacaggctaatacacttatcttgttttttcctttcttctttttctttttttctgggacatgaggggggtctcactatttcgcccaggctgggttcaaacacaatcctcaatactcctgcctcagccttctgagtagctaggactacagaaagatgccatcgtgcctgactttagcttatttaaacagttctccattagcattcaggaaagattacatatatttattaaataaattacatttaaaattctattaatatagaatacactatagtatataatatagtgtacaatgagctacacaggggtgctggcacaagcatcaagctccttttcgaaccctgctgaataaattagatttcttaataacatactcacaagacttaaaattttccctgaaaaaaagccaaatgccctttgttactttttcattcctttaccaatgttgaacctacctcttcgaagactcccactgtcagttcgaacttccttgactcttgggtgcattagaggagacattggcatcaggggaagatgtccctgcacatttcctccatttcctgtttcaaagttatttgggaatataacctgtagaaaacaaaaaccctttgatttacatatagataaacttgctgattaaaacttattaaaaatgttttcttttctttttttgagataaagtctcattctgttgcccaggctggaatgcagtggcacgatttcagctcacagcaacctccaacgcccggggttcaagtaattctccttcctcagcctcctgagtagctgggactacaggtgtgtgccatcatgcccggctaatttttgtatttttaggagagacgaggtttcaccatgttggccaggctgatctcgaattcctgacctcagatgattcacccacctcagcctcccaaagtgctaggattacaggtgtgagccactgtgcctggccgaaaaagtgttttcttaacttttttttactattttatttctttctcacttcttcacaaaatacaacttggataaagtgctcaattcttaatgttaacgaacgtatggaaagagttcatttcatttaaccttataatttatataggtaagttaccaaccacaagaactaaacctctgaggtaggcagtatcattctccatttagggatgagaaaattgaggatctgaatgtgaaatttgcccaaggtcacacaactagtaagttataagagcaacggcttcaatactaatccttcttcaagttcacagcttttttgaacttgaaggagtctgaagttcttcaatggaaataaactgatgaatactgaagagtggcccaataagttactgtctgctgcaaaagaccaaagaagtatggaagagagatttcaagaaaccatcttctttccaattcctcctggccttggacagttctagtagtttgggattagggaaaaattcaagaagattaatgaagtacataaggagacaaaacaaagaatcaaaagacacgagttacaaaagaataacagaagtagacaaaaaaaaccccacaatttctcacgatactactattaaaaatgtaatttgtgcacaactctgggcacacatttttaatttttatttatttattcatttaatttttttttgagacacagtctcgctctgttgtccaggctggagtgcaatggcacgatctcagctcactgcaacctccgcctcctgggttcaagcaattctcctgcctcagcctcccaagtagctgggattatgggtgtgtgccaccatgcccagctaattttttgtatttttagtagagacggggtttcaccatattggccagcctggtctcgaacgcttgacctcaggcaatccacttgccttggcctcccaaagtgctgggattatagtcatgagccactgcaccagcctctgttttttattttttaattctgaataccaccaatgaaaagtgttcaatctttatacagacatttgaaaatttttaagtaagtttaatggtttcctagacatgatatcaaaaagcagaagcaaaagaaaaaatatctgaattggacaccatcaaaattaaaaatttttgcatttcaaagacaccatcaagaaagtgaaaagacaggccaggtgcagtggctcatgcctgtaatcccagcactttggaagaccatcctggctaacacggtgaaaccctgcctctaccacaaatataaagaaattagctgggcgtggtggtgggtgcttgtagtcccagctactcaggaggctgaggctggagaatggcgtgaacccgggaggtggagcttgcagtgagccgagatcacgccaccgcactccagcctgggcaacagagcaagactttgtctcaaaaaaaaaaaaaaaaaaagaaagtgaaaagacaacctagaaaatgggagaaacattttgcaaatcatttatctgataagggatttgtatctagaatagatgaagaactcctataattcaataataaaaagacaacccaattacaaaatgggcaaaagatctgaatagacatttctccaaagaagatatgcaaacagcttacaagcacataaaaagatgttgatcatcattagccaccagggaaatgcaaataaaaccacaatgagatattacttcactcctactagaatggcaggattaaaaaggcagataataacaagcattagcaaggatatgaagaaactggaatctttctacattgaccgtaggaacaataaaatggtgcagccattttagaaagcagtctgacagtttcccaaaagcttaaacagagttaccatatgaacctgcaattccactccaagaaaaatgaaaacatatgtacatatgttcacacaaaaacttgtgcctgaatgttcatagcagcatcaatcataatagccaaaaggggttagttgtggtggctcatgcctgtaatcccagcactttgggaaactgaggtgggaggatcgcttgagcccaggaattcaagactagcctgggcaacatagggagatcccatctctacaaaaactacaaaaattagccaggtgtggtgtgtgtgcctgtagtcccagctactcagaaggctgtggggagatcatttgtgcctgggaggttgaggctgcagtgagccgtgatggcgccactgcactccagcctgggtgacagagtgagatcttgtccccccccctccaaaaaaaaaaaaaaaaaagtcaaaaggtggaaacaactcaaatatttatcaaccgatgaatggataaataaaatgtagcatccatacaatggaatattacttagcaacaaaaggaaatgagccagatgtggtggctcacacttgcaattctagcactttgggaggctgagatgggaggactgcttgagctcaggagtttgagatcagcctgtgcaacatggcaagatcctgtctctacacacacatgcgcgcgtgcacacacacacacacacacacacaattagccgggtgtggccaggcgcggtggctcaagcctctagcctctaatcccagcactttgggaggctgaggcaggtggagcatgaggtcaggagttcaagaacagcctggacaagatggtgaaaccccgtctctactaaaaaaagtacaaaaaaaattagccgggtgtggtggtgggtgcctataatcccagctacacgggaggctgagacagagaattgcttgaactgggaggcagacgttgcagtgagccgagactgtgccactgctctccagcctgggtgacagagcaagactccatctcaaaaaaagaaaaacagaaagaaaaaaaaattagccgggtgtgggtgtggtggtatgtgcctgtggtctcagctacttgagaggcagaaggacagtttgggccgaggaagttgagggtgtagtcagtgcaccatctttgtccactgcacaccagcccgggcaagagtgaaaccccgccttaaaaaaagagaggaaatgaaataccgatacattctacaacatggatgaaccttaaaaacattatgctaagtgacagatgcccagtcaaaagggactacatttttatgattccatttatatgaaatgtctagaataggcaaatttatggagacagaaagtagattagtggttacttacagctagggagaagattcgggggtagggaagtgatagctaaaggatgtaggtttctttttgaagtgatgactatattctaaaattgtggttatggctgcacatatctatttatatactaaaaccactgaattgtacacttaaaatgggtgaactctatggtataggaattatctctcaataaagctggtttttttttttttttttttaatgatacgattatcagccttgcccagactcacttcttcacaggtaggaactttgtttgcagaaacctggagagcctcccacagtgcagaatcgtgactccatgctaaactctccaaaatctgttcttcaatgctgtttaggtgtttcaccatgtcccttgagagcccctcttctgagcggatcaccacctcaataacctgcagaggagaaagtgagaaggcaatgtggtttcaagcagttagttctagtctggacttgcatgtaggactagctgtggctttcttcttcttcttcttttttttgagacggagtttccctctgttgcccaggctggagtacagtggtgtgatcttggctcactgcaacctctgcctcccaggttcaagtgattctcctgcctcagcctcccgagtagctgggattacaggcacctgccaccacacctggctaatttttgtagtttttagtagagccgaggtttcaccatgttggctaggctggtctagaactcctgacctcaggtgatctgcccgcctaggcctcccaaagtgctgggactacagttgtgagccactgcgcccggccactgtggccttattctgtggcacagaaccaaagtcatctttgaaccataattctgtggcttactaacatcttctaatttataaaggagtttttaagttctttaaaatatgttcacatatatttctgtttttcacgttttatattataaatgacaacttgaggcaacgataggtgaaaactggtcaacagaccaacagtgggagaagtcaggtcttgggttccaagtctagttctattttgaatgtattgctcctttccagactattttttccactaactcaaaataacagaatgaatgaactatttaaagtgactttgcgtatatacactataattccattttataagggaagtatctagaataaagtttatatacacaaaatattaataatatgattgttaatagattatgatgtatgactttaatattcacatttatttacttatttatttatttatttatttatttatttatttatttattttgagacggagtctcactctgtcacccaggctggagtgcagcggcgccatctcggctcactgcaatctctgcctcccaggttcaagcgattctcctgcctcagcctcccgggtagctgggactacaggcacgtgcccccatgcctggctaattttttgtatttttagtagagatggggttttactatattagccaggatggtctcaatctcctgacctcatgatccgcccgccttggcctcccaaagtgctgggattataggcatgagccaccgtgcctggcccacatttatgtttatgattttcttcaatgagcacatatcatttatgtcatttaaaaaaacaaaggaggccgacacagtggctcatgcctgtaatcccagcactttaggaggccacagtgagaggattgcttgagaccaggagttcgagaccagcctgggcaacatagtgaaaccgagtctctattgaaaaaaaaggcatttagctgcttgaataaaataaggatgttataaataaaaaccaattactatgaggttgttgacaaaactaaactttttcctaatggcaaaagttgaatacacacattaacattaaagtgagtgtatagtagaatcacttctccctaagaaacctaaaaatactttaatcacactcagtaattcacacagataagctttccaatgacctgcattttctacaactttaattcaggcatactttaggtataaaaatttaactcttcaaaccaatttttctatcaccagtagaaaagtacctagatgactaaatattaactaaatcatgccaagaagcgtaacagtagcattagtcttaaagttcgatactatgtaacattaaacgttattgactgtgatgactaaacgttattgagggtgatgatgtagttcaatagctatgacctctgttttattttgaaaagattaacaaaaatagttctagcaagaaaaataaaggtaaggtaagtaagattcattcacactgaattagctcaaacttggggaagaagcataatctattattacggctttattagttagaccaccaccaaaatcaattttaggtcttccttcctcttggtagaaagcgttttttgttcttcatcatgcatttgtttaataggattataattttcattcataaatatggaaaatttgaagttaagtactagttccaggtcacattttcaagtccgtgttaacaaaggaactgaagctgtaagattgacttaatttactgatactctcaccttctctctctctttttttttctttgaaacagggtcttgcttaggtgcccaggctggagtgtggtggcataatcatacctcactgtaacctcaaactcctggactcaagccatcctccagcctcagttttccaaagtgctgggattataggtgtgagccactgtatgctcaactctctcttgtgttcttggtttcacccaagaggaatatatattatctttttttttttttttgagacagaattttgctcctgtcgtctaggctggagtgtaattgtatgatctccgctcactgcaaacctccacctcccaggttaaagcaattctcctgcctcagcctctcaagcagctgagattacaggtgctcgccacaatgcctggctaattttttttggtatttttagtagagacggagtttcaccattttggccaggctggtctcgaactcctgacctcagataatcctcccaccttggcctttcaaagtgctgggattacaggcgtgagccaccatgcctagccaggaatatatattttcagaacacatctggaaacactttccagatatcacaacagtgtttttcttcagcactaagataaatacaatgtttctgtgagaaacactgttttcatctcataacagaactttgttttcatctcaccttataaaagtaaaatggttgcaagttgagaacttcaataatccaaggaaaagtacgaggtgagctataggcaaagagcacaatttccaaacaacaagccatcaaggaacgatgaaatatatcttgctctaaaagaacctgggggaagagaaagaccacagtttaatatttttcagcaatttcagtctttgccattccataaagaaacctataaaaacaagaaaaaataacgtgcaaattatattacactagattactggagataaaaatttgagttctcaaattggtagttttcctataatacctattcttgctcagtgggtagggaataaatttaaataaggtgtacataacaatctgctttgaaatctgaacaaataataaaagtcagtattcccatcaacagaaaagcattagaattggttatttttcttaatgacagttaattgttttgtcaacataagggtttatttatcaaaacacagaaatgaaaggtaatatgtcacagtttagacaaaactgttcagaaaaagaaatacttcactgagaaagtaaaagtcctactttaccattaagtttaatataagttttcagttttaaaaatggtatttgttgccttctttctttcaaatatcaccctagattggctgagtgtggtggctcacccctgtaatctcggcactttgggaggccgaggcaggtggattgcttgaggtcaggagttcaagaccagcttggccatgatggtgaaaccccgtctctactaaaaatacaaaaattagctgggtgtggtggcgcgtgcctgtgatcccagttactccggaggctgaggcagtggaatcacttaaacctgtgaggcagaggttgcaatgagccaagatcacgccaccacactccatactgggcgacacagcgagactcagtctcagaaaaaacaaaaaactaaaacaaacaaacaaaaaacaagtatcgccccaaatcaagggaggataaaaaacagaaactccatcatcagtaaaactagcagtcatttgtaactgtaaaccacaatatatgaaggatgacaaattactcagcagaagggacgatgatcaagcataaggacctgcagtgagacacttaaaacaaaagaatctgatctaaaatacatagcaactgaggacacaggcagaatgggaagtgggggtgaagcattgggtgggtgatctgaaagtcttaggatcctcaggtccccacacaacccccactctatgggatcagatgacagacctctattctgtctccacaggaatctacaggattattctctagagaaattgaactggagactcagaggtagagaacattaggcacagaaaagactagggttttaggtgaaactctgcagactgaaccataagaccaagtttcccttccttcttctgatccacaacaccaacagccaggcaagagatttacagatatgtctctggagaaactgagatattccagaaaagtcttacggataccagcagataagtctctaatactatgtgatcacctgaggtcaatggattttttacttccactcttgaaataaaagagctttaaaacaaacttttactgcctcattcacagagctttgaacacgtttttagtgtctcattcaaatttaagtggaccactaagaattatctgacatttgaggaaaacctcttacctgaaaaacataggtcaaaacaaacagaaaagcgaggtgcagcagcatgcacctgtagtcccaggtacttgggaaactggggcaggaggatcacttgaacctaggagttttgacactagcctgagcaacatagcgagacaccatcgtattaaaaaaaaaaaaaaaaaaagccaggtgcggtggctcaagcctgtaatcccagcactttgggaggccgaggggggtggattacctgaggtcaggagttcgagaccagcttggccaacatggtgaaaccccatctctaccaaaaaacacaaaaattagctgggcgtggtggcatatgcctatagtcccagctactcaagaggctgaggcaggagaatcatttgaacccgggagatggaggtgcagtgggccgaggtcatgctactgcactccagccagggtgacagggcgagactctgtcccaaaaaacaaaaaacaaaaaacaaaaaaaaatttaaagatccgccatctgcaaatgcagattttcgtgaaaacccttacagggaaaaccatcaccctcaaggttgaaccctcggatacgacagaaaatgtaaagaccaagatccaggataaggaaggaattcctcctgatcggcaaagactaatatttgctggcaagcaactggaagatgtctgactacaacattcaaaaggagtctactcttcatcttgtgttgagacttcatggtggtgctaagaaaaggaagaagtcttacaccactcccaagaagagtaagcacaagagaaagaaggttaagctggctatcctgaaatattataaggtagatgagaacggcaaaattagttgctttcgtcgagagtgcccttctgatgaatgtggtgctggagtgtttatggcaagccactttgacagacattattgtggcaaatgtctgacttactgcttcaacaaaccagaagataactaactgtgtatgagttaataaaagatataaactaacatttaaaaaaatttaaaatattttttagagagagaaaaaaggccagacatggtggctcacacctgtaatcccggcactttgggaggctgaggtgggtggatcacctgaggtcaggagttggagaccagcctgactaacatggagaaaccccgtctctacaaaaaatacaaaagtagccaggtgtggtggcgcatccctgtaatcctagctactcgggaggctgaggcaggagaatagctggaacctgggaggcggaggttgcggtgagccaagatcgtgccattgcactccagcctgggcaacaagagcgaaactccatctcaaaaaaaaaaaaaagagagagagagaaaaaaaatggagaaaaattcaggagaaacagagacgaagcagtcaagaaaatttcgaataaatctaaattagtaactttagagaacatgaaagagaaatgaaaatatagctgaaattaaaagttcattgggactagatgaaaagttgagtaaatatctttaaaagtagaataaggccgggcgcagtggctcacgcctgtaatcccagcactttgggaggccgagacgggcagatcacaaggtcaggagatcgagaccatcctggctaacatgggtgaaaccccatctctactaaaaatacaaaaaaattagccaggtgtggtggctggcacctgtagtaccagctacttgggaggctgaggcaggagaatggcgtgaacctgggaggcggagcttgcagtgagctgagattgcaccactgcactccagtctgggtggcagagcaagactctgtctcaaaaaaaaaaaaaaaaaaaaaaaaaaaggtacaataaaagagataaagaaatggaaaacaagagaagaaattaagaaggtcaattcagaaggtccatcatctgaaaaatgaaagttccagaaagataaatcagtgggcaatgtaccatctaagaaataacaaaataaaacgaccaagaactgcagggcatgaatttctagactaaacgggcaagtctgtgggaatgacagacacatgaatgaaaaaaaacacagtaagatacatttttataaatttaagaacatcagtgataaaagatactcaaagatttcagaaaaaaaaaacaggtcacatactactaagtgggaatgagaatgtcactggacttctcattagtaacagtggaatctataatagaaaataatgcaacagtaccttcaaactcataaaggaaaatgattgtcaatctagaattcttttctttttttaagtttttttttgtttttagggatggggtcttgctatgttgcctaggttggaggacagtagctattcacagtgcaatcatactacacagcatacatacaatacacagtatactacaacctcaaactcctgggctcaagcaatcctcatgcctcagcctcccacagatctttttttcttttttttttctgagatggagttcgctcttgttgcccaggctggagtgcaatggcgtgatctcagctccttgcaacctctgcctcctgggttaacacaatcctgcctcagcctctcccaagtagccgggattataggcatgtgccactacacctggataatttggtattttttagtagagacagggtttcaccatgttggtcaggctggtctagaactcctgaccttaggtgatccacctgcgttggcctcccaaagtgttgggattacaggggtaagccacagcacctggcctctcccaccaatcttgaattctgtacatagacaactatcaatcaattatgagtctaaaataaagttacttatgcaaaatctttaaaaagggactttaagtgaggtaagatttctatactttacttaaattggttatatggctatacaaaacatctatacaaaaaaaaatctttacaaggctctaaaaaatgttcaagtaaccaacagagagggaggaaaaagaaaacaaaattaaaaaaaaaagagtgagaacaaacagaaaacaaaaataaaatggcagacttaagtgctaacataacaattactaattttaagtcatctaaatttactaattaaatgacagagattagcacagattagaaaaaaaaaaatgacccaactacacactgactataagaaattcacttcaaaggtcacttgaaaaaggatggaaaaagatatgccatgcaaacattaatgaaaagaaggcaggagtggttattcataaacatcaggtagatgcaaagaaaattaccagggacagagaggaacattttatttatttattttatttttaagtttttttttttttagatagagtctcgctctgttgcccaggctggagtgcagtggtgcaatcttggctcacaacaacctccacctcccaggttcaagagattctcctgtctcagcctcccgagtagctgggattacaggtgcacaccactatgcctggccaattgttgtatttttagtagagatggggtttcactatgttggccaggctggtctcaaactcctgaccttgtgatccacccggcttggcctcccaaagtgctgggattacaggcgtgagccgccgtgcccagccttatttatttatttattttgagatgcagtctctctctgtcttccacgtgggagtgcagtggtgtgatctcggctcactgcaacctcttcctcccgggctcaagcgattctcctgcttcagcctcccgagtagctgggattgcaggcgcctgccaccatacccggctaatttttgtattttcatatatttatttttttgagatggagtctcactctgttgcacagggtggagtgcagtggtgcgatcttggctcactgcaactgccacctcctgggttcaagcgattctcctgtctcagactcctgagtagctgggactacgggcatgcgccaccacgcctggctaatttttgtatttttagttgagacgggattttgccatgttggtcaggctggtctcgaactcctgacctcaggtgatccacttgcctcagtctcctaaagtgctaggattagagatgtgagctaccatgcccagccttttatattttcagtagagacagtgtttcaccatgttggccaggctggtcttgaactcctgacctcaggtgatccacctgcctcagtctcccaaagtgctgggattacaggcatgagccactgcgcctggccagggaggaacattttataatgattacagagtcaattcatcaagaaggcagacagcaatcctaaatgtgtaagcatcaaacagcagagcttcaaaatacgtggagaaaagctgacagacttgaaagaaatagacaaatctacaatcatacatggacacttcaacatcctctgtcaacaactgatataacaactagactggaaatcagcaagaatataaaataacaacatcaaccaacaagataaaactgacatttacagaacactccatccaacaatagcagaatacagcagatccttgaataacaccatttcgctcaacaccagtttgttgtaacaatgaaaaataatggattcccagctggggccactgtatgaaatttacacattctcctacgtctgcatgagttctctctgggtactctggtttcttcttacattccaaagatatgtacattagcttaactggcatatctaaattgtgacagtgtaagtgtgggtgtgtgtgtgtcctatgatgaaatggtgtcctgactagggttggggcccgcctttcatcgtgagctgctgaggtaggctctcatgaccctgaacaggaataactggataagtaataatcttccttatttttattactttctcttatttatttcaatgtttaacattataagtgttttgtctttatttagaagtttggtgaggtttttgtgactagacatatgccaaaagaacttaaactcctgtttatatcagttagcctatggtaaaattggtttcattgtatgttgtttttgcttaaagtcactgtttccaagaacctactgacaaggttaaatgtgaggatttactgtatacattcttttcaagtggccacagaacattcaccatgataaaacatatcctgggctacaatataactaaaacaaattgaaaagaactaaattcatacagagtatgtagaagtggaaaacaataatggctgagaggagtaagtgtaactaactataaaggggtagcaggaaggagatctttaacagttcagtatttttattttggttatggttaatctatgcatatgatacaattttatacacacacacacacacacacacacacacactgttttaatgtcaattccccagttctgatactgcagtatataaaattgtaaccattagggaaactggataaaggatgtgtgggacttctctgtactacttttgcaactttctgtgaatctataattatttcaaaataaaaagttggccaggtgcagtggctcacacctgtaatcccagcacttttggaggctaaggcaggtggatcacatggtcaggagttcaagaccagcctggccaagacagtgaagccccgtctctactaaaaatacgaaaaaattagctgggtgtggtggcaggcgcctgtaatcccagctagtcgggaggctgaggcagagaactgcttgaactcgcgaggcggaggttgcagtgagccaagatcgcgccactgcactccagcctgggtgacagagcgagactacatctaaaaaaataaataaataaaattaaaaaaattaaaataaataaaagttaaaaaatttacttctttcagctgggtgaggtggctcatggctgtaatcctagcactttgtgaggctgaggtgggcagatcacttgaggtcaggagctcgagaccagcctggctaacatggtgaaaccctgtctttactaaaaatacaaaaattagccaggcgtggtggcgggcgcctgtaaccccagctactcaagaggctgaggcataagaatcacctgaacccaggagatggaggttgcagtgagccgagatcgtgccactgcactccagcctgggcaacagagcaagactcagtctaaaaaaaaaaaaatttacttctttctcaggaagccatggaagtgtatgcaccatcaagatattagcgtaaactatgaaaaagaaagacacagaaaagagaaaccaacacagaaaagacatgaaaaaaatttccaggtaaacacaaagagaaactctattacaatagttacgcagcatccttaagacatcaacctgttcctattgggatagaaaagttagaagactccaagagtgactgcagagggaaataatgaaggaggaggaaacaaagatcatatgataggtctgaatttgtagaaaaattcttttacacatcttattggagacagtggtctgacttggtcatagttaaagaaacaaaacaaaacaagaaaaacccataccattttataatccaaaatccttggaaggtatggacaaatgtcttaattaacagttgctttaacaggtggagggatcactagctgggaatgaaggacagaaaaaaaaaaaaaaaaaaaaaacacttaaaaaacactgatgtgtaccaaagatgaactttacgttatttcacatttctgcctagattgattagccttgcatgtgctaaagtcaactaaatgccatcctggccaagtgtgtcatagattggtgactcccacaacgccttacagagcctctcaaaacactgcttccaggctgacttttggaccttgccagtagctcagagagtggatttacttactgacatgtccattccatgaagtcttcgtgtttcctgaaccattacagtctctagtattttataatacaaaatttctgccagctttagtctgtttacagcaaagtctatcagggaaatacagagaaaacatgtgttaatgaattttagttgttaaggactgaaaagcaaaaattatatataaacttaaatctgatacattaagaatagcagggcaggccgggaatggtggctcacgcctgtaatcctagcactttgggaggcctaggcaagcagatcacctgaggtccggagtctgagaccagcctaaccaacatggtgaaactccatctctactaaacatacaaaattagccggtgtggtggtgggtccctgtaatagcagctacttgggaggctgaggcaggagaatcgtttgaacctgggaggaggaggttgcagtgagtcgagatcatgccattgcactccagcctgggcaactcggtctcaaaaaaaaaaaagaaataagaataacgggagaggaaaaaccgtgaatttctaattttggggggattacttattttcaatgctatgccaactgtagttttcttttcttacctatgtgagatcctggctgttcatctgttgattgagtatagtgttgacagaaagtctctcctattccttttagtattttcataatgttttccacaggattacgcacacaagatctacaaaatacaagaggaaccaattaccaaaccaaacaaaaacaaacaaacaaaaaagactccacaccagaatactaacatgccttcttcttctttttttttttttttttttttgagacggagtctcgctctgtaacccaggctggagtgcagtggtgcgatctcagttcactgcaacctcttcctccagggttcaagcgattctcctgtctcaacctcccaagtagctgggattataggcgcgcactaccacacctggctaatttttgtagttttagtagagatggggtttcaccatgttgcctaggctggtctagatctcctaaccttgtgatccacccacctcagcctcccaaaatgctgggattacaggcatgagccaccatgcccggccaacatgccttctttcaagaattagtttttagcagccaaagttgtattctcagttggaaatctacatatgtaagcaaagctttatatgataaaatattttaacacgtaaaattatataataaaaatacagattgtatacacatgtaataaaactttgctgctgtaagtttgactatactatgtaccttatatgagtggaatcatgcagtattttgtctttttgtgattgactaacttcacttaacataatgtactaaaggttcatccatgttgtagcaaatggcagtatttccttcttttataaggctgaataatattccatctcatatctctatttctttctatctatctatctacctacctacctacctacctacctacctacctacctacctacctatctacctatctacacacacacacatacacccacagcattttctttctctatcaatggacacttaaggtgtttccacaacttggctattgggaataatgctgcagttaacatgatgtgcaaatatccctttgagatgctgtttttaattcttttggatgtatacccagaagtggtattgctgagttatatggtagttctatttttaattttttgaggaacgtccgtactgttttccatagtggctgcaccactttacaattctaccaacagtgtgtaagggtcccaatttttacacattcttaccaacacctgctattttggtttttttggggtgatgagtgggaagtggctatgctgatatgtgaggtattatctcattgtgattttgatttgtaactccctgattagtgatatcaaatattttttcatatgcttttggccagttgcatatactctttggagaaatatctgctgaatcctttatacgtttttaaattgagttatttgttgttcttgagtttcaggagttctttacatattctgagtatgaaccccttaactaatatatggtttacaattacttttcccattctataggttgttttttttactctgttgattgttttctttgctatgttaaagcttttaggtttgacaccgggcatggtggctcacatctatattcccagcacttcgggaggccaaggtaggtggatcacttgaggccaggagttggagatcggcctggccaacatggtgaaacatgtctctactaaaaatacaaaaattggccaggcctgttggctaacacctgttgtaatcccagcactttgggaggccagggtgggtggatcacctgaggtcaggagttcgagaccagcctgaccaatatggtaaaaccccgtctctactaaatacaaaaaattagccgggcgtggtggtgcatgcctgtcatcccagctactcaggaggctgaggcaggagaatcgattgaacctgggaggcgaaggctgcagatcgggccattgtactccagcctgggcaacaagggcgaaactctgtctaaaaaaaaaaaaaacaaaacaaaacaaaaaaaaaaaagcctattccagggttcactattcctagtcagggacgtctagttatatgaggatctctccccaaatcttcatggaatgttggaaaatggcagcccttggctcatgcctgtaatcccagcactttgcgaggctgaagcaggcagctcatgaggtcaggagatcgagaccatcctggccaacatggtgaaaccccatctctactaaaaatataaaaattagctgggcatggtggcaggcgcctgtagtcccagctacttggaggctgaggcaggagaactgcttgaacctgggaggtggaggttgcagtgagccaagatcatgtcattgcactccagcctggcaatagagcaagactccgcctcaaaagaaaaaaaaaaaaaaaaggaaagaaagaaacaatgaccaggttttatttgttttgtttttttgtttttgtagagatgaggtgtcgctatgttgcccgggctagtctcaaactcctgagctcaagcaatacacccaccctggcctctcaaagtcctgggattacagatatgtgccattgcacctggcctctaatatggatatcttaacaatattaagtcttccagtccacaaacacagatgtctttcctttttttttttttgttgagatagggtctcgctctgttgcccaggctagagtacaatggtgtgatcatggctgagctcaagtgattctcccatctcagcctcccaagtagctggaatgcatatcaccatgactaatttttaaattttttctgtagagacagggtctcatcatgttgctcaggctggtcttaaactcctgggctcaactgatcctctcgcctcagcctcccaaagtgctgcaattacaggcatgggccacaacacccagcgtttccatttatttgtgtctagattttttttcttttgcattctatacttcctttttcttattgacatatttgtatatttgctttgtcactgcttttcaacttattcatgtttgaacagtagttcaatccagatctatttactcaaatgatatggaaggtagatccgtgacagtcttcctatcttactggcagtatgcttttcttctgagctatttctgaggctggagattgttctgtctactttcttgtatcctgaaggtttgaggaatgggggagagctcagctatgttcagcttttcttggaggaccagggcttcgctttgtcttctgagatttagttaaatattcctattctagggttcactattcctagtcagggacgtctaggtatatgaggatctctccccaaatcatcatggaatgttggaaaatggcagcccttggcagttgttctgctgggatcctgctggtggtacatacggactttcaattgggaaggtttgtatgactttttatctgtctgcctactcccccatttgtttccctccaaatctgaagtattgatgagaattctcaagatctatcactataccctctttccccaacactgcttagggatgggaataccagaatcatgaattttctttttgatctctactttggaaatttgtcatgaaatcatatctctctcctcatttggttgccattgataaatattttgctggttttgactattctcttattttattaggtattaggaaagaaggttctctgatctggcttcattctaccatctttaccaggaatcatgcttccttaaaaaacaaaaaaaaaaactgtataaaattccattttatgggctgggcgcggtggctcacgtctgtaatcccagcactttgggaggccgaggcaggcgaatcatctgaggtcgggagtttgagaccagcttgaccaacatggagaaaccctgtctctactaaaaatacaaaattagctgggcgtggtggcgcacgcctgtaatcccagctactcgggaggctgaggcaggagaatcacttggacctgggaggtggaggttgcagtgagccgagatcatgccattgcactccagcctgggcaacaagagtgaaactctgtctcaaaataaataaataaataaataaataaataaataaataaatccatttttatggctgtaccaccaatatgcaattagtcccctatctaatggacatttagaatggccccatttaaagttaatgtatgtccttatacaggtgatctttagaaacaaacaaaaataaaaataaattaaaaataaagtcaatgtaaaatcaaaacatgcataactcaggggtagttataagagtgaaatatcagtgctaaataatctttaaggtacacttatctctaaaagtctatactcccatgaaataacattatatataattttttttaagagacaaagttggcctggcatggtcgctcatgcctgtaatcccagcagtttggaaggccgaggcagttggatcacttgagctcagaagttcaagaccagcctgagcaacatggcaaaaccctgtctctacaaaaaatataaaaaattaggcatggtggcttgcacctgtagttccagctaacttgggggactgaggtgggagagttgcttgagcccaggaggtggaggctgcagtgagctgtgattgcggcactgcactccagcctgggagacatagcgagaccctgtctcaaaaaaaaaacaaaaaaaaagggagagataaggtctccctatcttggccaagctggaattagtctcactatgttggccaaactagcttcccaagtagctgggactacaggtgtgtgccactgtgcctgactgttatacataatttttaataggtacttcaatatggttttaggtcaatatattttgtgattgaaatggtatagtaaaacttgccagatgaacatccactatcttgagaattctgaatatactaaaaatagaatggaacaagaaatctaattttaaaaagacatttggaaaaataacagtattgtacatactcaaaaatatttataagttggtcacttggtgcatttttcagaccagccacaatactctgtaaccggctcacactttgggtggctgatgcaacaggagtaatgactgcttctttttctcgtaaatatctccgtccggtcagtggggtagaaggtgcaaatgaccttttctgtcagaaaagaaaaatccgtgagtttttaaaagttaccatcttccttattatgtgtttaattcagtgcatataccatcttctctattcatatttgtaatatccatgaaatttttagcaatactatgctaataacatccttatatttgaataacactttttaaaagcactttctacatataatttcatttaatcttcacaccactgatttgaaagataatgtatacataatttaattttatatatgaggaaataggaacagagaaatttaaaaacttatttcagttgacaaagttaatggtaaagcttggactaaaacttaggttttactatgttctagacaagtgaattttccattagatctcttcctccaacccattttacacataaatacagagttaagccttggccattaacaatcaagtccagagttttatggctgaagttacagaaaaacacatagtttgtgtcacgggtaggaaagcaaactaaaatttaaagcaacgtaacggagcctaagttgaagcaaagaaagaactgtaagaaagcaaaacttcctcttcatgtcaaaagacatatactctactaataaacccagtcatgctgggaaaatggatataaaatatgaatagtaagaaatgaggtaaaaatactaaatgccagttttaaaaattaccttttaaggctttcatgagaaatatgaattagtagaagaagctcaagatttaacttgaaagatgcttctgctgttagtagaatcacacacagagagaaaaagatcattcaagattgaggccaggctaggttatattactttttcaaagtgctgttgaaggttatactccacattagcctgtgctgtcagtttccctaatggggtgtcacgagtgaactttcgaggtgttccaatttcctcttctgcgtctgctcccaaaaagatcctctcatcaaaatcaccaacagttagaacatactcttcatactccttattcactgctttgctgcaaagagaattattataagctgtaatactaagttacacaatggatttattttgacttgaagatagatttagtgtttacagcttagaaaacttgacaactttctaatttttattaactctgaccatctaacaatatcagagggtcctacctgattatggacattcttcaaattcatatatacaaccaataaattactttcaaaagtgagagactacatatacttaatctgaaaactagttgaatctaattatgaaaatggtttctgatcactaaggaaacactagtggctttgaaatatggcaggtggaggttgcagtgagccaagattacaccactgcactccagcctggcaacagaacaagactctgtctcaaaaaaaaaaaaaaaaaaaaaaaaaatgggccaggcgcggtggctcacgcctgtaatcccagcactttgggaggccgaggcgggcagatcacgaggtcaggagatcaagactatcctggctaacacggtgaaaccccatctctactaaaaatacaaaaaattagccgggcgtggtggcgggcgcctgtagtcccagctacttgggaggtgcctgtagtcccagctacttgggaggctgaggcagaagaatggcatgaacctgggaggcggagcttgcagtgagctgagatcgcgccactgcactccagcctgggcgacagagcgagactccgtctccaaaaaaaaatatgggcactgccaacatgtgattaatgaaagaatgtaaaatcaaatacagagtcattgggtctgtttatgagtttctcaagagagtggctgttttttgtttttaagacagagtctcactccgtcacccaagctggaatgcagtggcccagtcttggcacactgcagcctctacctcccaggtttaagcaattctcctgccttagcctcctgagtagccgggactacaggcttgtgccaccatgcccggatagtttttgtactttcagtagagacggggtttcaccatgttggcccaccttggcctcccaaagtgctaggattataggtgtgagtcacttcgagcttggctgagtagctcttttaaatgccatttggctgggtgtggtgggtcatgcctgtaatcctagcactttgggaggctatggtgagaggattgcttgaggccaggaattagagaccagcctgggcaacacagtgagatcccatctctaaaaaaataaaaataaatacgtgtcaatgattttttttctttaattgagatggaatctcgctctgttgcctaggctggagtgcaatggtgtgatctgggctcactgcaacctccgcctcctgggttcaagtgattctcctgcctcagtcttccaagcagctgggattataggtgcacgccatcacacccagataatttttgtatttttagtagagatggggtttcaccatgttggccaggctggtctcaaactcctgacctcaagtgatcagcccacctcggccccccaaagtgttgggattacaggagtgagccaccatgcccggcctctttctttttttcttgtttttttttttggaaatagggtctcactccgtcaagcaggctgaagtgcagtggtgcaatcatggctcactgcaacctcaacctcccagattcaaatgatcctcccacctcagcctcccaagtagctgggactacaggctcacgccactacgtctggctgattttgtattttttgtagagacaaggtttcaccatgttgcccaggctggtctccaaccttctgagctcaagcgatctggctgccttggccttccaaagtgctgggattacaggtgtgagccactgtgcccggccttaatttcttttctttctttttttttttttttttgagatgagtcttgctctgctgcccaggctggagtgcagtggtgcgatctcaacttactgcaacctccacctcctgggttcaagcgatccgcctgcctcagcctcccaagtagctgggactacaggcgtgtgccaccacaccgagctaatttttgtatttttagtagagaccgggtttcaccattttggccaggatggtctcaatctcctgacctcgtgatctgcctgccttggcctccgaaagtgctgggattataggcataagccattgcacgcctggctgagtagctgttttaaatgccaattggccgggtgtggtgggtcatacctgtaatcctagcactttgggaggctatggtgagaggattgcttgaggccaggaattagagaccagcctgggcaacacagtgagatcccatctctaaaaaaataaaaataaatacgtaagtatcaataatttttttttttaattgagatggaatctcgctctgtcgcctaggctggagtgcagtggcatgatctcagctcactgcagcctctgcctcctgggttcaagtgattctcctgcctcagtctcccaagcagctgggattacaggtgtgcaccaccacacccagataatttttgaatttttagtagagatgcggtttcaccatgttggccaggctgatctctggccaggctgatctcaaactcctgacctcaagtgatcggcccgccttggcctcccaaagtgttgggattacaggcgtgagccaccatgcccggcctctttctttttttttttttttttggaaatagggtctcactctgtcacctagactgaagtgcagtggtgcaatcacggctcactgcaaccacaacctcccagattcaaacgatcctccaacctcaacctcccaagtagctgggaccacaggctcacaccactacgtctggctgatttttgtattttttgtagagacagggtttcaccatgttgcccaggctggtctccaaccttctgagctcaagcaatctgcctgccttggccttccaaagtgatgggtttacaggtgtgggccaccgtgcctggccttgatttcttaaaataaatgtatttaaagccaacaagtcttagtgataataaacattcaatgccactaaagcagagagaacttgaatttggaggtcttactttgatatactgttatgcttaacaaatttcaacaaatcaacaaatatgacagcttgtgataagccaggcaccattagtactagatatttacctattatcagtaaaacttgaaaggtccaggaggcattctccttttaatatctgtgaacaaaaaattattttgggacaccatataattaagcatattaatacacacacaaacgtgaaatttatctaaatttccatattgttataacacacacacaaaacagaattattaaatatttctttcagactaggataaactatttagcatgcaaataacttttttttttaacttttttttttttttgagacagggttttgttctgtcaccagggctgcagtgcagtggtacaatcatggctcactgcagcctcagcgtgccaagtagctgggactacagttgtgcaccaccatgcccaactaatttttgtattgtttgtagagacaaggttttgccatgttgctcaggttcgtctggaactcttgggctcaagcaatccacctgccttggcctcccaaagtgttgggattacaggcgtgagccaccgcgcccagtccctgggatcctttaaaaaaagtttactttgctagagatgtttagcatacagacaatgggccataatatagatatctgaggaacacaagactgaatacaaaaatttgtataaaagaagaagaaaccagtaagggaagaatttatgcttaaagaaaaatctcataatatttgaaaagtgggatccataatccaaacccctccttttaccaaagagaaatcttgaggcttaactacatttaatggctcgacgttggggaaataagaaattgaaacccaaaggaacaagccaattcataaatgtagaaatagctaagttaattaccaaggagacaatgtccagaatgcacacagatagcctacaagtggctacaaaactatcatggattttctgctcgatttacatggaattaaaactgtggttgttatacatcatcctacttttagtcaacagtcagcagttattcaaattgtggcagtaaattagtcagcttattctgacctcctgtttttcctaattatttgtcagccctactctgatgttctattctttacaattctttatcagtacctcctacggttgcctctgacagtacatttacccaacagtacatatagttggtcacatttttcaacagctctgtttctcacatcacacaagatcataaggaaattctgaatcacagtagaggctaaagcctgggaatcctgaccctaagttctataatgctgagaacttgcttaaaacatttttttcttttcacattactggtgatctgtaaacatctcagtcatctaattataagtacagtaccttcctgtcaaagagttttgaaatatatggcttaaagtagtgctcctttattccttttgcttctacgagaagtccatcatgcagttcacacagtacagcaatgatgcagggtggctcttcagaagccgtaaagtcagcagtatgaaaatcagatggtaaacctagtttgacagtgtaggaagggcagagggaaaaaaaaatagtcaacttttaaaaatctttttccaaaaactgataatcagttttcaaaaataaataaaaggtcttacctttaaatgatggatttagcaagtcttgtctatttgggcacataatcgcattggcaaaaatcagatccaagcagcatagaagtaaatgataagagtttactaagtcatccccaatcatccgaaaattacctttataagggaaaaaaaaaaaaaaaagacacaaaaaccagaaacctctcatgtcaaatagcaccaagttcccagagtagaaatgtaagaccactgaaagtgtcatcttacccttagtataaacaaaaagtgtccaacagaaattaaacagatccttaacactgcaaggaatcctcctaaaaagggaaaaaaattactttttgtctgactagctcgctaaatatcatgtaaactgaaatagtaaatgtaaatatcaaatagatcaaattacacatgaaattccattcatgaagaaaagtaatctattatttatgaaatggacttaagtaagcctttccaacctgcataaaataatcagaacatagggctgggtgtggtggctcatgcctgtaatcccagcactctgggaggccgaggtgggtagatcacctgaggttaggagttcgagaccaccttggccaacacggtgagacctggtctctactaaaaatacaaaaaatgagccagacggggtggtgcacacctgtgatcccagctactcaggaggctaaggtaggagaattgcttgaacctgggagacagaggttgcagtgagccgagatcaggacactgcactccagcctgggcaacagaatgagactcctcaaaaaaaaaaaaaaaaaaaaaaaaacaacaacagaaagaaaaataagtaaaagtattatcctgaatttccaaatatggataattgtacatggatttaaaaagaaaataattaagttctttgcaggaatacttttcataaaaaacagactttcaaaaaagtatattctcttagtttgtatcataatctttatgtcaattatataaggattaagggctcacctctgcttccggcttcgtggtaactttggtggttcttcatatggattttgaaatatatctaaaaaaattggctcatattttttgaatattacagtagacacctcaaaatttctctctagcctttctatacgttcacgaaattcttgtggtagatttgacatgtccatccatttcttcattttactaaaaaattgtattaaactaaaaaaaaaaaggaggagaaaaaaggcacctttaaaattcatttaaataatggattgaaaggaaatattctattcatgactaagactctttattaaaaagccagatttcccaggcaacatagttaagaccccatctctacaaaaatttaaaaaattagctgggtgtggtggcatgtgcctgtagccccaggtacttgggaggctgaggtgggagaattgcttgagcccaggatgtcgagactgcagttagcctcaatcatgtactccagcccgggtgacaaagcaagacactgtcttacatgaacaaagaacaaacaccatccctcaagcctaaatttaattaaaaaaaaaaagtcctcactatgaaatcactttcgttcccaggatcaccaggggaatacaggttattaattagtggtcatcacatagagtttactgctatggagggagcgagagcacctatctacttcctttattctctatattacctagacaatattttgcataaaatttacaaagttaatgttagttaacagattgacaggttataaaattagtttgagatcacctgagatcgggagttcaagacacagcctgagcaacatgaagaaaccccgtctctactacaaatacaaaattaggagctctccctctccctctccccacggtctccctctccctctctttccacggtctccctctcatgctgagccgaagctggactgtactgctgccatctcggctcactgcaacctccctgcctgattctcctgactcagcctgccgagtgcctgcgattgcaggctcgggccgccacgcctgactggttttggtggagacggggtttcgctgtgttggccaggccggtctccagcccctaaccgcaagtgatccgccagcctcggcctcccgaggtgccgggattgcagacggagtctggttcactcagtgctcaatggtgcccaggctggagtgcagtggcgtgatctcggctcgctacaacctccacctcccagccgcctgccttggcctcccaaagtgccaagattgcagcctctgcccagctgccaccccgtctgggaagtgaggagcgtctctgcctggccgcccatcgtctgggatgtgaggagcccctctgcctggctgcccagtctggaaagtgaggagcgtctccgcccggccgccatcccacctaggaagtgaggagcacctcttcctcgccgccatcccatctaggaagtgaggagcgtctctgcccagccgcccatcgtctgagatgtggggagcgcctctgccccgccaccccgtctgggatgtgaggagcacctctgcccggctgcgaccccgtctgggaggtgaggagcatctctgcccggccgccccgtctgagaagtgaggagaccctctgcccggcaaccgccccgtctgagaagtgaggagcccctccgcccggcagccgccccgtctgagaagtgaggagcctctccgcccgacagccacccagtctgggaagtgaggagcgtctccgcctggcagccacccagtccgggagggaggtggggggggtcagccccccgccaggccagcacccccatccgggagggaggtgggggggtcagccccctgccaggccagccgccctgtccgggagggaggtgggggggtcagccccccgcccggccagccgccccgtccaggaggtgaggggcgcctctgcccagctgcccctactgggaagtgaggagcccctctgcccggccaccaccccgtctgggaggtgtgcccaacagctcattgagaacgggccaggatgacaatggcggctttgtggaatagaagggcgggaaaggtggggaaaagattgagaaatcgaatggttgccgtgtctgtgtagaaagaagtagacatgggagacttttcattttgttctgtactaagaaaacttcttctgccgtgggatcctgttgatctgtgaccttacccccaaccctgtgctctctgaaacaagtgctgtgtccactcagggttaaatggattaagggcggtgcaagatgtgctttgttaaacagatgcttgaaggcagcatgctccttaagagtcatcaccactccctaatcgcaagttcccagggacacaaacaccgcggaaggccgcagggtcctctgcctaggaaaaccagagacctttgttcacttgtttatctgctgaccttccctccactattgtcctatgaccctgccaaatccccctctgtgagaaacacccgagaattatcaataaaaaataaataaatttaaaaaaaaaaacataaaataaaataaaattagtttgagggaaaacagaagtctcccaaatggaaagacaattccattttccaaatgggaatttgattacaaagcaccagattgttacaggttaggagtaaaattcaagagtttgagttccaatgtgtggttccacaaccaaaagtaaagaaggtagcacatactcagaaaaaaacttaatagttctggtgcccaggttggagtgcagtggcaccaccttggtttactgcaacttccacctcctgtgttcaagcaagccaccgtgcccaggccaattctgggtacatttttttatgtccctatgttaacgtggtcttagatagaaaacttgtcatgtcaaagctcacttaattaaaggtctagcaatatatacagaataatacttgtaattttttttttttgagatggagtctcagtctgtcacccaggctggagtgcagtggcatgatcttggctcactgcaacctctgcatcccagcttcaagcaattttcctgcctctacctcctgacagctgggactacaggtgcacaccaccatgcctagctaatttttgtatttttagtagagacaaggtttcaccatgtttgccaggatggtcttgaactcctgacctcagatgatccacctgcctcggcctcccaaagtgctgggattacaggcatgaaccactgcactcggccctatgttctgattatttcatgtagattggaaaggcttacttgagtccatttcgcctggccaatacttataatttctttttaaggtgacagaagacattaatagcaaatcatccaaagctatttaatgtggtttggatgttttgtcccctccaaatctcatgttgcaatgtaatttccttggctgggcatggtagctcatgcctgtaatcccaacactttgggagggtgaggctggaggatcacctgagcccaccagtttgagaccagcttgggcaacacagtgagatctcgtctctacaaaaaatttaaaagttagcaaagcatggtggtgtgtgactgtgggcccagctactcaggaagctgaggcaggaggatcacttgagcctgaggggttgaagctgcagtgagtcatgaacatgctactgcctgggcaagagagtgaaagcccgtctcaaaaaaataaaaaagaaacgtgacctccaatgttggaggtgggcctagtgggaggtgtttgggtcatgggagcagatccctcatgaatggcttggtgctctcctcatggtagtgagtttagttgtcactcacctgagatctggctgtttaaaagtgtggcacttcccaccctcaattgctcctgctctcatcatgtgatgtgcctcctcccccttcacctaccgtgactgtaaacttcctgaggccctcaccaggagcagatgccagccccatgcttcctatacggcctgcagaaccctgggccaaataaatctctttttttaaataagtcacccaacctcaggtattccttcatagcaacgtaaaacgtcctaatacagcattcaaactctggacatgctgatataatctgagactcttaaggacctcattaaaagattcttaccaacagcagcaaaaaatttgtcagattactaaatattttttggcttacaaaaaattatgctcccttacagaggactttaaaaattttgttttttggccgggtgcagtggctcacgcctgtaatcccagcactttgggagtccgaggcaggtggacaacctgaggtcaggagctcgagaccagcctgaccaacatggagaaaccctgtctctactaaaaatacaaaattagccgggcgtggtggcacatgcctgtagtcccagctactccggaggctgaggcaggagaattgcttgaacccgggaggtggaagttgcggggaggtggaagttgcggggaggcggaagttgcggtgagctgagatcgcaccattgcactccagcctgggcaacgagagcgaaactccgtcttaaaaaaaaaagactgtttttatttttggatgatcacattttgcatgtgaaaccctctgctttgaggacatttccacttttgagccttgtctaccactaaacagatcagctttactggaagctaggatgaaggcatataatctgatatcctttatcagatacatctgcttgagattttgaatctgaagctgctggtgcagagaagtgaagaagtggtgaattcttagagcaggatcaatctcctggggcaaataaagtggcaatgtccagggacagcattgctagccatgcaaactatgtccctgctagatggattctgtgatatgctctttggctgtgtggccagcatccttttgttcctggccttttctaagcgtagttttcttaagtcatcctaaagattttatcacctatccaatacttcttttaggtcaggcaaagttggtaagtgatatctcttatttttttgagatagggtcccgctctgtcactcaggctgcagtacagtggcatgattgtggctcactgcgggcttgacttcctgggctcaagcaatcgatcctcccgctccagcctcccaagtagctgggaccacaggtatgtgcccccacacccagctaattttaaaatgttttttagagacaggggtatcactttttgttgcctagactgatacttgctttttataaacaagagccttgactacatcatcatataatccattgtacatactactctcccaagaatggctttcctaacctggaacaaaatgcatcagggtgtttgaaaacaaaaaaaccttatagcactgttataacttaaatcataattacagtttttaaaactaaaataagaagcaaagtaaacttcacagctttcaattcattgggattctgttacaaagaatatgctactgctgggtgtggtggctcatatctgtaatcccagcactttgggtgactgaggtgggaggattgcttgagcccaggagtttgagaccagcctgggcaacatagtgggacctcatgtctacaaaaaacttaaaaattagctagacttggtagtgtgcacctatagtcccagctactcaagaggctgaggtgggaagattgcttgagcccaggaggtcaaggctgcagtgagctgtgaccacatcactgaactccagtctgggtgacagagtgagatcctgtctcaaaaaaagaaaaaaaaaaaaaaaaagaatacactactcaagttgggtgtggcagcatgtacctgtagtcccagctactcaggagtcttaggtgggaggactgcttgagctgaggaattcgagatgagtctgggcaacatagtgtgatctcatcttataaaaaaaattaaaaggccgaagcgggtggatcacaaggtcaggagatcgagaccatcctggctaacacagtgaaaccccgtctctactaaaaatacaaaaaaaaaaattagccaggtgtggtggcgggcacctgtagtcccagctacatgggaggctgaggcaggagaatggcgtgaacccaggaggcggagcttgcagtgagctgagatcgcgccactgcactccagcctgggcaacagagcgagacactgtctcaaaataaacaaacaaattttaagctggcatggtagcttacacctgtaatgccagcactttgggaggctgaggcaggaagatagctttgagtccaggagttcgagaccagcctgggcaacatagagagaacctgtctctatataaagtttaaaaattagcttggcatggtggcatgcacctgtgatcttagctactcgaggggctgaggtaggcagatcgcttgagcctgggaggttgagagtgcagtgagccatgattgcgccattgcactccagcctgggtgacagagcaagaccctgtctcagaaaaaaaaaaaaaaaaaatttaagagagagagagagaagagaatacactatccaagcaagtacatgaaaaggtgctcaacatcattagccatcagggaaatgcaaatcaaaactgggatggctacaataaaaaagatggataacaagaagaattggcaagaatgtggagaaactggaacccttgtaaactcctggtggggacgtaaactggtacagtcaccttggaaaaaagcctgacagttcctaaaaaggttaaacacagggctgggagcggtggttcacgcctgtaatcccagccactcaggaggctgaggcacaagaatcgttgaaacctgggaggcgcaggttgcagtgagccgagatcatgccactgcactccagcctgggtgacagagtgagactctgtctcaaagaaaagttaaacatagaatcaccatatgactcagcaattccactcctctccatatatatccaaaagaaaaaatatatgtccacataaaaagttgtatacaaatgttcatagcaacactaatcaatagccaaaaggtagaaataactcattaactgataaatggataaacaaaatgtggtatatctatgcaatggaatattattcaaccataaaaagaactgctgatacatgctacatcatggatgaaccttgacaccattatcctaaagaagccaacacagaagaccacatattatacgattccatttatatgaaatgtccagaatagaaaactctatagagacagaagttggatcagtggctgccaagagctgggtgtgggggttggaatacgaagtgaatgctaacaggggtttctttttggggtgatggaaatgtcctaaaatggattgtggtggtggtacacaactctgtgaaaatacaaaaaaccatggaactgtacagtttaaaggatgaattatatggtatgtcataatatctcaataggctattaaaaaatacctccccacaacactactccaaagaggttacagtaaatacatgtaaatatgttagaaatattaatttgttcacttttttttttgttgagatggagtctcagtctgtctcccaggctagagtgcagtggcgcgatcttggctcactgcaacctccacctcctgggttcaagtgattctcctccctcagcctcctgagtagctgggattataggcacatgccaccacacctgactaatttttgtatttttggtagagatggggttttgccatgttggccagggtggtctcaaactcctgacctcaggtgatccacccacctcggcctcccaaagtgctgggattacaggtgtgagccactgcaccggcctaatttgttcacttttctagaggcaatttggcaacatgaataaaaagccttaaaaatgctcaagtcctttcatccagaaattactttttaaagactctaacctaagaagaaagtaaaaaatacaggcaaaaatacaaagatgcatatcatgatactttgtgtgaaggtgttgttttttaataagtaatatgcacaagcacaaaattctaaaagttactaaagcatgtataatgaaaattctctttctcatcacctgcctcccagtttttctccactaaggcaatcatggttgccttagggactaatagactgtcaccaggttttgtttatctttgcagaggtattttgggaatttataaacatataccagcatacataattttttccactcaaatgatgtcatactacaacagtagtccccccatttatcctcagggaatatattgcaagactcaagagatgcctgaaactgcaaatagtacagaaccatatatagagtatatattttcctatacgcatatacctatgataaagtttcatttacaaattaggcacagtaagagtttaacaataataaaatagaacaattataacaatttactataataaaagttatgtgaatgtggtctctctctctttctcaaaatatcttattgtactgtactcacccttcttgtgatctgtcaatctctgataactgagagggccactaagtggccaacaggcaggtagcatacacagcatggatacagtaaacaaagagatgattcacgtcccaagcaggatggagtggatagcacaagatttcattatgctactcaaaaccatacacaatttaaaacttaaaattgtttatttctcgaattttccatttaatattttcaaaccatggctgatgggctactgaaaccatggaaagtgaaaccaaggataaagaaggattaatgtacctacaatattctgcaccttgctttttcctctaatttatcttggacatgtttttacatcagtaaaaccccttctatcactttaacagctggagtttattccattgtataccattccttttatctcttaaacttttcactttgaaataccatcaaacctacacttgcaaggagagcataagaagtcctttataccctttaccaaatattaacattttgcatatttgctttatcattttttttttttttttttgaggcagagtcttgctctgtcgcccaggctggagtgcagtggcacaatcgcggctcactgcaatctccgccttccgggttcaagcaattttcctgtctcagcctcccgaatagctgggactacaggcgcctgccaccaagctcggctaattttttgtagttttagagagactgggtttcaccacattggtcaggctggtctcaaacgcctgacctcgatgatctgccccaccttggcctcccaaagtgctgggattacaggtgtgggccaccttgcccagccatctatatatacatgtatactgtatatacatatgcatatatggtagtaaattttatgtgtcagcttggctgggccacgatgcccagatattttctcaaatattctggatctttttgtgaaggtgtttattagatgaaatcaacatttagattggtggacttttagtaaagcagattactcttcataatgtaggtggaactcatccaatcagctgaaggtcttaatagaaaaaagactgacctcccttgagtaagaagaaattctaccacaagactgcctcaagactcaaactgcagctcttccctcaagatgaagactcaaagtgcagtctccaacatggggcctaccccatcagactttcaactctccaagcctccatcgtgtgagccaattccttaaaataaatttttctctatatatagcttgttggctctttttctctggataatcctagttattgcaatatacatataatttttttctgaaccatttgagagtcacgtttagctttcatgccctttacccaaaaatacttcagtttctattttctgaaaaaaaaaaaaaaaaattctcttacataaccaaagtacaattatcaaaatcagaaaattttacattgataaaatattagtccatatttcaacttaaatttaaaatttaccaattgtccaaatgttctttcggagcaattttaaacatcctaatccagtagcatgtattgcatttaggtgtcatttcctttctgtttctttcagcctggaaccagttcctcagacttctttgtaacacgaacattttagaagacaattggtcagttatttgtagtatgtccctaatttgggtttgtctcatgcttccctcattattagatttaggctatgtatttttgacaagagtattacctaagtgatgtcatatccttgtcagaggatcatatccattagtcccattactgataactttgtacttgatttaggtggtatgtgccatgttttccatttcaaagtttctattttttcctttgtaattagtgattcataggagacactttgcaattacgtgaatattctgttcttcatcaaacttttattcactagttttaatatccattgatgatctttgactgtatcaattattactatgaggttgcaaaatggtgactattttctaattctaccactttttctacatttattagctggcattctaatgtaagcagcattcctttctaataacgggagtctaccaatgggagtcttttcaacctagcttctaagttccttgacacacctccaccattttgttgagcactccttactttctggcataagaagctgttccagatgcatcagagaaaacacgtctgctaagcattggaatcagccatttccttgaggacattacgataagtgaaataagcatgtcacaaaagaacaaatattgtaggatgacacttctaagagatgctcagagtaatcaaattcatagaggaagaaaaagtagaatggtggttgctgaggctgggggtaagggtgaaatgggcagttttcattttggttttatttgaagtttaacactaatattttcctatgtaaggcttaatgtatagttacaatgatctgattagtcaagatggtctttttttggggggcgggcagggggaaggtatatttaacatttcacactgaagatgtaactgtcatgggttcctagcactttaggaggccgaggcaggcagacccttggagctcaggagttcaagaccagccttggtaacatggcaaaccccatctctataaaacaaaaactacaaaaattagcctggcatgatggtgtgtacctgttaagtcccagctacttgggagggtgaggtgggaggactgagcccaggaggtagagactgcagtgagctgaggtggcaccactgcactccagctgatgccacagagtaagaccctgtctcagccaaaaaaaaaaaaaaaaaaccctcaaatgccataacagcagtgtagacaaaaaataacaaatgattataatttttagaaaaagaaactttttttgttatcaagtttcccaagatctaaaccagctgtttagccaatcttttatttgggtctttatatcggccattaacttagtgatgttatctgatttatctgggatatagatacttagtttttgagaacagggggcagccagttgagatttttagatgctgggcttaaagcattttttttttttttttttttgagaagggtcttgctctgtcacctaggctggagtgcagtggcatgatcatagctcactatagtctggaactcctgggctcaagtgatcctctacctcagcctcccaagatagctgggactacaggtgcatatcaccacacttcactaacattctttgtaaaatttttttgtagagactaaaaagtagtctcttactatgttgcccaggctggtcctgaactcctgggctccctcccaagcgatcctcccacctcggcttcccaaagcgttgagattacaggcatgagccaccacgcccagcccacaaaggtttctatatgtaagctactatggtgacttttctgaagtttacgtaaaattgtccagtttcagtttgccaggcttcaggaaaaagcagttttaattttagtgatttcaagtcagaaaagtgggagaaaaatttagaaacatcaatttcaagacttgcagacaggaaagaattcaggacttagtccaaattctatgcaaataataaatttaaaaaaatagtcaaggctggaatttaataataggtatgctataattttgatagaatgtacttttttttttcctcttcaattccccatttttaccaaagattaatcttagtgggaccaatttactttctttttaaaaatatttattttatttatttatttgattttattttttgagacaagagtctcgctctgttgcctaggctggagtgcagtggcaatcttggctcactgccacctctgtccactgggttcaagcaattttcctgccttggcctcccaagtagctgggattacaggcaagcaccaccatgttcggctgttttttgtatttttggtaaagatggggctttactgtgttggccaggctggtctctaactcctggcctcaagtgatctgcccatcttggcctcccaaaatgctgcctgtgcctggtcccgccgcaatttactctctctctcttttttttttttttgagatggaatctcactttgtggcccaggctggagtgcagtggtgcgatctcggctcactacaacctccacctcctgggttcaggtgattctcgtttctaagcctcccaagtagctgggattacagacacccaccattgcgcccagcaaatttttataattttagtagagacagggcttcaccatgttggccaggctggtctcgaactcctgacctcaatagatccacccgcctaggcctcccaaagtgctgggattataggtgtgagccaccacgcctggctcgcaatctactttcaaaataaggtttagtaatatatttggcctgattctttgcatagggggcaataagaatagtgagtggccacctaggctcttttaagttggttttgttggaacattcataaggaattttggattagacttttaaaagccttgaggctaagaagtcaagccaaggatccatcatcagactgttcccataatacctgtatgcattgggtgaaatcctctcttcctgaagtccccaaaaatatcttgaggttcctgggcttgtcagaaagtgacatcttttacttactgcaaggtcagggaccttgttagggaacctttgaacaataatgattgctcaaggaattgctttgatcaaagggacagtcatgtagtctgaaacagtttccaggaccacttctctcttgtttaaaattcagctttggtcctttgtaatattcccccctccatgagactcaacttcttaggaatgaaccttcctaatggtgtgagatattgacttaaacatgacccaaatacatgattgttctgcaatggcgagtcaatcttcccaaatcttttttatcagctctataaagtaaaccttggctggtgcggtggctcacacctgtaatcccagtgctttagtgctttgggaggcaaaggcaggaggatctcctcaagccagaagttcaagaccaacctgggcaacaaagccagacccagtctctaagaaaagacaaaaaacaaaacaaaacaaaaacttagccaggcatggtggaatgcacctatagccccagctacttaggtcactgaggcaagaggacagcttgacccccccaagtttgaggctgcagtgagctatgatcatgccattgcactccagcctgagcaacagagtaaaagcctgtctctaaaaaacaaaaacaaaacaaaaacaacctcaatgttttaaagcagtctggtcatatctgaaaatttgccattccaatcaaagcctaggtaaaataaccagtgtctatgattgtgtccttagaagcagaactttaattccagctccatcaagtgtggaattggttgcttgaacaaagtatgaatctcaaaccaaaattaggaagatttgaaatctgagaggagactcaccagagacccctgctggctcagcgagattgggtgaatggtaccaaggctccaattataatatcagtaaatggaggctcgcttcaggtcacttcatggttgccaaaatgtcaactggccaggagacatagggcagcagcagcccctagaagacagcacagagcatgtgtctctatgccgggggagcctgcaaggctgggccaggatcataaggtttctccctcactaagggacaacgcaggggcctagggacaagaatacaaccagaaaccccagggacctgcgtacctccttctttttctcctcctcaggttggggccagccatcccccctgctggtgatgatacagtcagccctgcacctcagtggagcagagcacagcatagttcactgaggcagagctgggctggactaacagctaaacagctgagttaccatttaatgtgtatagtttgggaagataagaaagttcgggaaatggtggtggtgttggttgaacaatgtgaaggtgaaggtatgctgaacttaaaaattgtcaactttatgaattttatgttatatatattttactccaccaccaacaccatacacatacaaacacacacacacacacactctctctctctctagagtttaccctccatatctgtgagttccacatccatggattcaaccaaccacacatcaaaaataattggaaaaaaaggatggttgtgtccgtattgaacatgtaccaacttcatttcttgtgattattccctaaagtatacagtgtaacaactactgacatagtatttacattgtattaggtataaataatctagagatgggaccaggtgtggtggctcacccctgtaatccctgcactttgggaggcgaagatgggtggatcacttgagctcaggacttcaagaccagcttggggaacatggtgaaaccccatctctaaaaaaaaagagctacaaaaattatctgggcatagtggcacacacccgtagtcccagctacttgggaggatgaggtgggaggattgcttgaatctgggaggcagaggttgcagtgagctgagatcatgttactgtactctagcctgggcaacagagtaagaccctgactcaaataataataaaagttaaaaaaattatatttaagttgaaattttgaaaacagcccaaattattataagtcaaagcaaacaaaatcatttgaaatttttgtttatttctctgaatgaacacattgatgctgggtaactgctcttttagcattaaaaatttgacacttaaaaacgttttgcggaaggctgggcgcggtggctcatgcctgtaatcttagcactttgggaggctgaggcgggtggatcacttgaggccaagagtttgagaccagcctggccaacatggtgaaatcctgtctcaactaaaaatacaaaaattacctgagcgtgatgaaatgcacctgtagtcccagctactcaggagggcgtggtgggaggatcacttgagcccagaaggcggaggttgcaagtgagcagagatcgcgacaatgcactccagcctgggtgacaaggtgagaccctgtctcaaaaaacacaaacaaaaaataaaaaagataaaaacaggctgggcgcggtggctcacacctgtaatcctagcactttgggaggccgaggtggatggatcacaaggttaggagttcaagatcagcctggccaaaatagcgaaaccccgtctctactaaaaatacaaaaaaaaaaaaaaaaaaaaaaaatacaggtgggtgtggtggcatgcacctgtagccccagctactggggaggctgaggcaggagaatcacttgaacccaggaggaggaggctgcagtgagcagagaccgtgcattgcactccagcctgggcaacagagcaagattctagctcaaaaaaaaataaacattttgggggaaagggactttgagaatatcaatctacattttaaaaagacttagttttcttttttttcataagtttgtaattatttttaatggatttttttttttttttgagagtgggtcttgctttaccagcctggctggagtagagttgcatcatcataactcactgcagcctccacctcctgggttcaagtgattctcccacctcagcctcccgagtagctgggattacaggcatgcaccaccatgcctggctaatctttgtagaaacagggtatcaccctgttgcccaggctggtcttgaactcttgggttcaagagatctgcccgccttggcctcccaaagtgctgggattacaggtgtgtgccactgggcctgaccaaaaaagatacatcttttgacccatttttaggaatcatacatatttttggaatttatcagaaatatcatctttacaatgatgtttatttgtccgcaactacaaaggactggatacaatcgaaatggccataaggcatggctaaatagatgaaagatccttataccctaaaatatcctagtatcattaaaaaaattaatgaggtagaactacatatgctgatatggaagaatttccaaaatataaagaaaaataactgtagagcaacacatatagtataatttatgttttaaaaagaaaaaacaccagcctgggcaacatggtgagacccgtctctacaaaaaatataaaatttgccaagcatggtggtgtatacctgtggtcccagctactcgggaggctgaagtgagggatcgcttgagcctgtgatgtctaggctgtagtgagctgtgatcacaccactacactccatcctgagtgacagagcaagactctgtctcaaacaaataaagagaaaagaaaataaaaagaaaaaataccaaaaaacaagtttatatatttgtacataggaagacctttttttttgagacagagttttgctcttgttgcccaagctagagtgcaatagcacaatctcggctcactgcaacctccacctcctgggttcaagaaattctcttgccttagcctcccgagtagctgggattacaggtgtgccccaccatgcccgactaattttttgtatttttatagaaatgaggtttcaccatgttagccaggctgatcttgaactcctgaccccaggtgatccgcccgtctaagccttccaaagtgctggggagtccaggcatgagctactgcgcctggccagaagaaattattaataatggttaattacggagagtgccaaaaggagacgtttttcttttcttttcttttttttttttttttgagatggagtttcactcttgtcacccacactggaatacaatggcacgatctctgctagctgcaaccttcgcctccctgggttcaagcaattttcctgcctcagcctccccagtagctaggattacaggcacccgcaaccacgcccagctaatttttttgtattttttagtaaagacggtgtttcatcatgttggccaggctggtcttgaactcctgacctcaggtgatccacccgcctcagcctcccaaagtgctgggattacaggtgtgagccactgtgcgtggccaaggatactgctttctacttataagccttctgtattatttaaaatttttgaaaatacatttgtgtgtacgtgtgtgtgcgtggtaaaacatacataacctttaccgttgtaaccactgttaagtctatagttcagtagcattaagtacattcacactgtgcaaccatcaccactgtccatctccagagtttgtttcattatttgaaatttgattttttttttttttttttttttttgagacggagtctcactgtgtcacctaggctggagtgcaatggcgcaatctcggctcgctataagcgccgcctcctgggttcacgccatactcccacctcagcctctcgagtagctgggactacaggcgcccacctggctaattttgtttttgtatttttagtagagatgaggtttcactgtgttagccaggatggtctcgatctcctgaccttgtgatccacccggcttggtctcccaaagtgctgggactacaggcgtgagccaccgcgcccagccttgtttttttaatttgaaatggagtcttgctctgtcgcccaggctggagtgcagtggcgctatctcagctcactgcaacctccacctccaaggttcaagtgattctcctgccatgtactgctctacatttgttttgttataattcttttttgtttagttcccccagaatctgtcattacaaagatttttgaaattatatgaacaatgacaaacattgacagaaaaagatcagattgttttatactaacaatgataatgtcttgctcaattaaaaaattaaccccattgatcttcatttaatttttatcatcttattttatttttagaaccaaagttgtttaaaaacattttttttaggctggacacggtggcttacgtctatagtcccagcacttagggaggccgaggcgggtggatcacctgaggtcaggagtttgaaaccatcctggccaacatggtgaaaccctctccctattaaaaatataaaaaattagccaggcgtggtggcgggcgcctgtaatcccagctactggggaggctgagatcaggccattgcactccagccggggcaacaagagcaaaactccgtctcaaaaaataaaaataaaaaaaaatttaaatttagcatcaactaaaacctatttgccatttctgaatagggctttaaactttgctcctcttctattctggaaacacaggaatagcaaatagacaatgaccacaaatagttttgtcccagaaacaaagaatattagcatgaatccaaactggatagctaaatttgttttgtttcctatccagccaaataattctatatgcttgatactagagtaagtaaaagatgtatctgagacccatagagtagctgcaaggtgaaaaaaattaatatacagtagagaaataggacaacatcttgaccagatgacaaaaattaacatcaccaatgagatgcagatggataacacatgccatcatcagatgtgatatcctcaggagacaaaatcacttatacagttttccatcagggaatgactaacctgcatctaatcaaaagttaataggagacaaatccaaaattgggaaccatctattaaaagaggggatgagggtgggcacagtggctcacgcctgtaatcccagcactttgggaggctgaggcaggcggatcacaaggtcaggagtttgagaccagcctggctaatatggtgaatccacatctctacgaaaaatacaaaaattagctgggcgtggtggcacatgcctgtagtcccagctactcaggaggctgaggcaggagaatcgcttgaacccgggaggcggaggttgcaacgagtccagattgcaccactgcactccacctgggcaacagagtgagactctgtcccaaaaaaaaaaaaggctgaggcaagaggaccacttaaggtcaggactttgagacaagcttgagcaacatagtaagaccctgtctctataaaaagatttaaaaatatcagtcaggcatggtggcacatgattgtagtctcagctacttgggaggctgaagcaggaggatcatttgagctgaggagtttgaggctgcagtgagctaaaaaggtgccactgcactcgaggcctgggcaatacagcaagactcggcctctaaaaaaattttttttaattaaagaaagggacaaagtgattgtggattatattcttcaaaaatggtaatgtcataaaagaaaaagaaaggctgtggaaatgttcctaattacagaagaataaatagacatgataagcaaatgcaatacctgatccttaattagaaattgtacttccaggaaaaaaaatgccataaagaacattattgaatcaactaacaaaactagaacagagttagcaggttaaataaaattattttatcagtgttaattttgctgaagttggtagctgtactgtagttatttaaagaaatacacagtgaagtattttggggtaaaaggctacaaatgtatgctacttagactgaaatggttgaggataaaaagagaaagatctggctgggagtgctggctcacgcctgtaatcccagcatttagggaggctgaggcgggtggatcacctgaggtcgggagttcgagaccagcctgaccaaacatggagtaactccgtctctactaaaaatacaaaattagccaggcgtggtggcacatgcctgtaatcccagctactcgggaggctgaggcaggagaatcgcttgaacccaggaggcagaggttgtggtgagctgagattgcaccactgcactctagcctgggcaacaagagcaaaactccatctcaaaaaaaaaaaaaaaagagagagagagaaagatctatatattgaagaaagaaaaatcaaatgagaaagcaaatgggataaaatgtcaataacaggtgactctgagtcaagggtatatgggtattgtccttttcttatttttgtaacttctctgtaagcctaaaattatttccaaattttaaaaaattaattttaaaaagtatagctaaagattcaacacagaggtttctagcagaatttgagaaaggcagagaaagaatatgaaaattgggaaaggattatctatgttataacttagaattaaatgaagtcacacagtggctcacgtctataatcccatagcactttgggaggttgaggtgggtagatcatttgaggtcaggagttcgagaacagcctgaccaacatgatgaaaccccatctctactaaaaaaaaaaaatacaaaaaattagccgggcttggtggtgtgtgtctgtaatcccagatactcaggaggctgaggcatgagaatcacttgaacccaggaggcagagattgcagtaagccaagactgtgccactgcactccagcctggctggcacagtgagactgcgtctcaaaaataaataaataaataaataaataaaataaaaattaaatgaagtcaaatgatctcaaaacaagagaaaactgattccaaaatttagagcttatataacatttaaaaacatcaaagaggtttaccttaatttagctgaacgtagtattctggtaagtgaaacacagttgccttccatgataccctttccaaccgtgggaataatgcttttgcggcatgcaacatataatgaacatgccaaccagtgtgtaacttctccctggcaagcaaaagacaaacagcaaaacaggtataatattatgttaaaatgctttaattctagaaacaagagatgtagaattatctggtctcaattttccttatgtagataaagggccagagaagtgaagatatttgcccaaggtcacaaagctgttagttgcagtaatgggtataaaactccttactcttagttctgtgtttttacaactataacatgctaaattaatattaatctaaagataaaagcctggcttggtggctcatgtttgtaatcccagtaactcgggaggctgaggtgcgagtatcacttgatgccaggagtttaagactagccagggcaacgtagactctaaaaatgaaaataaaaaaattagccaggcatggtggtgcttgcctgcagtcccagctacttgggtggctgaggcaagagtatcgcttaagctcaggagttcaagactgcagtgagctatgtttgtgccactacattccaacataggcagctgagcgagatcctgtctcttaaatcctgtctcttaaaaaaaaaaaaaagaaaaaaactctttcacctacactccaaatctaatacaggcatatgccacataacatcttggtcaacactggaccacatatacaatggtggtcacttaagattataatacttgccaggcgcggtggctcatgcctgggaggctggagcgggtgaatcacttgaggccaggggttcaagaccagcctggccaacatggcaaaactccgtctctactaaaaatgcaaaaaattagctgggtgtggtggcatgcacctgtagtcccacctacttgggaggctgaggcaggagaatagcttaaactcgggaggcagaggttgcagtgagtagagatcgtgccactacagtctagcctgggcaacacagggacactctgtcacacacacaaaaaagattgtaatactgtatgttctaactgttctatatatttaaaaaattataatttactgtaccccttttatgtttagatacacacatactcaccattatagttgcctatagtgttcagtacagaaacatgctgaacaagtttgcagcccaggagcaacaggctatattaaacagcctaggtgtatagtagactacactatctaggtttgcataagtatactctgtgaagttcacacaacaaaatcacctaatgttgcatttcttagaccatgtccctgtcattaagtgaagcatgtctgaattaccagaagagttttattaaaatttgtcagcatgactttcttgattttaagaaatggccttgatgatcctgaagtttctatcgtttttgctttatgtttctctttagtgtggcagggaaaggcaagaacagagtaaaaagttggcaagggagtcacacataaaaaattaatattaatcttacgcaacatgaaggagactgtcatttttgtaaggtaaacatttggggatttaccccaaaacatgtcatctttaaaatacagtcatatgcattgcttaatgacagggatatattctgagaaatgcaacattaggcaattttgttgtgcaaacatagcatagcctactaaacctaggctatatggtatgcttattgtttctaggctacaaacctgtggagcatgttactatactaaatactgttggtaaatgtaacacaatagtaattatttgtgtatctaaacacagaaaacatatagtaaaaataaagtatgtgtggtccatcactgactgaaacattctgcagcacacgactgtagtaagcacggctctttatattagtagatatctcaatttacaatgccacaaaaaggtgacatttgggaattcaacaattttctgcattagacttcagacatctccaagctagaatcacttcatgacttcactgctgaaatacaatagctgaagtttaaggattaagaattacggataggccggtgcggtggctcacgtctgtaatcctagcactttgggaggccgagatgggtggatcacctgaggtcaggagtttgagagcagcctggccaatgtggcgaaaccccgtctctactaaaaaatacaaaaattagccaggtgtggtggcgcacgcctgtaatcccagctacttgggaggctgaggaaggagaatcacttgaacctaggaggtgggggttgcagtgagccgagatcacgccactgcactccagcctgcgcaacgggagtgagactccatctcaaaaaaaaaaacaagaattacagataaaggccaggcacagtggctcatgctcgtaaccccagcactttgggaggctgaggcagaggattgcttgagctcaggagttcaagatcagcctaggaaacatagtgagacccccgtctgtacaaaaaaggaaaaaattagccgggtatgtggcacgtctgtagttagagctacctggggaactgagatgggaggatcatttgagtccagaaggttaaggctgcagtgagctgtgactgacccactggactccagcaagggtgaaagaacgagactctatctcaaaaaaaaaaaaaaaaagaattacagatgtaaatctgatagcacaacacaatagtgttcttatacactgttccacagactgtctttaagaccaaaccctagaaggataaaaagattgataaaaagatttcttgcaataatctaaaaggggtgggtagaaatgggtggccatcaataaacccaatgttcctaccctgaaggaatgagaagtcttttctcaaagcactaaatgaggcaggtaagcttaaagatgaatatttttacaagctttgattaatgaattgcttgggaatagggtctggtcatggtggcttacgcatgtaattccagcactttgggaagctgatgtgggtggactgcttgagttcaggggttcgagactagcttgggtaacacagcaaaaccctatctctacaaaatacaaaaaaattagcaggacgtggtggtatgcgcctgtagtcccagctactctggaggctgagatgggagaagtgcctgaggccctttttttgtctcaaaaaagaaaaagagaaagagttgtttgggattagcatccaagtattatagagcctttggatacaggctactaaatgaaaattctagcaagatggtgaaaatataagtcctaaaattattgtttcgatttttttaaagacattaaagaatacactgatttttattttactttttaaaacagggtctcactctgttgccccaggctggagtgcagtggtacaatcagggccactgcagtcttgacttcccaggaatgagggccactgcagcctcgacctcccaggctcaagcaatccccccaccttagcctctggagtagctgggactaaaggcacatgccaccacacccagctaatttttgtagagatggggtttcaccatattgcccaagctggtctcaaactcctgggctcaagtgatccacctgcctcagcctcccaaaatgtcgggataacaggtgtgagccaccatgcccagcctattttattttgtgtagagatagggtctcactatgttgcccaggctggtcttgaacttctgggctcaagtgatcctcctgcctcagcctcccaaagtgctgggattataggtgtgagccactgtgcctggcctgactttctttccttaaaaaagtcaactattttattccatgagaataaaatagaatacaattctatttgataaaatcctatttcataaaaattctatgaattctatgatatcagaaaccattttttgcatttctaaggcctacttgccaggccttagaaatacaaaaaatgttttctgatctcacagaacttcacatctggagctaagaagaggaacagatactatcatttataattggtgagatatacaagctataagaagaactgaagataaagtgttgtaggagaatatagtgcagtgaataactgattttgactacagtttagggaaggcctcacaaaaggagacaaaatttgtaaatcaataaaaatgtaagcaggagtttgtcaggtagactagagaggggtagggattggagaaagacttcttaggaagcatgagatatatgaaaatgactactccaaatacctttaaaaaattgattttaaaaaaagaggaaaataaacactggatagaataaacacaaaatttcagttcatacatttgtgctttctaaagcaagcattgggctgggctcggtggctcatgcttgtaatcccaatgctctgggaggctgcggcagaaaaatcacttgaggccagttcaagaccagcttgggcaacatagtcagatactatctccacaaaaaattgaaaaattagctgagcaccgtggtgcatgcctatagtcccagctactggggaggctgaagcaggaacatcacttgagcacagaagtttgagtttacagtgagctataattgcaccactgcattccaggcctggtcaaaagagcaagaccctgtttctttccattttttttttttttttgagatggagttacactcttgtgcagggtggagtgcaatggcgtgatcttggctcactgcaacctctacctcctggtttcaagagattctcctgcctcagcctcctgagtagctgggattacaagtgcacgtcaccatgctcagctaattttatatttttagtagagacggggtttcaccatgctggccaggctggtcttggacccctgacctaaggtgatctgcccacctcagcctcccaaagtggtgggattacaggtgtgagccaccgtgcgcccggccaagaccctgtttctaaggaagaaaaaaagaaagaaaaaataaataagtagagcaaacattgaagatgtcctattcaactctgcctaactagagatttagctctcaacttttcctggtgttgggggtgaggggaaatattccaggcagagggaatggcatggatataccacaaaactgggaacaaacttgtcatattcaagaatctgaaacaggtgcatgccttgaccatagtttgacacagtaaatgcttattcaatgacagatggtgtgaccttgggcaagagagaccaaatcagacctaggatgtcagaaatgctttctcaggctttcaaaaatcaatctgttttcaattgagacgccattcattctaatctcccttactttcttattcttcccacagctctccagtcatgccacccacggatgtggaccattgtcctttacccagtctatccagttctgaagacacttttttcaggtactactccttcatatataggcacacatacaatcgacacttttccaactctatgcctttgaacccagcaattatttcactgggtggtgagtcagtggtgcaccctgggagtgggtccagcgcccttggcacatgaaagcctttgaacatgaggccagtggtgctacatgaaatacactccatcacaattctgtctacactgggcttatgctcgtctgggtttctttctctgtttttagatagagtcttgctgtcacccaggctggagtgcagtggtgtgatctccactcactgcggcctatgcctcctgggtttaagcaattctcctgcctcagcctcccgagtagctagattacaggcaggcgccaccacacccagctagtttttgtatttttttagtagagatggggtttcgccgtgttgcccaggttagtctcgaactcctggcctcaagtgatccgcccgccttggcctcccaaagtgctgggattataggcgtgagccgccacgcccagcctgggtttctatattagaataatcctaggcaagacaaccttctgagccttgccattatcacctggaaagcagtctaatactcattgccatgccatgttcacagggctgttgcgaggataaaatgcaagaatgatggggaaaaaaatcaagtaattataactgacatttgttttattcagagccagacactgatgcaaagcatcaggacgatgctctgacggaggaggaaacgtagggctgagatcagcttcgtgtgcacattggctttgatcaaactgctgcacagcgaccggcagctccaccctggtgaagcagagggtggaggttaaacggctcagaccctgggtctggctccatctctaaccgtgtgaccttgggcctgtagcttaacccgtctagggctccgcttcctcttgcgtgaaatggggatcacagaaggggttcagacggaactgagggtccatttaaagctctgggcagtgatgtcttggcatgcagttcattttcactttaccattatatttgttcttactgatttaagggcagcaccatgacttttgtggcgcttggcggggtagagggaagtgtggtcaggaagcctggggtctgagcggcgcgggacctaggccgctcctttcctgagcttcagtttcccgcctcaaaatgatgggtggattggctgagctacacccacctttcccgcccctcggcgcttggctgcgcagcgaccctcctaggtggggaaactcccaccaccccataggccgaggaaggggcggggcaggggtggggcctggcgagggtagggtccggccgccccacctgctgccgctcacctctaggctgtagttgcctcggatggcagtaaagtcgtccagggcttcggccgcgctcccctcgtccaggttcagctcctggcacagggcctgtagcgcctccccggctgcggcgaccaccgccgccccctcagcgtggggcttgtcctcgaacatcccttcaggccccgcgggctgcgcgccacggcccccgacttctttctccctcccaggcgcgctacccacaaccacctgcgccaaagcgcgcgaaaatctgcagctgcgggacgtgttgtcatccaccgtctgcctccgcttttctcctcaaaaaaagtccgtttttcctccggagctcctagcagtccctccccggaaatgtgataagaagatgtacctcagattctgaaagacctgtccttggcccttggctggtcgcggggggcccagccggcgggacagaaaaagagcggagggatcctcagcccgcgcgcagagcctgctgggaggtgtagtccatctcttgggagatgaagcccgcggcctccccctgtcttcctggttaggctcttgggttttggggcagggctgggctgcctactgcgaggtggcctcgtgcagcgtagtgagatgcctcctctatccacgggccctgggtttgtcactgtccctgggcgccaaacataatctgagctgtaccccttgagttaggagatggaggctggaagagaaaaaagtagcccctggacgaagaggggcctcttgggactctccccaaagtcctagtgcccagtgagtggttcgctaaatgacagaggggaaggattggtgacggatattagaagacgaatcctcatctcatgctagtcgctaaaagaggcaggcagagaagactgcagtaaatgaggcaggagaatagggtctggaggcagggaacctatggctgtttcacgtgacttcttagaactaaattgaaaggaaaaccccaactttccacgcctaagtaacaaaagaaccagaggctgttcccttggaccttttctgcatggcagatgggaaattggctgtctgcaacaaatcacactgagcgccttccagtctttgtttgcaactttgtaacttcactccagcctctgaacggttgctgtccacaaccaatcagactgatggcgggagagtcttcctttgcatagaagtataattttgttaacttcaccctggcctctgattggttgctttctgcaaccactcagactgattgtgggctaccacttcagttacatcaagagagcataaagtggccaatgggaaacttctagagggtatttggaccccagaagattctgtgtctgggcccttgagctgctgcgtgggttcgcttccccactatggagtgtacttttgttttcaataaatccctgtcttcgttcttttgttgttccattatttgctttgcctgtaatcccagtactttgggaggccgaggcaggtggatcacttgagtccaggagtttgagaccagtcaggccaacaaggcaaaaccccgtcactactaaaaatataaaaattagctgggcgtgtgggtgcacttgtgtaatcctaacaacctgggcaactgagacatgagaataaagaatcgcttgaaccgaggaggcagaggctgtagtaagccaagattgcaccactgcactccagtctgggtaacagagtgagactctgtctcaaaaacaaacaactgaggacacatctgtcaaacccagcctcacctgcatgcatttaaaaaaaccaaaaatcaatatgcccttccttatattggttttattttttcttattatcccaggacatgcccatttaacccaaaattgagcttttctgaatagaaaatgaagtatggaaggccggttgcagtggctcacacctgtaatcccagcactttgggaggctgaggcaggcgggtcaccagatcaggagatcgagatcatcctggccaacatggtgaaaccccgtctctactaaaaatacaaaaattagctgggcatggtggcgggcgcttgtaatcccagctacttggcaggctgaggtagaagaatcgctggaacctgggaggcggaggttgcagtaagccaagatcgtgccactgcactccagcctggtgacagagcgagactccgtctcaaaaaaaaaaaaaaaaaaaagaaaaaagaaaatgaagtatgggtagtgaaatagatttactctgcccttcagttttgagccagatacacatgaaggttgtttctattttgatcccattgtgtgatagcctctatgattagcctccctgttgtggtttaatatttcagagttctcccaaagcatgtggttggaacctgattatgacctttagggattccaagactaaaaagattatagtgtgtacccttccaaatgtaattcaaaatatatgcaattctaaatcacaaaataagtgtaagaaagtacaagaaagttctaactaattttcccaagatgtctcattttgaaattcttaaatttttttttctttttttgtcctccagctttgctatgccctaagcagaaaatcagtctgcacttgcccctctcaggacaaactgcttgtctaaccttctattaaaaaaaaaaaaaaaaaaaaaaaaagcagttgatatttgtgggggaggggcaagacctgacctcaccattctttttttttttttttgagacagagtctcactctgtcacccaggctggagtgcagtggcaagatctcagctcactgcaacctctccctcctaggttcaagcaattctccttcctcagccccccaagtacctgggactacaggcacacgccaccatgcccggctaacttttttttttgcatttttagtagagacggggtttcgccatgatggccaggctggtcttgaactcctgacctcaggtgatgcacccgcctcagcctcccaaaatgctgggattataggcgtgagccaccatgcccagctggacctcaccattcttaatgttctttttccttggaggaaaaactaaagtggtgatctttaagctggttctgcactgtggaagtagtgcattacaaagattaataaagcctctctacccacagaagggggaaaggatttgcatacaatcttagaaaagcaaatgtaaatggcttttagatgtgaaaagatgcccaactttctttctttctatttatttatttatttatttattgagacggagtctcactcttgttgcccaggctagagtgcaatggagagatctcggctcactgcaacctctgcctcctgggatcaagcaattctcctgcctcagcctcccgagtagctgggactataggcgtgtgccacaacgccagggtaatttttgtactttttagtagagacggggtttcaccatgttggcacaatggtctcaatctcttgacctcgtgatcccacccgcctcggcctcccaaagtgctgggattacaggcgtgaaccactgtgcccggccccaacctttctaataggaaaaatatatatacaagtttaaaccggtataaaaccatattttaatctattcaattgtcaaaaatccaaaagtttgaaaatgttctagtgactccccatttctttcagggttaagccaagctccttgtcctggcctacaaggcactaagggtctggtggtcccctgtctaactctgccttcatttgctactctctcctttctcaccctaccgtagtcatacttgtgattccttttggctacctttttttcctttaattttgaaaaatgcaaactcaattttttatgtagttgttaaccccaatgtttaaaaaaagtaaagcatttcatccaaattactaactaaaagataatagctaagaatacctgaaccagatatcaaagaattgggggtaatgggggccgggcatggtggctcatgcctgtaatcccagcactttgggaggctgaggtggacagatcacttgaggccaggagttcgaggccagcctggccaaaatggcaaaaccccgtctctactaaaaatacaaaaattagctgggcgtgatgatgctcgcctgtagtcccagctacttgggaggctgaggcaggaggagaatcacttgaaccggggaggcagaggctgcagtaagccgagattgcgccactgcactctagcctgggcaacagagcgagactctgtctcaaaaaaaaaaaaaaaaatgcaattaaccattagatacttccattcttcacctgccagtttttccatttcctttcttctttcccatatcacctccaagatgtccctccattgccctagatagctcagctctggctctctgtgtatattcttcaaccaaacaagagcctgagaatcagattgatggtgactatttctaattagtccaaattagtccagtgtgcctcttgggggcctcccacaattccacatgcagcttataaaagtggttgcccaacacaaactaatctcttttcccagaaaatttctgcttgtaagaaatttttctccatttatgcttaaagcagacagtgggtactcaacaaataatagttcctatcctagagccatttgaggatctgacatcggttataggagagggaattatgaaaatggaaaaaagggagaaggagtggaaaacttggatatattgggataaatttaccattacaccaattcagaagtttttttcttgcttggaggttttttctttttcttttttttcagacggagtctcgcactgttgcccgggctggagtgtagtggtgtgatctcggctcactgcaacctccacctcctgggttcaagtgattcttctgcctcagcctcctgagtaggtgagactacaggcacatgacaccatgcccgggtatttgcatttttagtagagacagggtttcactatgttggtcaggttggtctcaaactcctgacctcatgatctgcctgcctcagcctctcaaagtgctgggattataggcatgagccaccgcacccggccgcttggaggtttttaagggaaaggaaaaggaagaagacagggccaaaaaggatttcacaaaaatacatcattaaatatgaaactataagaatggattgttggccaggcatggtagctcacgtctgtaatcccagcacttgggaggccaaggtgggcagattacttaaactcaggagtttgagactatcctcggcaacatggcaaaactccatctttaccaaaaatacaaaaaattagctgggcatggtggcgcacacctgtagtcccagctacttgggaggctcagtggggaggatcacttaagcccaggaggccgaggttgcagtgagccatcatcgtgccactgcactccagcctgggtgaatgagtgagacactatctcaaaaaaaaaaaaaaagttactttattcttaatattgttggcaattaagcagacatactaacattgtaacattaacatttatttagaatctcttttgaagctgtccttgacctgtttctcaagactggaattctgctgggtgccgtggtgcatgcttgtaatcccagcactttgggaggctgacacaggaggatgacttgaggccatgagttcaagactagcttgccgcacaacatagcaagattctgtctctacaaaaataaaaaaaaaattagcttattcatctctagctgtcagtccctggtgtgagtccagtacaagggggaggaagaggaattaacaatcactaaatatgtactctgtgctcaatctgtgtaatacctcttacatacactctttcatttactccttccaacaagcctttagttagaaaacgctatctccattttttacatgaacctgcagatgagaaattaatttttttttaatgtttccagaaagtcagctataatgctggcatttgatcccagatgtgcacactccaaacttcataatatttccactgtattattttgcctattccaaatatagctctatttgcagagcgaataattgtgctgatatttggtgagatagcatgtgcaatagaaaatccagtttattatttaaatggaggcagaagatgtagatataggcaaatcgtaacatcacctatgttagctcttgtttctgttttgcctttcccatttgacaaagaactgtttgtagcagttaagggctattttattttctgagatggagagaacagcatgaagggcataccattagtaggtacggttgtgtgtacctgtagttccagctacttagtaggctgaggcaggaagccaggactttaaggttagtgagttatgatcatgccactgcactcgaacctgggtgacagagggagaccctaactctaaaagaaataaaacaaacaaaaaaaaagatgtgaactttttttttttttttttgagacagagtcttactctgtcgcccaggctggaatgcagtggtgcgaccttggctcattgcaacctctgcctcctgggttcaagcgattctcctgcctcagcctcccaagtacctgggattacaggtgcctgacaccatgcccggctaatttttgtatttcaagtagagacggggtttcatcatgttggccaggctggtctcgaactcctgacctcaagtgatctgcctgccttggcgccaaagtgctgggattataggcatgaggcaccatgcccggccaaaaactctatagatttttaaattatatctgcaattttaaactaagaactgccctcctctatatcttaaggttttgaaagcaaaagacatgttggaggtaattaaatgggtagaggtggcttcatgctggcattgttttaagtctgaaaaaagtggggctggcatcagtggcctctgtggcttctgaaaggattggtttttacctgatgttgcttgccttgtgtttctaggcagaggacctgcccatgagcttctgcaaccagttcactctctgcttaggttttggttcggccctcgccatctggactagtaacagagtctgggaagcgatgatgcacagcgagggctcagggtcacacagcaggtctctcagatctagcggtaggcaaacacaggttggaggtaaaagcccctgagatctgtggaaatgaatgaaggtctagatagcaaaaagcttacatgcccatagcagcttagattacggtccaactgtctaaaagtttatatatcagtgaattgtttccaattttgatctacaaaacctaccggtttctgagttgccaaacatgtcactcctctgcaataatcacattccaagtagtctttctaaagtcgaatgatctggacctcccaagccatgtctaatgttaacatctaagttcccgtgttggtcctagaagtaactcttacatcattatcttcttttaattaaaaaaaaaaaacttttagtttttaatattttctttcttttctttttctttttctttcttttttttttttttttgagatgaagtctccttctgtcgcccaggctggagtgcagtgatgcgatcttgactcactgcaacctccgcgtcccaggttcaagtgattgtcctgcctcagccttcggagtagctgggattaaaggtgcccaccaccacgcacagctaatttttgtatttttaatagaaatggagtgtcaccatgttggccaggctggtctccaactcctgacctcaagtgatccacccaccttggcctcccaaagtgctgggattacaggtgtgagtcactgtgcctagcagtttttatgttttcttattgcaaaagaaatacatgttcattgtgcagaacatttagacattacatgtaagcacaagaagaaaagtcacccataatcctaacatctagcgataactattgttattttcaatatatatctttctggtcttctttccatacatttatatttacatatatatgcttttattttttgtccaaatggaaccatatgaccgaggaattgcaaatgctggttttatttaatgataccacatcatcatttatctgagtcacttaaaaattattctaggccaggcgcactagctcatgcctgtagttgcagcactttgggaagacgagggaggtggatcatttgagcctaggagttcaaaaccagcctgggcaacatggcaaaaccctatgcctacaaaatatcaaaaaataaaacattagccaggcgtggtggcttatgcctgtagtcccagctacttgggagactgaggtgggaggatcccttcagcctaggaggtggaggttgcaatgaactgagatcatgccactgcattccagcctgggcaacagagtgagatcctgtttctaaataaataaataaataaataaaataaaaattattctataatatgtttcttggctattcaggttgaggatcccgtatccaaaatgtttgggagcagaagtgttttggaaattagaccattttggattttggaagacttgcatatacataatgagatattttggggatgggactgaagtctaaacacaaaattcatttatgtttcatatacaccttatacatatagcctgaaggtaattttatacaatattttaaatagttttgtgcatgaaacaaagttttttgactgtgtgtgtgtgtgtgtgtgtgtgtgtgcacgtgtgtgcgcgtgtgcgtgttttaaacagagtctcactctgtcacccagagtgacagatcttggctcactgcaacctccgtctcccgggttcaagcgattctcctgcctcaggctcctgagtagctgggattacaggtgcgcgccactacgcctggctaatttttgtatttttagtagagacagggcttcaccatgttggccaggctggtcttgaattcctgacctcaggtgatccgcctgccttggcctcccaaagtgctaggattacaggcgtgagccaccacaactggcttgattgtgttttgtcttatgaggtaggtcaggtatggaattttcccattgtggtgtcacgttaacactcaagaagtttcgggttggagaacatttcagattttggatttttttgattagggatgctcaacctgtatataattctacaatatgaatatgctataatttctttaattatctattgtttccaatctagattatttcccacttttgttattctaaataacaataaatggacattcctgtaactatttctgcttattttcatagattaaattcctaaacaagaattgataagtcaggctgggcacggtggcttacgcctgtaatcccaggactttgggaggctgaggcgggcagatcacaaggtcaggagttcgagaccagcctgaccaacatggtgaaaccccgcctctactaaaaatacaaaaaatagccggacatggtgcctgtaatcccagctactcaggaggcggaggcaggagaatttctttttctttttcttttttttttttttgagacgaagtctcactctgtcactcagccaggctggagtacagtggcgcaatctcggctcactgcaacctctgcctcccgggttcaagcaattctccttgaatcacacctggctaatttttgtatttttaatagagacggggttgcaccgtattggtcaggttggtctcaaactcctgacctcaggtaatccacccacctgggcctcccaaactgctgggattacaggcatgagccattgtgcccggcccaaagtttattaattggtaatctttgccatttcgacagaaaaacgcatactgtcatctcatcatgatttattttgtaaacctctgattactagtaatatcaaatatctttcatctatttattggcgatttgtaattattctatgaacctcttattcatattgtttgccagttttcttttgagggtttctaatttgatttaagggtgttaaccctttatcatgttgcaaatatttcccttcatattattgtttgcatttcacttttaactatttctctctttttcaaagttggtttttaaatttttatgtagacaaatctaccattcttttattttatggatatgcctttagtatcatacttagaaaaggttctcttttttattttattttattaattaatttatttttttgagacagagtcttgctctgttgctcaggctggagtgcaatgtcacgttcttggctcactgcaacctctgcctcccaggttcaagcaattctcgtgtctcagcctcctgagtagctggga

SEQ ID NO: 377 - DNA, 95190 bp, Homo sapiens
gatactctgttgctaatattcatttcacacatttgatgaactgcttctgaggtgggaacatgcatatttcacaatgacttcaggtaattctgatgcaaatggctcagcttcaaaaagcactgctctaatccttgggttggatatagccaactgtctcttctcttgacctaatgtttacttacttattgcgctattctattgttatttatcctctgcaggcacccaaaagtaatgttatggaaagaacagcatttactcagttcttccattggataaatagttcagcaaagatgatatattgggctcaaaagctttcaaacagagtgaggaatgagaaataaatgcattgtacacacagtcttggaaccacagccttgagttaatagacatagttatccattccactcagtgacacagtacaaaactagtaatctaaacaaaattaatttgtttagattgaggaaattacgtgagttctgaaaagagttatttatttcaatattgtattttaaaagcagtttatttcatcaaaattgctaatgattattagacattattgtggtatactaacaaagtgattaaaatcagcatattcacatataattttataacatgcaaaaaaattggaaggctaagaaaaaataaaagctacaatcctaaatattaatggaacaggaattctaagtaaaggagccatttagagtgtattttacaactgagcaatgacagagaagtacactgagaagaaaaacaggtttggagtcagctattgattacaaaaaattaagtacaaatttgtgaaaaatcatgtgtgctgccctaaattttagatgatttaattgcttttgtgttgctcatgacagtagataaaacatgcctaaaaattcacacttataagacatttaattttaattatttgccctgttataggactattaggactgaaaagcactctgattttgcccattcatctcaaatgagtgctgataagacaatgagcagttaatttccttcatcttgtagactacacattacgtttggaaattaaatgcttgataagatggcatatcttgttacataatttattttttgaaataatagatacttcagccccaaaactactaggaaaatgtgtggtaaatagaatattttaactgaaaatttcaaaagtaaagaagagtttgcttagccctcaaacatggttaatttattaaaagggtttagggttcacacttggaatatctgactctgtttacacctgcagagtgtgtctttttgtagacacttcatttcaaagaagcagctgcataattccctggatttgggggtagaaggagagatctgcttgcaaaaattacattctacctatgaccagaaactttaggaagctgttttagagtataatatggcacccaagttatttctccccaaaatagaacatgtgtatatgtctgtatgcatgcatccacttgtgtgagttctgtaaaaagtaaaatagaaaataaagtacatacaatttacatatacacagacttataaggtaacgattatttttcatttggtgtatttgtgtatattagtgcattttatctttatatgatccctttgaagtaagttttattattcaaaatctccctcacctttgagttcctctgttcccttttaaaaaattaaaaagcaaacaaaaacgccctcaaaagcaaaaaataaaaaattgcttcacatttactcttcagcttctctactagctgttacttcatcatctctaaagttaagtcaactttttgtgacatgcaaagcaaaagccaatatgttactgtatcagttagtttttgctgtgtaacaaattgcttcaaattttagtggctttaaacaatatttattaggacacaattctatgggtcaccaatttaagccaggtttggccaagctgagcttcaccaaggctcactcctgaggctgtagtcaactagcaggtcaattagaaattggttatttaaaaatggctttgcttgcatcacatacatgtctggcagtggggtctttctggctagcagtttttaatagctagccagaccaactggttatcagctgaaataatgggcttaacacatctacaacaagctagcctggtcttagcctcctggtgatggtctcaaggtatccagcatgagcaagaggtgaagcctcaatgcatgagttctttccaagcctctgcttgtgtggttgctaatagccaagttcagaggcaagataggtgggtattaccaaaagcatggatggaagatgcatgaatcattagggaccaatactataacaatctacagcaatcaccctgtgtatatcctcaaaatgttcttgaatcagtccgttcttttctatcttcaccgtcatagcctaatccaagtcttcgttttatcacttggtctttctaactttcctcctccacaatccacttactttttattatatttttcttcctagtacccctcagtgatttgttattgtccgttgtgataaagttgtacacatttcttagcttgatcaagccctctcaagatctgaccttaactcatggtctttcatgtctcatgatgatccttttctctaactggacccaaataccaactcctccaaccagctgtactctttattgccgctgtgcctctgtacattctattccctctgtgtggaatgtattttccccacaattccacctgtgaatgcaaacaaatccttcaaggctgattaaatgttgcattctccgtgaagccttctgcctgcccttcatggacccttgcttctgtattcctagagcattttgtacataccaccatgttgtattctaatatatcagcctcctccattagactgagtattgaaaatgaaataaaatgtcttatttatatttgaatcaccaggtcatgataaattatttttggttgatgaaagtaaggatgaagggtgccaccaatttccattcacttttgtaacaaatatttaataggtatccactatgtcccagctgctgtttaatatatacatttaatattaaatttgagttgcaacttatatttttgccatttactatgtgtgcttattacaatagtatgtaaggagcagttcttaaatacacatagagcaataaattatttacttttgtatactgactaatataatctattttctttcttcactattgcaaacaaacgagtagtcttacattaatctaaaaaagagcattagactatcttttattggaaatggaaagaaatgtaagttgtttgtatgtgaagaacaaaggttcttgaagatactggatgttaaggcttaacaaaataactttcaataaaaaatagagtaatttacattaatttaactaaagaagtgaacattgaaatattttaaatgtattttctctacattttaacagtaacattataataaacatacatttcccaagctttaacatattttatgattatatttgcatccctagaattatataaatatcttctatttacaaacaatcataagttaacttttactaacaattaaaaaaaactcagcttcaaaatttttattttgaaataacttttttaaaaagagagtaatgtaacgttcccttcctgtgtccaagtattctctgttacctgcatgttgtgcacatgtaccccagaacttaaagtataataaaaaatatatatatatttaaaaaaagagagtaatgtaataagctcctttacactctctatcctaacacttttacttttcaaaatcacatatcaaataagaaatgagcctatttgaatccgtcactcattaaggtttattgtatgaagaggtacaagggaagaagaatatctcatcacagccctaaggaaaatcgaaggaaatgtttacaaacctaaacgggtttcaacagcacacattctcattaaagacacttctggttcagggttaaattgccagctctgggccccaattcaagctgaagttcctgtcttgggcttaaaagacatgtctatctttagaatgatggagatagaagagatagttgttcaggaaattgtctgacaattgtgattgtcagtgctgatagtgagttctggtataaagtcaaaacaaccaactgagaaattaattacatagaaagtactttttatttttcttgatacttcctaaagattgcaatctaggaaataactttttctttccatgcaagacctccccatttgtcgccaggctatactgattcttcctttcaataacattagtacctgtcactctccccatttccaaccacatactacctttctgactccgatccctgaccaactgggattcctttcctggattttccccaaattaatttgtcttttacattggtatgcagttatggaaaaaagaatggttctgcccacacagaaactggacccatcaactcggtctcctaaatcataaccaactgaatatattttatttacctttctctcttttttaattgactccctcaatcctctcagccatttattgatccttccttttcttcatctctcctcttcattttccatttcccccgttacttctctattatcctacatgcaataaggaaaaacatatggcacaaccaagattgaaggaggaggaaattagacttgaagaaggaatgcagacctaatctgttgatgtttatatgataacaggaaaactgatagttcatattttaagaacaagcctggaaaatttgtcgaaattttataaatttcttccacagcaaagttttggactaagtagtaattcttacctggtaagcagattcttaatttttaaaaataatctggttgggtgcagtggcccacacctgtaatcccagcactttgggaggccgagtgggggtggataacttgaggtcaggaggtcaagaccagcctggccaacatggtgaaaccccatctctactaaaaatacaaaattagctgggtgcagtagtgtgtgcctgtagtctcagctactcaggaggctgaagcaggataattgcttgaacccgggaagcagaggttgcagtgagccgagatctcaccactgcactccagcttgggcagcagagcaagactccattgcaaaaaaaatctggcctttcttatttaaaaaaaatttactttattgaggcaaaattcacacagaagtcatcattataaccgtcttgaagtgtacagctcagtggcttctagtacagtcataatattgtacaaccatcatcactatccaaaacatttttgtcatccaaaaaagaaaccccatacacattagggagtcacatctcatttcccctacttctaacccctggcaaacccattaatctactttctgtctctatggatgtgcttatcctggacattacatgtaaatggatcacacaatatgtagccttttatatctggcttatttcacttgacatgatgtttttaaggttcatacatattgaagcatgtatcattgcttcactgttttgtttcgttttatttttttgaaacaaaatcttgctctgttgcccaggctagagtgcagtggctgcgatctcagctcagccacctgagtagctgggattacagacatgcaccaccatgcccagctaatttttgtatttttcagtagagatggggttttgacatgttgcccgggctggtcccaaactcctgagctcaagcaatccgtcagcctcagcttcactgttttttaatgactgcataatattcccttgtatggatataccacattgcgtttatgtatagaacagctgatgaacattttggttgtgttgactttttaacttttatgcataatgttgctataaacatttttacacaagctttgtgtatgaatttatgtttcaattctcttgagtatctacctaggaacagaattactggatcatatgtttaactttttgaggaactgtgaaactattttccacagtggtggtatcattttacattcctaccagcaatgtatgaaggtcccaatttctccacaacctcattatcatttttaaaaaattatagtgggtgtgaagtgataccttattgtggttttgatttgcattttcctaatgaaaatgatattgagcattttatgtgcttattagccatttatatatcttatctggagaaatgtctatttaaatcttttacatgtttttaaattgggctattgtcttttgattgttgagttgtaagagttctttatatattctgatggacgattttaaaatatttgtccattgtgtgttgtcttttcattttcttgatagtgttttttgatgcacgcattttggtggagttcagtttatctaccttttttcttttattgcttgtactttttgtatcacattcaataaacctttgcctaatcccaggtgataaagacttaaggcaaggttttagtccaagagttgtacagttttagctcttatatttaggtctttgaaccatttttatttttgtatatagtgtgaagtagggttccaaactcattcttttagatgtggttatataattgaaaaggctatatatctttttccactgaatggtgttagtacctttatcaaaaaatggtatttattgcttcgtgtattttggggctctgctgttaggttcataacctcactttacttttatttgaaagaaacaaaatgaaattcattaacagaaagcaaagtacttgccgtatttataaaataattttggtgaacagaaaaacaaattaggagagacatgaactttcacagaagaaaatttcatagtatatgatcactccagataatactatgcccagaaataatctaggcaaggagatgttcctcaaaattcttctgcagtgaaagagagaaattttttttccttgcttatgtgaactaaaagagatctaaagtttcagaataaaaagattagatatgttttattgaaggcttactctgtttcaggcactggactagtttcttctttataatgtttcatttgatgcttatatcaactctataatgtgatgtcttatgtcagcaggacttgagtcaagtatttttctacaaaagcaatttaaagaaagtgttgccaggagaaacaggaaagggagtaggggtagcaggacagaggagggcaagaagccaacacagatgggattttaggaatggtctagtgggagatggtttcagtccgatcccatagaggagctctggttgtaagttgtacctcagatttatccaacatgagatcaaggttctcaaccatcagtcattggctaagtgctactcaggggcacctaggctctatctgcctatgggcaatggtggtctggtagctaagggcagttcctccaaagaaaagtcccaggagctctcaggtggtggtcttggggctggtattggaaaccaaaggaggcaaaaacagggtgaggggtgctcagaaaatgtggaagaaatccaaggggatctgagcagaacacccacaaaatctactatagatatgtactatttttttccaattttgagagaaggaaacaggcacagaaaggttaaatgcccagaagcacaaagagaatgagtgcaaatgtacctgactccaaattccttttcctttcccctttactcttgtgcctccagtcatgaagaccctgtaatttgggaacttcaaagaatcttctttcagacatcatgtgtttttatttttttccttaaaacagaataaactttttcaggtttttttacttacagtctgttaaactgtaagcagaaatttttacattagcgtattcatgggcatttttccccctgggagacagttgatagcttacaaaaatttcttaaagagtatataaaaaataaacatcttacaaatcactattttaaaagatcattctccatttttacctattttcctgcctagagctgcttttctaaaacactagtctcatgagctcagattagttataataattacaaatagcaaatttagaatattgacagcttttcccctcctctgctttcaccacataccatacgtttgagaagaactggcatttattcttctttaaacgtttggtataaatcactcatgaagctatctcatcatgtgttttctttatgttggaagtttttttattactgattaaatttatttacttgctataggcctatttagacttcctatttttgaatagaagcacaaataactttcacattattttgttaggcaaacagatttacttaaaattaaggcaaaaagttcacttagggccttaactgatcgtggtttttgtttccaatgatctgttcaattggataattgccagattttcacgtagtgtctgtatgacttacacacacacacacacacacacacacacaaacacattatcatatggttagtattttaaaaaagaaattccagtaattttcctgaacatttttcttcttatcatttcatataagtagacacagttaatcactgggactccctttacagaatgaatctgagggtatctctgtaaagaggcaacattctaaactttagtactgtacatacagctaagccctctggtctgagcaggctctgaggctttcggaggactgggtagagaaaactggcaaagttgtcctgaagcactggaggggtatacccactttaggagtgtggaggggtgggtagccccatcctggatctagctgctggaggtaccagataaggtgaaaacctttgacaaagagttgctgcctttcccaacaagtggtactaaaaatggggagattcaaatccactcataattttagctgcttttgctgtattacttagactgtatcgctccttcccataattcacccttcagccacccaccaccttggatcccattttgtttgttctatgttaaatttcaatgtaatgtagtttaatattgtcaaagtcgaaggctgatttctctctctaatgctgcaagagaagatgacatgctgtaggttgtgatgaggcaatgtgatccaaagcagaatccttgcttttgttggagagcactggacatataaagacactgggcgtatttgtcaaaagaacagaaggtggaaggaaaggaagatgatctggcagtcaggtaacaccaatcccaagtctccactgaccgctcccgtctaaagagagcacagattatagtttgcccccatgagattgccattttgggttggaagatggtcgcaatttcatttttcacttaagcaaacgtccgttgccgtactgctaggtatgagatgagtaatcgtcagggacgcgtttaaattacaaaataatggtaaatgggagagaaagaatcttttctcggggttgaggccagatcctccagggctgggagacccaggagtgcgggccactgtgcaccctcgagcaaagcagtgtgtgacgagatgggatcttccctcaaatgctgagaagagccctcgccaatccctcggaaggttcccagaataaaaagcccggtccctgctgtgcaaagactgagcggtactccggtgtactttttccctgtcccaggcgtgcagagtccacgccgcgcggccaggtgccccaatagtgtacctgaaagtagggatggggccagttacagctgcactttccctgcagaagacagtgagccttcccgggatctttctgggagctctgagtgtgaaaacggtcctccggccagcgcaggttgagagaacgggaaggagggggaagctgtgggcgcccagggcgtgacaggcgcaggtgagaaagtgagtttcgcgggagcatctgccgggaccgcagacaggtggagaaacgcagtcccaccgcggcccaccgcggctcccgggcggcctgggctgtacctgtgcgcggcgtcctttctgcgctgagccagggcaccccggagcctgcggcctccttccccgcccctgcggccccgggtcccagccccgccccgccccgccccgggctggggctccgctggggaaccggccgagcggcgcgcgcggaggtgtccggcggccaggaggatggccaaggtcccggagctggaagacaccttcctgcaggcgcagcctgcgccccaactgtccccggggatccaggaagactgctgtgtgcagctcctgggcaagggcttgctagtctatccggaagaaacagtgtacctggcggccgaagggcagcccgggggcgagcagggcggcggggagaaaggcgaagacccggagctgccgggggcagtgaaatcaggtgagtgctctgccgcatccggagctgggaaggggacggggacgtattctaagaagggcacccaataataataatgcatcccgaacaaacataaggcagatatagaatgttctgtccaaatctttgtatttcctcagtaaaatgtcaagtagagacctgacattttgcatagcccccctttcctcccctccgcccccaccccagtaggctactcctttgaagttaaggtacacttaaaggcgacttagttgattttatattctatttttctttatcatcccttcaactggcaatcagaaatgcacttaaacaatggtaacttttcctctgaagaagaggacgccgacaaccacgacagcaaaaccaaagcagcggatcaatacctgtctcagaagaaaaccatcacgcagattgtgaaggataaaaagaagcagacacagctcacgctgcagtggtgagactcgcccgcagggtacactgaagcacctgttgacgttttaacagccagcgtcttcaggatctttgattttcacaatttacttcttcctcaaactttttgggaaagtttaaaaaaccaattagaatttaacccagaatttttttcactgaatttttagtatagagacttatacaagtactggtgaaggatttgcaatacaaatgaaaaccacattacgttgttccttattgactaaaaccatattttcttcaaatgtaagcattaatgaacgtttttatgacttactggcttaatatgcaatcagttcagtccttacatatttgttgtttgatagtttttgagattataaaatatgattcttaaaaacaacttaaaatgaggaaggatcttaacactgcctttattcaaaagagggcaaattaaaaatagtgtatactccataagatgaactgtgtttgaggtagaagacatagaaaaaatcggttaagatatctatactaacttaaatagaagttcaactatttttataccatctatcatatatgatttataataataaaatattacaaattggattttgtggaaaatcttttaaaaccaagaatttatcagtaggatttccacatagagtgaacattttgtaatatctatctaaaagaaagacggctctaaagtaaaagcattatattaaactttcctacgtagtgggaagaaataggagcataaatttcctcacaaattccaagtaaaaaacaaactaataaaaaggactatatatttactgattagttacataacctaattttgtgtaaagtatgatctaaggagccttagaaaaatacaagataaagaactagtaaattttatttttattatttatttaaatattaaattacaatttacatatagtagttttttgtgattatatgcttgaaccctttcaaaatatttgaaatataagccaaatattcatctaaagttggagtttaactattgaagttgatgtcgtggttactagttaagaatatactagagcagttaagtaattgagttaaatatctgggatatttaggatacaactatttgcagcaggataactggggcaaaagtgttttgatttcagatatattattgagctgtttcgaatgattactccattttttccatttaaattgagtgtgtggaaatatatgtttcttttatgaataaatgtatacataaatatatataagttaagatcaaagaaaaaacttgtaccccaaatgaacatcatacttatgtctaggatgatttaatattttgaagacaaagacaatgccgactacaacagtatcaaaatagcaagatgaaatgtgaacattgtgtacatgtaattaaaatataatttttaaatagataaactagaactgaaaatcaaagtgaaaaagctggctgattaattccagttttcactatcaactagtatgtcaactgattttatgtacatatattgatttcatattttgaaacactagatcttagtttttggtctttttttgttcttcattaaaaaaatgagtgatattttacctgttcagggaatactttctttagcctttatcttgtacacattaggatattttaaatcaaatctttgaagggtttcatccaattttaatctgcagactctatattgcatcgtttctgcattataataaatattatcttactatacataaaattggtataagtaaattttagtcaaaatcacctactgaactgttaggaaaactgggattggaatctaaaagtttaatttctacattgctgtttagaaagttgtaacacaaatatgtatttattacatttatataagttatgcttagttacaaattaaatggaattacttcaaattttcaaaggttatatagttatttttataatataaagttgaaggtatatatgttatgtttggagatatctatagagaattacattatcttttaagtgtataggatgttttagataattatagtactgatgacagtagtaaaaagtataggaatagaaatatatcagtgtcatttcagacttaagtaaaatgagtttatcctcatgtgttttgcaaataaatgcatcattgtccttccctaattattcagggctgagaaataggttttgaatgaaagtgagagaatgtaagcatttgccaacctgaagcttgacagccctttagtactaagaatgttttaaaaaatacccatcatcttcaatttcaccattcatatttatatgtcacagagcaaatcatgatgaaccatgaggtttatatagaagacctaatatttgtgatgtggaccaggcatggttttatgttagccatgatattttaactgtactagcagatttttcactggggttttgtacttttaacattaatccttataatttgatttttaaaaaatatccagaataaacgaagtctacttatgtctactcattacctcatttatagagtccatattcaaaatgggtaataagtcaatgagaaagttgaaggaaaaggaaataaaatatttgacctaatttttgttcctttttcttaggcttgaagagaattacattgtatgtgaaggagtttgcttaccacggtgcattctttatgcacactacttagatttctgtaggaaagagaaattagagccagcctgtgcggccacctttggaaaggtaaatgacacgtattggctatagtgacttataactaaagtcatgtcaggcagatagcatgaaaatgaattcatctgtgcaagttctcttagagaatattgagacatttgttttgcaggcataaattgtcttaaggactctgtttggaattgctatatgtttataacttgattttgaatattagaaccctaactattagaagatctaatgtgaatttaaagcaagctttgtttaagcagtagcatttgccttcaaagagggatgcattaaagtgtatagtatggcctgtggtaagaagcaaaattaagtggaggtgacaagtctcttgctaatgcaattagtggttagtggttatccatactatttacctagtccaaatatatgagtttttaataggttttaaaatgtattaaaatttctcctaattctccatttcactctatgtttacattccaaatcccaagattttatgatgggatgggttagaattctctcatttaaaaatatttctttctacccaacctgtgtggttaggatgggaatctatataactgacattattatgcttatatatagagagagagacatcactttgagaatcaatatgaatgtcttaagaaagccttgttctttaagattcatgtcatgctgtgtttgagaacctaggatatcccagaaaaactttaggaagcttgggtctcaaatattgtatcttacacaaattgaaatccagattctaacctgtagagggactcattgtccagaaaataatgaatactacagtccagcttctcatttaaaaaataatgttatttatttcaaaaacctatctatttacagagagagtgtgatattatacattgtaatcaggtaacctgggttctagcctagactggactaatttattgtgagaccttctgaaaagcacttaatctctttaaaaatctgtttactcattctattaaatgaggagtttggataagacaacttctaatatccatattaacattaccattttgtgagtctaccttatgggaataattcttaactgtttggcagtcatgaagcaccttgaaaacctggtaaaactgtagagccagcctccaagaaattaatacatacatagtttgccatggagctctttaaagttcatgtatggatcttcaaagattgaggttaaaattgttttatgtagaagactttttaaaaaatgtttaatcagatcctaattttagcaactttagagaaaggaacatacaaaacaaaaaatttataacattataatggagatacagtaaggcagagaaagttttatatgtcctttggggttgggaatagatttttaattgtgggtaaatctctgtatggaattatatgaagagacccaaatcttctcactccatacataaataaagtaataattgctttggtagtaccatcaagcaaaagcagatattggtatgatctgccttagaaatcaagacaaggtcagtagagcacttcaatcaaaaaagtacctccctgcctctgctgatgtattgcttatcaatatgtgtaagttattactttttccagactaagtattcactcacagttcattcagagttcaacatttactttccccaagtaattggctatgagtggcttgcattaggaccatatactttctaacgcctaaagtaatcatctttctttttagacaattcgccagaagtttcccctcctaacaacaaggcggcttggaacaagaggccattcaaagtaagataccagtgaacatattcaggttctgctcttgtgcatgaagattgacacagatgtaaaataagtattgtctttgtcagtacaaagagaaccaggtattctcttgatgaagcagacttttatcaactgtgagaactgaaaaaaaaaaaaagattttagaataatgtttaaaaagcaaattttacatttgaaaataataatgtattattatttctgctgaaataatttaaatgagtcattttcataatcttaaagctgttactgaaggcaccagtgttatgaggaggaatgcaacgctcccaaagagcaaggcccaaaccagggggtaaagagctttgagtaggaaggaagtgccttagcatgcttcaggttcttcctctagttttctttctgagacaataatttcttgatatctccttctcttctctttaagacaaatgacatgcacagatgacctgtttggtcatctcttaaggtaaatataaacataaactaagctgtcacacattccccctctttatgtctttaaattttcctctctgttgtggcagtctctggagaactcccaggtacagtttctcattcaacagctattttctatgcgtactgtgttttcagtttctcctttccttctgcctatgagcatgtccagatctcctttatgctgagaaagaaaaaagttccaaccttcatgattgctctagtatttccccctttgagctgttgcttcccttaccactgatcacatccctctgacctagtccatttcctacctgggcaaaaatccaatggctggtttttactgttactcatcttccttggctcctgcttagcatttgaaccaactgataatgccctcttaaaataaatacagaaaactacctctatagcttctctgtcatagtactatctaggccctcttccctcttctaccactccttttctggcttgtccactgcctccttctgccctgacatcacatccagcactgatcaatgaaagtataatgtggccacatatttaattcaaaaatttctggaagccacgtttaaaaagtaaaaaggaacaagcgaaattaattttaatgttttatgtaatccaatttatccaaaacattattatctcactatggaatcaatataaaaattattaatcggatattttacattcttcttttcatactacgtttttgaaatctagtgtgtattttacacttacatcacatctcagtttagactagccacatttcctgtgcttacccccacatatggccagtggctttattgctttattggatagctcagctttagacacttgcaaaaacataggtcctactttttgaattcttttgaatatgactctcctcattgctactttcatagcctggccttgactctgtctttcttgtccattcatgcaatttttccaaactgaccttttaaagttgagattcaatcatatctcttccatgttcaaaacctccactggctcataatttctactattaacaacaaactttcctcaacttgacattcaaggtccatcatgatttagtccaagttcattttactatgtcacctatttcttactttctagcatgtagtctatgtgctcaccaaataattatcccagtaacctttgattcactccaactgccagtcttctgtttaagtttatgctgtcttcccctggagaatgccttttcccatatatgtatgttgaaattttacccatttgaaagaatgtctcttgaacttcttcctttagatctttttttagtccattgatttattgtaggtcccttctctgcaccctgtggcagtttgctggtacctatcttaatgtgaaattaacttatctcctcctctaaacagataatacatattttgaggacagaaactttgtctcattcacttttatattctttctgttggtcgatatataatagattatcaattaatacttatttaattgattgcaattaatgttaacattattgtggcctggaaagaataaataaagtgccagattcaaaaaggcaaaatgggtcccttccttctaaccaagtcaactttatttcaaagtttgatcagtttaactgactgatttctactgaatttgattcctactgaattgtattggttgaggaaagatcagatagtgtttaaagtaaatagatagggggaaaagaggccgagcaatgaagagaaaccctcttgacaggatctataagagggtgggctggcaggctgcagggaaagtcaattaatctttgaaggagcctttaggattagggatgaatcattaaccctgtccattgtgtcacagtggggctctagtacttaggttgatgtaacaacatggggtgacttcgggcaatttatttgaatccaagagccatagatgtgcccaacagcaaggcattaacaatttgaatttttttctgctgtgctgatatgccatttgatatttgtgacgtgacttttttgatatgtttatatcatagagaaaaattaattttccatatttaaactacatatggtaaaaatatagcaaaatgtagtttgtatatcttgtaaatagtaatttttttgacataattattcttagctaggtatgtttctgcctttatttccaagaaatatccttagcttttatcttggaagatagaatatcaaaaggcagtatagcctaatggttagggacataggctttaaagttggacaactttaaacatgaatctgatgtttccatgtatagctgtgtgacaccagctttccagctagtgatttattgtaaggttattcagcttttcaccagtaaagtgggtatacaatatcttataggattgttgtgagagttaaatgagataaagtataggaatgaatatagtagtgaatatgctttcaaccgcactatccttaataataaaaaattaatgactcaatataaaatatctgcactacaattagaagttatttactgagtattacacacacacacagatgcatgcactcatctctaatccttgcaataatgatagaagataggaattactgtattacaaatgaggaaattgcatttcaaaggttattggcttgcccaaggccacatagataatacataataacaatgctggcatttgaatcaaagtatatctgactctaaagtttatgttttatctgctagtaaaagtagggaagcctactactttttttccaatatcaatcgtatcaacaaataattattcaattgaatgtttgatttttgacatataagttttattaagtttttttttaacagatctaacagttcttaaactttattaacatattagattcttcttcagagaacaaacaacactttaccatgccacaattgtaaggcatttaatttagaggtatttgtgttttatattaacagcaaatttgtagcacaattttattttctgccttttaattttagtcctaaacatgtctctgttatatattatctttgcaaacatttctaatggctattatttcataaacttacattttataaaaatatttttatgtttctatggaaatatgaacaactgaatgaaagacagaaatataaagtaagtataccttagaaaatcagggaatcataatttctcccaattttactagtaattttgcaaaacattttattgttattgtagtgtttaatacagtacttttagcatagtattactaaatatttgttgaattatttaaaaaatataaataaatgtgatatttattttaacttccttggattgcatactaatacatacaaacattgtgaaactgttctgatgatgattacttaaaaaatgagttctcagtttggccaaattattataggatagctagagtatgtccagtcatctcactggggactatcagaatttattttagattatgattgactcaaaaggttctcctgtactctgggcatgagatagcaccctctttttaaaaattgttcttagatgtctttgaggttcatgaagcaatgtcactctctaaattttactggtccctatataaaacccaaagtttggaaaacactaatctatgtgacaaagagatgattagtagggcctaaaaatcatgaatgaatgtggtgtctattttcaagttctattttcctaagttttgaaataactggctgttaattacagtaatgtcttcacagctctcacatttgtgcatgtgctacttctttccctcactgaaaagtgaaagatgaaaaagtttgactgtataaaatgagcccaaaatttattcaattaaatggaagagataaaatatttaaaacagatatattaaaacaaaaaaaaataggctggatgtggtggctcacacctgtaatcccagcactttgggaggctgagacaggaggatcaggaggtcaagagattgagaccatcctggctaacatggtgaaaccctgtctttactaaaaatacaaaaattagctgggcgtggtggtgcgcacctgtagtcccagctactcaggaagctgaggcaggagaatcacttgaacctgagaggcggaggttgcagtgagctgagatcgcaccactgcactccagcctggcgaccgagcgagactccatctcaaaacataacaaaacaaaacaaaaataaaaaaataataaaacaaaaaaatctaaacagacaggatcactgtgtagggccagatatcatccactgtcaaaattaggaacaattaaaaatggagtaatttgttttcagtggcaagttcaacattccacatcaaaggccactgctgctgatggttatggaaaaaaaaaatctctaaagatgaacatgaggggtcaggaagcgtcactctagggcacctaacaagtgtgctttggggacaaagccagtcaatttgcaggtccattagcagctcagctctctatccagttccttcacgcttaccatcccctgccagccaagaaaaccagcaaccccagcggcagacactgtacattcccaataccaagataaaaattgactttactttcatgtttcttcttttcttccctttagttttactaccaattccaaaagtatacacctggttttattatctgtgatattttttaattgaggttttgaataaataaaaaatgaaacaaagttctataaggataataatgaagaatcattcttgcatattttatggttatgaatacattgagaataatcagtccattcctactgacatggatgtacaaagcgtgatgctaaagagtttttgagatgcaaagaattgtaaaacagggtacctgctggcaaagaactttcgctactcatcttaattatttaataagcattttactgagggtcccgttgctaactaggccctcgggtacaatgataagcaaaaaccttgtatcccacccttgctcagaatggcttggctaagtaaaggagaacataattgagcccacaaatagattttacacacatggtagactgtttgattttaagttacattttaattttttgtagactttgatcagccaaatcttggttttcagacatgatggacaaaagctattatcttatttattagtagtgatttagtgggttaataaaactgatacggcagctgctcttatcatagcaagttattgcaagtccctgaacagcttaatcccatcatttccttatcagttatcatttgtgtagtgtaaactaacatcagggctactagctcagtgggaacatatgtttcaggaattctatataaagactgaaatggaaaagaagaaatatagatgcaagtacaaattgttcagcaaatgaagaaaagtattaggcacaaagtaaatattttagtagtaaaaaaagaacagcaataatttcatttttcatattaaaagtctgttatattttataacatgttcacattaaaatgtggttacaagcattaattattcttttttcataaattttaaatcagatctgtcatttgacataagattgaggaaagttgctaataaatgaacacaattttcttagataatcatagaagctgctttcatgacacattttcttgaagagattagctaatcatccccaggattttcgagcatttatcatatatcttctttaatagaaatggataataatcatatagggagaaggaactgtgaaatgtttgggaatctttattcagagtaacctacaggataagcatcaggtagtgttatataaatttaaacaactatttcttccacagtgagacaaacatcactttttatttaacatacaccagcatatcttcttgttatattacagtatgcatggtaaatactccctagcaagatttattttagggtcatctattaaccacaaaataatgctataaaatattgcaagtgagatgaaaaatttatgtacactttgcatgaactctctctccccagttttatgaggtttatctttagtgactaggaggacagaaagctgctcatttattatctcttctctgttctcagagactctaaatcactcagatgacaacatgtacctagttagactaaaaggaagattaaaggggaaaggttattttgttggctccagaagaaactgggtatgaaatgtgctaaagcattacagtggtcattgcaaaatactgaggtttgtattgctagcaacagtctttccaccaaagtacaccaatttcatgccctttatatatattgtttacgtatgcaacttttgttcaatctcagtgttttactgatgacctggaaatgcaatgtcagaaggtggttattgaaaactatcagctttaagaaaatttgttttattgttttctaaattcctagaagaacacattgatttaaccagtaaatgtatgaggatttttcttcgtactaatttttaatgaggaatacagtgaagggaaagataaaattctcatcctcgaaatcttagggtttagtatgggaggtaagccatgtatacaaatgccaatgatacaaggacagagctgtatagggtaaatgaccaagggaggagttcagggagttcaggagttttgcctgagatatcaggcaaagcttcatgtgttaaaatatgccttaaactatgattaagaaatgaggacctgatggaagaagggtattcccaatggagagttcaaaaaaccaaaggtaccaccgtggctatggcaagctatttatgaagagcaagtcatcctgatagtaatagtcaagtttctacagtacctgtgatagggttaaaggagttagtagacttccttacatcatgttagataagagattctttaatttctaccaaattttaaattgtggtgatatgtttaagtatatgatattatatgaaatctcttaattggcaaatgtttttatggttttgtgacacattgttatttttaatttttcaagttattcattcatttatctaataaatgtttattaatttcctattacagggagcttacattctgcgagtttatacatgaaatgtcaaatatgaaacatccagatcagtggtgtgggtcttaataattcatgttagttatctatgcttacattactcctgccaaacaagaataaagtgtgtgtgtgtgaatgcagacatatttgaactgtatttcactagaactttctaattgtaaataaaattgcaatacaaaagagagatatcttttgcatcttgagtgtggaggcaatatggtttgtggaatcatgggtttaaattttgccttcaaacccataacatttttaaacaaatcacataatttttgaatgtctgttttggaatggggataatgctctacttgccggctgctgtgaaaatttgagatcatgtacacatacaattctttgcatgtaatagatgctcaaaaatggtaattatttctatcatgactcactatcacctgcttcaatggtagcaaatattaatttggtattacaattctctgtttgcattatttgttccctcacaagactgttaactcctccagagactctcctctacctctctttcaatcctcagcacatggcacacagtgagcactgaatacatgtaggaaaaaaaagagtgtactctttcactggttctctatctcctggcatgtatataagattgtatgatagaatatgctcagctacatcaacatatctaaaatctaaggcattgctaataagaaaagtacatgccatttctctcttgtagagctgagtgtagctgaccaagtcattttcttcaggtgtcagtttgtgtatgggtttatagtgttatttacatttgacttatacataaaatacatacattaattaaaaagcacggttttttgagtatatataaaatagttacttttgtattttggatgtaggtagaggcattaaatatttctatttgtaaagatattctgtcctaatgactggggacaggaataagggggccaaataatataatcatttataacaataagaaacaaataaattgcataataaaacattctatccttaaaagtcgtaagaaaaaagttacacatctgtattagttaggatttatttagtcttaaaatgtagcaatttttttaaaatgtgaatatcaaatggttttaaaaactgcaagtaaaatgtacctcagtgctggtcagtgtagtcacttttccatgacagcaggcatcagaaggccatagactatggaggaatttggaaatatggatattcctgatcagattttcaatgtctgttttgttcatcattgtactgacaactagcacagtggtcagggcacagtatctgctctaatattttttgaactaatggccatccctttgacttgtcttgtgatttttgtgtaccacctgtgaagacagtgtagtttgttctcaatctgcatggcaaaccattttaccacgctgaaaagaggattagagttgagaaacaagaaaattgaagttataataaaagaagtttatcaatttttaagccaacgtttaacatgtatttctttagcaagtggctaaaatgtagtatttaaactataaagcttatagaacaaacagcaagctttgcaaaaagaacatgaaattacaacatctttccattctaatggatctctgttttcaaacattatttgatttatttcttctaatatgtaaacatttcttttggtatcttagttctaaaatctaacaaatgaaatattagtaattatttcagactctggcttattaactaattctactaatatatgtgactatcatctaaatctgctaatgttttcacagttttaaatatttctcttacctatatctattaatatagctcctttggtaaagtctttatgacttaagtaagcttctttcttttcgtttctaattagagacatactcagtttagtattttgaagtttccattaagttttccatttccttcatttctccctttgttccattataccttagaggttctttttttaatctaccataggatttctttttctgtactgtaaaaatgagcagttatgatggtccttttttcaggttaacagactataattgtacatttaccaaaattgaggacttgaaaacatcttcccagtcttccagaatcataaaatatcttcatttaccttgaccaccatatattattgtttcccaaatatgacaactctttctgaaaacattagttataatatttgttgctgctgttgttgttttgatgtttaaaaatcctttttccttcatctcaaatgaccttgaatcagtagaggcaagtttgctgccacagtcctgcccttagcacctgagaagagagaagccatttctgggcctcccactttggggggctcattctggctgtcatccagctgctgtcctcccatgaggcagggagtccatagcctgagtgaatgtgtccatccaaaaaccacatcccacttctgggtccctggggccctggaattccctgttcaactccccaggcccacttcttgggcctatattgggcatgtcccaagtccatcctcagaaggccacattgcttcactagtgttcataaccctagactgaggtgtggtcagggggtagctgttagtaggtgatgcagatgcagctggatcttggatgtgcagtccagttccctcacagtgaacaaaggagccagagctgaaaaatggggtgaaagtgggtctttccccaccaccatgttcccatatggaactccaggagtctaagaatgctaaattcatatttacctactagaccattatggaggtaacttgtcaatgtaagaggacaggaatatttttgttagctgttcattagctcgatttatagttttcaaatagctattcatatggtatgtaggcttccatttgtactcccgtcctggatcctgaaaatgcttaggagtggaacttcttggccaagtagttctttattgctgaggccagagatagggcccttgatggatgaacggaagattcatccattcaaccagatggatgaactgaggattcagatggtggctcctcagtttaaaggatccactttaaactcagatggtggtgctcggaaacaacgttttaaaatataattaggctgatgtccactggaaatcccctcattctcttttttacatttctttcctgatcctagatgaatgcaaattgaaggagttggtaaacagtaggtagtggtgctttatgggggatggatggtggagagtggagactgaccacagaaagcagatgctagaggactctgactatcctcactaaatgcccactattccactagcatgtgtataatatttgtagtgtttgtatatgggtgtgtaatatgtcaagagtttgtgacttaggagaataagccataatttgagaatcagtgagttgctatacttgtattgtgtctcatgatccactggcatatttaaaacaaattatctacagcactgttactttccacatgtcattttcattgatttgcaacatagccttctccccattgttgcatgaaattttgaagtgaaaatagtagtgaattggacttttgattcctcgtgaggaaaataatgtgtaaagggtcacatgtttcatacatattcccatgtgtgagattggtcttccctacacatatggtaaagaaaaccatagcattttcttgtccaattgactaaattcatgttgaatcacccaatttgtaaatacatacagtacatatacttagagccaaagcctacatttatacattattgggatttggaacctaatgttttagggtatgtaagaggattgtcagtaggtaattctcatttttcaagcctagagtcagaaataacaacaataagtaggagtagtgactatcaaagaggaatatagcacattaagatgctgcctacctgaaaaatgtcagaaaagaaaggtcatcagggtttgcagttcttattcatggttatgtcagttataccttagtctctttttcccctccaaaaatctccttcactaacacagagctggttcctgtctttgctctaggtatcattactatgggattggcatcaaagagagcagtgcatattaccactccgtttattctggaaagggcttgacaaggtagagttacaccatcttcaagacaaattctctgtgtttctttaaatatgcatgatacctattgaataaaatgatttcttaattttgcttatcaagatgtttccatttaagcatcagaccttaatgtccgctttgtatggatgattatataatctagattactgggaaaattatataacttgtcataattagtgagaaattaattgtgaactagtgttccagagagatgaagaggagaaatcaaggaagcagaattgcttttaaattagtatttactaataaagcaaagtctattttcaggttggattcaataaaacaaaggcagtaaatgtaaatgtaacttttttctgagacaacctgttttaaagatctatgtgcttgactagtaccttaccaagatagaaagtttattgtaataatctctaatcacatatactttgaccatcctcttaccttatgagggtgaaattactgacctgtttgggtttctatgaaaggtaaaacatgaatgaaaataaacagcacattgctctaagccactgttaactatcatggggatattagtaagtgaggttacatctaatgaaaccagtgataacacatcattcattttttaaactgaaactctgaataattagatgtgtatctgagattgctttatggtacgatttaccaagaattgctcttagctcttaaaagaagaaattatttttaaaagtaaagtatcttgtggaaaaaaaaagtttagtcactgagtcatactaagataaatttagatattacaaggaacataaggctgcttactagccaccaccccactataaaatgtaaatataggctggaacacacacaaatgtttaatagtgagtgtcctttacttgtctcaaatctcacctggcttttaaaaatattattcatttactttttttctaaagaacttattttgttttagtaagttgagaaagatgcttgatttctttaaaaaaagcaaatttctccagcttatttctctaatcatggtatgaaattactgcttctttaggttgtctacatatcattgaatgctatagctgtaattttgtttgaactaatggaaaatgtactaattttttaaggttttctggaagcaagctaaagaatgaggtaagaattattttcatctctattttacatctgctataatatgtcttacaagctgagcaatacatgttaattattccctttggcaaatgtagaaataaatgttatttattaggaattccttgacgaaggacttcagatacagctcaattagatttgggacaacaaatgaatctttgcatggatctaccaaacaactttcagttaacctaggagagatacatttttagttatctttacctaatatcagatacttacaagactgtaaaaaaaacactatcatttatccaaaaagtttccacttaaatataaacaaaaagcttaagctgaggatatggaaagaattggtctttggactgcacccatttagacaaaacatttattagttatcaaggagcccaaatgctatgctacactatggtttgttttactactttgtgtacacacacacacacacacacacacacacacacgtatacaatctttctccctaggcttcctctccaccccctccttcaagaacagactttatctaaatgagttagactaccattagggactgcatgggtaattagacacatgataaggccttcattattctcaagttaactaatcattaagaagaggtgctgccaagctaagggcacatgacaatgtgttgtgtagtaaatctggacctgaggtaaagtgtaactccattagtttggtgaaatgatgcaagcatattttaagaaataatataaggcccccaacccactaaatggccaatttctttccaccagtgcttttaatacagttaatggctaattacataatataaatcctccagattgctctttttatcaatgaaataatagctctttattagataaacaattgtgaaactgcaaaaatattgacttagagatacactttggttgagtaaagtttatgtcaatagggaatttacgttatttctctcaggtgttctttctactagtttgatgaggctggtggtactagcaagccctctgccgataaatggcaagccttgtttcatggaataaaagaaaaatatttctcaagtctactttttcctccttagaagaggacactgcaaatactgttgtagattttgttactaaaattaaaatattctgattaagctctatagcctaaccattttctgtggatacctgaaggcaataatagtgtaccattactttgatgattatagaaattaacacaactaagagctttctaaaggctcagaactactctaaataagtttaaaatgataataaaatattttcataacacaattgaaatttttaaaaattattttctttgggaggctgaaaaatacaaaaaattatttgggcatggtgatgtatgcctgtaatcccagctactcaaggaggctgaggcagcagaatcacttgagccctagaggctcggaggttgcagtgagccatgattgtgccactgtattctagcctaggcaacagtgtgagaccctatctcaaaaaaaaaaaattgtatttagggcgaccaaccatcgttggtgtgctcagacatgactttcagtgcaaatcttcatatacgtcagttcatttgaacattcataactgtgaggtatggtgtcagcatatttacagctaagaacaatgaggctgagagatgtatttgcttttttaagaggtcagagaaagattctatttttttaaagccatggtcaagatattaattaacagatgtattacattacaggtactaggagacaaaatggtgaatgaagagatttggtcctgcccttccagagctttacagtatagcaggaaagcatatcttgaacaagtaattataagaaattctagagggtgtcatgggagtaactaggtttagggagttaaggacattttacacaggaagtgatattaaggaaataactcagaatatagtggtagtttggaggaggagtggagtaggggaagagggaagaagagtggttaagacagatggaatagcataggccagggtttctcagcctccatactatggaaattgtggttcagataataatgtttatggaagatatcaagtatattgtaggatgcttagtagtatcacagcatctctggcctctacccattacattccagtagcagacccccacccccttgtcgtgacaaccaaaaacgtctctgacattgccaaatgtcaactactggcatatgtgaaggcaagcaagaggtgtatcatgttgtagaaaaaataaaaaaaattctgcttagctatagtgtagaatgaggtagagagtaatataataggtagaggctggattgtttgtagtctcattaggttaagaattctgtaatgggaagccactaaaggggaattatgcatcagacttggtgttttataaaactcattctgaccatgacatggagaatacattagaagagtgtaaggcaggaagccagtagatccattggaggctatctggatagtctgtgtaagagaagatctggaccagaataatagcccaagggatggagagaagtaactgattttagttgggaaatattgaaggagaagcaggaagaaagagtaaaaagataaggggtttaatttgggacttgtcatatttgatgtgtttgtgaaacatttaacacaaattttaagtgggaagttggatatatgtgattggaaaggaggacttcaagatttagtttgatggtgattgaagccatggtaatggataaaaatgcttagggaaaaaatgaatgagaagacaagaggttaccaaaaaaaagttgtgaaaagtgagagaggaagagtcggtgagataacagaggagagtctagagtggtaggaagagaaggaggagaatacagtgtcacaggattcaggatgaaaaaatgctccctacagaagggaatgctcagatggtgctgaaaagtcatcaagataaggagtggaaaggatccatggaattagttaagtggagataactaatgatttcagggagagcctttccagtggtgagctggggtttggtttgtgaaatgagtgggaagtagcattgaatgtagaacatttagtcaagttcagggtgataattggaaaggacttgggatttgggattttttgtttttgtttttgagacagggtctcactctgtcacccaggctggtgtgcagtggcacaatcttgactcactgcagcctcaacctcctgggctcaagtgatcctcccacctcagcttcccaagtagctgggactacaggcacacaccaccacacccagctaattttttggaatttagttttgaaggatgattagactaatgtctaatgctaataaaacaggaacagtaaagaatgaagactgaaaatattaaagaaaggaaagttgagagcacaaggtcactgaggaggtcagtgtagaggaattggccctagagaggaggagcagttcttccactaaaactgaaaagagaaagggtaagttcggatgcaagcagatttgtagatttttgtggcagaaagttgaggtagcttctgtttggtagttttgcatttctctcaggaatggtagtgtaggtcatgtgctgtggcaaaaatcatggaaagaaagtaggagtttgaggaacttaaaagaaagtcctagctattctcaaccaggttttctagagagaatatagccctaatgccctaagacatccactgaatataaggaataaactctgtcgtgcatgagtgtttagaatggtattgattaagcaccatccttgagagaattgaaaaatggttgttcaaatcattttctgtaggacttaattttctcacagatttattgagatggtagcaacagtctttgtggaagacaagaaagttagaagattgtaaaatttaaatggcatgagccagaagaaatgcaaaatattcaggaacagttataataagagaagcatactgcctatttggaaaaaaaaaatacaggcataaaagaaaactacaagtgaaatgacataccatgtgcctggataggaatgctagatattataaatattccaattcttcctaaattaattcagacattttatattataatgaaaatttgagtgggtaattaatttttggagatgaatatgttacgagcttaatctagaagaatatacaggaagtaatagttaagagaaatgtaaacaagaagagtaaaaaggggatttgtctgccacatatcaaaatattatgacatgatactgagtcaactgtagatagaacaaatctgcagcagagtttaggtacctgacaaaagaccctagtatttataaggttttagtgtatgaccaaacagaaattacaacaaatgaaggaagaaaatatttttctgtgtcctttttggagaaaggtggagtactatataaataaaattattcaggaggtgttagaaacattgaccattttgcaaaaaaatttctatacctcacaacttatgtgaatttcatataaacaattaaatataaaaataatacttaggaggaaatatatgtctaccccacttctggaaggagttattcactttctaagcataaaagcagtttaagacatttcataggaaaaagaaaaacacacacattggaaacttcttcatatcaaaagcatcatatgcaaaatttgaagtcaaaggaaaaactgggggaaatatcttcagcaaacatgacaataaaattatatccatagtacataaaaaatcctataaaaatatgaagaccacaataagtagtagaagatgcgaatagatgattcacagtagaaagaaaaagctaataaacgcatgaagaaaggagtaccaaataaacaaaaattaagataacattttacaatatgaaactatgaaatatttaaaaattattgggaagttggtgaaggtaggatgagataaactctttcatatcttgctgaaggcagaatgaatttttggaaaatgtttggaagatctgcaccaagtctttaaagtatttatatcctttcctgctaattctacttttgtatggattttgtatgaatcttttctttttttttgagatggagtcttgctctgtcacccaggtcggagtgcagtggcgtgatatggctcattgcaacctgcgtctccagtgttcaagtgattcttctgcctcagcttcccgagtagctgggattacaggcgtgcgccgccacacctggctaatttttgtgtttttagtagagtcggggttttgtcatgttggccaggttggtcttgaactcctgacctcaggtgatctgcctacctcagccttccaaagtgttgggatgacaggtgtgagccaccgtgcccggccttgaatctatttttatttcatagtgaaatctatttttatttaaaaaaaatttttatttcactatgaaataaaaatagaaataaaaataaaataggtaaatttcatagtgaaataaaatagaaaatgcagacagaaaattatgcacaaaatttttattgattacagtgagaaactatatgtaacctaaatgactaatatcaaagaaatggttacataatttattgtacttttgtgtggctgaatattatttattaaaaggctcttttaatgatatagagaaatgttaattataaaaaaaggacacagaagcaaatatatgtgaaatatgtaaagcataactgggtatttacaaattatatacagttggtccctggcttaaaatggtttgacttacaatttttcgactttgtgatggtgtgaaagggatgcgcattcagtagaaactgtacttcgagtacccatacaaccattccacttctcactttcaatacagtatttaataaattatgagttatttaacacttcattataaaataagctttgtgttagatgattttgccctactgtaacctaaggtaaatgttccaagcacgtttaaggtaggctaggctaagttataatgttcagtaagttgggtatattaaacgcatttttgacttacaatattttccaattgtaatggttttattgggatgtaaccccattgtaaattgagaggcactgtatgacagagaattaatatctattactatgttgtaaaatattgtagctgctagccacatgtgactattaattaagtaaagtaaaaaatgctcagtcacgttagctacatttcaagtgcttactgtattggacaggaaagatacagaacatttccataataacagaaagctctattggacagcactgttctagaatatgtatagaattcaagtcaataatgaaaagacaacccaacagaattatagcaaagtatatgaagaggcaattaattcaggataaacaaagaatgactaacagtgctagttggcattctggttgaccagtgtccataacgtatgttgaataccaccccttgccaataaaaaagtgctcaatctaaatattaatcagggaaatgaaaattaaaaccctaatgtgtgattgtctcacatatattacattagcaataactaaaatgtctaaagacacactgttgacaggaatatggaccaaaggaactctcaaatagagtagaagggacaatatctagtgaagttgaagatttacacactttatgactgcattcctaaagaaaccttcacattgtgcacaaggaggtgtgtatgaggatgttcactgcgacatggtttataattgcagaatactcgaaaataatcaaagtgttcattatgatataatgggaaataagtttttatacatttatacaatggagtgctatactgctttgggtatgagcgaatgaatgatagttataataatcaaattagggtcatctcaaaaacctaaagttgagtgaaaaaagcacattgaaaatacaaggatacatagtgtattataccagttttaaagaacagtataatattaagaacatttacatactaggtaaattttttaatgtttgagtagaaatgatctaaaccaagcccagaacactatttcttgtgggagaagaagggaatgaaattaggcaaggctgctttagtattggaaatgtctcatgtcttaatcaggatggtaagtgggtatttattattttttctctatatcttttaaaaagttttaaatagttcaaaatataaaagcaaacaacaacaacaaaaaacaacaaaaacaaaataaaaaacaggaaaaagatggtaagagcgttactacttagtattaataattgttactgttttaaaatttttattcataaatggagtggtttaaatttcagaaatgtcttagagattgtctcagaatctgttaattcacaggaataaaacaaatgaacaaaacttaattataatattttctccccatcaaagaaagcttttcttttcctgtgggtcttctaatgtgggccaaatttttgtttcaagcagctagtgaagttgacattatttcttagggaatgggtccattgatttcatacatttctaccaggaagtttccttgatagcctgagttttcttctccttaacatcaaccgttcacagccagttgaacaactttgtaccaagataaatatcaaatcctccctccttggtatatgcttttcaaatatttgtagactgttatcatactctcctttgtcatcacttagccaagccatgcagcttaagtcctttaatctttcctcataaatcagaccctcttgccttctagtcatatttgtttcttttctgtagggtccttcttgttttcttttagaaatacgattcttaatagttcacccaagagtaccgaagttatcaattgagaaaggaaaaaacaaaacaaacccagacctctgtagctggcctatgatctggcacctcttttagtacgattgtaatagcaaatatattagtggaattagaatgagcatattttactattttaaagatgatcactcctctctttttgtgttacacttactggatattattcgatttatgcaatttatatgatctttgtatccagttgttaacatccaaaacaaaattaattttaaggttttttggggcccttttgccccttcttgatgttgcacatattgctagctttgattacacaaaattattatttaccaatatgagagtttttaaaagtattagaattaaagttacatactttatttcttaatatgtgtttctttagcatgctaacattttttattgggaaatgtgttattcacagcacccacccaaacacacaaacacatgcatagaatttttaaaataatcataatatgaaaactcaagccctttctcataacttaaaagagaggagtcctctgtgcacccacttcaatcactttttcctccctactcatcagaagttaccactctccagaatatggtgttactgtttgtttttctgtaaagtttgccacttacaaatagatctctcaacaacatattgtttattatttgcccagttgtatcctacataaaaataggctccttgttttccctgtgactttctgttttccttcaatgctaggttttgtgattctttaatgctgatatatgaagttctaatttatttgtactgctgtataatattccattgtaggaaactatcccaatgcgtttattcattccattgtggatgggaattttttttttgcctgaaaaacaatattgacgcaaacaattctccaggtagacatctataggagttgaattccaggtcccaagatatactcatctttaactttactagtaaaggtgaaattattttccagagtggttgtatcaacttctgtctctccagctgtgtgtgatcattacttttgtaccttattcttatgcttggtattaaatgacattttagtttttgccagtcttgtgggtgtaaaatcatgtctgtgttttttatttggaaattgtttttaacaactgatgagctagaatatatttttggatttttattggtcgattcttttctgtgaaatgtttgttcagatcatatcgttttttattttgaaattttaatcttaagagttctttatatgttctggatactaatatcctgtaagttatgtgttgtaaataacttcttcctgttagtggcatgactcaatattctattgtatcttttgatgaagatttttattttatggttagtactttttatatcttgttttttaaaaatttgtgtatattccaagattataacaatattctctataaattactttgaaagcataaagttgctctgaacatttatttcatttgtaattggtttttgttcatatttttattgtggtaaactacatataaaatatactatctcagccatttttgagtgtacagttttgtggtattaagtacattggtatcattgtgtaaccatcaccaccatccaccttcagaactctttcatcttgcaagactgaaactctctactcattgaacaataactcccatcttccctctaccatgtccctggccactaccattctactttctgtctctatgatgtttactactctagaatcctctttaagtagagccatacagtatttgtcttctggtgactgacttatttcacttaccataatgtcctcaaggttcatccatgttgtagcatatgtcagaacatcattcccttttaaggatgaatgatatttcattgtatgtatatacagtaccacattttgctaatccattcatctgtcgatggacaagtgggttgcttccacgtttaagctacagtgactaatgctgctatgaatgtggatgtacaaatatctctttgagatcctgctataattgttttgggtatatacccagaagcggaattactgggtcatataataattctatttttaatttttgggggaactaccaaactgttttacatagcagctgtactattttacattctcaccaacaatgcacaaggattccaattttttcacatccttgacaacacttgttatttttgctggcgtgtgtttgtgtgtgtttttgtgtttatagtagccatcccagtgggtgtgatgtggtatctcatttagggtttgatttgcatttccctaatgattgtaacattgagcatattttaatgtatgtactagtcattcatatatcttctctagagaagtgtatatcaagtcctttgcccattatgaatcattttgtttacttttatgttgttaagttttaggagttctcaatatattctgtatattaatcccttatgaaacatgatttgcaaatattttctctcattccatacattgcctttctactgtgatcatagtgtcatgtacagttatatgcataacttttatgaacaaaagtgtttctttttttttttttttgagatggagtctcactctgtcaccaggctggagtgcagtggtgcagtctcggctcactgcaacctctgcctcccgtgttcaagcattctcctgcctcagcctcccaaggagctgggactgcaggcgtgtgccaccatgcccagctaatttttgtatttttagtagagacagagtttcaccatgttggccaggatgttctcaatctcttgacctcatgatccacccacctcagcctcccaaagtgctgggattataaatagttcatgaagaactattttttttatgaagtacaatttgtgtaatttttgttgttacctgtgttttagtgtcctatataaaattttttttccaaatcacatgtttccttctaaacatgtttcctgtttccttctaaaatttttatagttttagctcctacatttagatatttgattcatttttggttaatttttgtatatgatgtatgaggtaaaggtctgactttattcctttgaatgtggacatccagttttctgagcacactttgttgatagaactgtcctttccccatagaattgtcctttccccatagaatggttttggcacccctatcaaaaattattttaccatatatgtgaggatttgttactggcctctctgttctattccattggtttatgtgtctgtcttcatgacagtaccatattgttttgattactgtaactttatagtacgtttgaaatcaggaagtcttctctgactttgttcttctttttcaagatttttggctacccagggtcccttgagattccatagatatttttaggatggatttttctttttctgaaaaaactgtcactaggattgcattgaatcattgaatctatatctcactctaggcagtattgctatcttaaatattaattcttctaatccatgaacatagaatgtctttttatttatttatgtattctttaatttctttcagctcttttatgtagtttgtattgtacaagtctttcacttccttggttaaattagtttttaagtattttattctttttgatgctattgtagatgaaattgttttcttaattttcttttcaggctgttcattattagtgaatataaatgcaactagtttttgcatgctgactttgaatcctgctactttgttgaatccatttatgagttgtgtgtgtgtgtgtgtgtgtgtaatttttaggggtttctacatataagattatatcatctgtgaacagagattttctacttcttccttttcaatttggatgccttgtgtttttttgtttttttttttttgcctaactactctagctaagacttctagtaccatgttgagtagaagtgatgaaagcagacttgctttgttcctgatctttgaggaaaagctttcagtctttcaccattacatatgatgttttctataggtttttcataaacaacttttattatgttgaggtggttttcctatatggctggtttgttgagtattgttatcatgaaaggatatggaattttttcaaatactttttctgtacctaatgagattatcatttttttattccattaatgtgatgtaacacatttattgatttttatatattgaaccatccttgcattccagaaataaatctcacttatttatggtgtgtaatcctgttaatatgctgtggaatttggcttactaatattttgtggagagtttttgcatcaaagttcataagggatattggtctgcagttttcttgccttgcaatgtctttgtcaggctttggtatcagggcaatattggcctcatagaataagttacaaagtactccttcctcttcaattccttggaaaactttgagatgtattgatattagttcctctttaaatgtttggtagaattcactgctgaagccaactctggggcttttctttgagtgtgttggttaactactacaaatttgtaaattttccagttttctgctattatttatttccaagttcatcccatgttggttgaagaaggtacattgtatgacatctatcttttcgaattcactgagacttagtttgtggcctaacatatggtctatcctggaagatgtcccatgtgctcttgaaaataatgtgtattctgttgttgttgggtagattattctgtatatgtttgttcaatatagttggtttattatgctgtcacatcctctatactcttacttaacttctgtctgtttgttctgtccgttattgagaatgaggtgttaaagtctccaacaattattgtaaaactgttcatttctccctttaattttgtcaatttttcttcatatattttgattatctgttattatctgttatctgtacatacctgttattaggtacatgtacataaagggttatgattattagatcttttttgcctaatcaaaattttgttaatgtataatatccttgtctgttacacaccttttaaaatttagagtctattttgtctaacttcattctgccaatatctgtcttccaattggagagattgattcatttacatttaaagtaattaccattaatcaactcctcattatcctccattacccactacactttctagcatcttgtaaccactattctattctctaagttcatgtgatcaaattttttatctcccatatacgagtgagaacacgtgatatttgtctttctgtgcctggcttatttcacttgccataatattttccagtttcatccatgttgttgcaattgacttttaaattgatcttgtattcagcaactttgctaaaaaaaactttattgttaaccataatttttgtgtaatttgttttagtttttcaatgaaatcaattacatcagtagcaaataatgctaatattgtctcttccttttcggtacttaatctgtcattactttttcgagttcattattattctggctacaaactctggtatagtgttgagtaaaaaaggtgagagcaggcaaatttaccttgtttgtgattttcaagggtattttaccactaagtaagacatttgctgtgggcttctgatagatattctttgtataatgattaagttttcctctatttctagcatacacacacacacacacacagacacacacacacacacacacacacacagagggattgagagagagagaggctaatgaatggtagtggattttaaacaaactttttcctgcatcagttgagatgattatataatatacagcattctcctctgtttgttgttaatatgatgaatttaaacctgagtatgattgtacttatatactactgaattttgtttaatattttgtttaatactgtctttagtaataagtgaaattgaaatataatttttctttttctgttcttgtctagttttgacatatacgttttcaagtgaattgggaagttatccttttttctattgtcagaaaaaaatctagtaagcttaaaattgtctgtttcctgaatgcttgataaaaggtcacctgttaaaatcttttgagtctgtttttttctttgtaaaaggatttttgattactaattatatttctttagtggaaataagagtattcctttattcctaactgcgatttaatatcatactgtgtattatcattttgggagtttatatttctctgtttctcttttcctatatcaccaaatcacatattgagatgaataaacatgactttccacacaagagaaaaaatatatgaaaagtgcaaacctttctaaaattaagatttaggtaaatttttgttatgcttatccaacaaatgttagttttctgttttgtcatataacttccttcctttaaggattaagttatttattttcttgtttcctatattatttttccctatttattgacagtaacattccttgacagtgcaatgataattggtgctcataaatggaaaagccaagcattgaaagtctttgaagcatttcttaaattaagatagattaataaatagagtggattgggattaactatgctattatatcagtttatgataattattaaataatagttattaattaaaaaattaagaatatacttgaaaagagattaataaagtaaaaattaaacataatttttaaaaatgaatttctactatattttaaatataaagctcatttaaatctttttttttttttttttttttttttttttgagacggagtcttgctctgtcacccaggctggagtgcagtggcacgatcttggctcactgcaagctctgcctccagcttatttaaatcttaaataagtcaacaagaaatcagggcttctaaaatatctggtgttaaaggactcaaaagtactcccagttcccttggctctacccttataagttctagaaagacaggatgggaacccaacctgtctatgacagtaattaagtttttgtctactaaacatcttcaatatgacagagataaacaaagaagtgcagtctagaaataaatgtgagaaaattatgagaaagaacaaaattttgtccttgccagggacactttatgtcctttattatattcataatttcattatttccccaaacttttgattacaatctggtttgttaaaattttgtttggggaggaggaacaatcagttatggcctgggagactgatttgctgaggctccagttctgtcatgaatatgtgtttgttcttcctgtgtgggtttcctgtaagtataccagcacagtagcattataagttatttgtcacttttctaattttctgaaaatagctcaagtatgctttctccaagagatgtgaaagaacaacacatgcctgaatttagggtagaagaaacttactgtgggagagtccagtgcactagcttgagaatcagaagttagactccaataaaaattttgctagtaattacctctgagactgaataaattattttacgttcaatcatctcatttacttaatttgtaaaaaggaaggttggatttgacaattcctgatcctcttatagttaaaataatttcagtagtttcaaaggcagatcttcctaaacttatgccattagcaaatgtgtacttaaatttctaaaagttgtgaaaactgacaaatattcaaaactaaaatttgaagtgataggaaaaatattctaactatgaaactattgaaggtttgaaaaccatttggctgacatgtctcgtttattcagttacacaatctaaacagtctactcaaatctcgtaaattctcatggtttgcaggatgaagaagaatgaaattttatggatttgtattttactagaatagtactttggaagcatatagttgataatgatgtatttgttttcatttttctaaattatagggtggcttcactcgtaaatattcgcttagctcaaaaactggaacacttcttccagaattccccagcgctcaacaccttgtataccaaggatgcatttctaaggacaaggtatcaattacagatacttctctattgattttctgatatgttggctccatatgtcaatttgctgggaatttcatggtactgcaggaagcaatcagaaatctgcataatcaaacataattgactgatttataggagaggcaaacttttgttaacattgattaacacttccaattaattatttaccatctccatgatagtgtgtaatcagaaggtggtaaaataaaccttaaaagactaaacattattttttatttaaagctctattgaagaagaaaatactagaatgtggctgtcacatacactttcttcagttaaaagttttatgttttcaattatctccattttatttcagcaaatggtcatcaagcatttctctaggacagaatctgtccctagcactgagggacatgctagatgaatgcaagaactatgctagatgagcatgaactttccttacttctaaaattctgtgttctcttatatttgcattttttaaagttaagaaagaatcattttcattgggattcagtttataaataattctcaatatgacttttcaatgtttatgtaatagcgtgtaaactatatcttcgatttctgtacttctaaagtcatttgtcggggatctgttggctgtttagtagcagagaccattattaaattagagcataattatttctacatttttgtttcaaccaaagtacatgtttcattagcatttgaagaagacatctcttacagtatattgagttagttcgtatttctgaggtacaaagatagaggaatatgattaatgtccagatgctttactttagtaatgggctttttgtagaaatgaggtaaagatagcacattgatttaaaaaaaatttattggcatataagtagagatgcatagtaacttacagggctcattttgatgacagccatactctgttagttaagaataggcaaagtattctttagaaagaatgaaaacatgtcttttgcagcaacatggatgcagctggaggccattaacataagcaaattaatgcaggagaagaaaactaaatactacatgttctcacttataagtgagagctaaacactgggtatttctagtcataaaatggcaacagtagacactggagactactgctggggaagggggaagagggaaatgggttgaaaaactaactattgggtactacgctcagtatctgggtaattggatcattcgtattccaaacctcagcatctcttggtatacttacgtaacaaacatgcatatgtaccctctaaatctaaaatacaagttggaaaaaaaaaagtaaaatatacccttaaaaaaaagaagaggcaaatgaagataattctcaaatgccaaatccaagggagtctctcaaactatgttcacttctgactgttctctcccattacatttctcaaggttatcacataatttttaccttatagatgtaatgtgtgatatgatgactttatatttgagaatcccccagtaaatgttaacatgtggcagtttgtgaggattcctgtggaaatcaggaggatctcagtcttctgagggagggtattattgggttacttttgtggagaggattgcttccatgcaaacttatcatgaagatgtttatggtgtaaatatacctggtgagagagagagggggaccaaaaaggcaagcaacaaagaagaaaggagaggtgagaaacaggctccaatagtttacctcaatagtttgctgggaatttcatgtttctctgctggcctccaaggaagttcatacctgccaatttgaaagactggtctgtagatcatttctcaggtatcaaggtgcttttataacccttggtttctaagttcattcccagtggactccatcatgaaagccagggactgacactcttttttgaggacaatttagctctgtcaccttccttgccattagccaggctcctcaggtaacttatcagttcctagaaagtgcggtggggctaaaatcaagcacttaaggtacctgcttctttttcttttttcttttgagacagaccctccctctgttgcccaggctggagtgcagtggcgccatctcggctcacggcaacctttgcctccctggttcagtgattctcttgcctcagcttctgtagctgggattacaagtgcctgccgacatgcctggctaacttttgtgtttttagtagagacgggatttccctatgctggccaggcttgtctcgaactcctgacctcaagtaatccacctgcctcagcctcccaaagcattgagattacaggcgtaagccaccgcgcccagccagcacttgcttctttaaggccgaaagaatggaaactgcccagtgaaaagctgaccccagtgagggtactgagaagctgggggcctgctactcatagtgtctctcgaggcagttgtctcccccaccacgtgctcactgtctttagtggagctaagccttgcctctgctcctgcccactctagtacaatgtctattctcagaaaattgactaagattatgtttataaagaatgcaaagtacactggaattaaaattcattgcgctaagactatgtaagtattaaataaacaaattaagtattatgctaattgtgagttttaaaaattttgatgatttgtatataaagcaataaattttgtaacaagtagaaatacttgtgaagataaaggcttacttgtactttaataggtttcagggctcaaaggattaattttgaaagaatttattgatatggaatagatgtacatattttgggggcacatgtgataatatgcttatataatttgtacggataaatcagtgtaattgggttactgatcaccttaaatatttatcttctctttttgctaaagacatttgaattgttctcttctagctactttgaatatgcaatagattattgtaagctataatcaccctacagatctatccaacaccagatcttatttcttctatcaaattgtgtatttgtacccattaatcaacttctcattattttcctctccccctcctctttccgacctctggtaaccaccagtctactcgctaccttcatgagatccacttgtttaggtcccacatatgagtgagatcatgtgatatttgtctttctctgcttggcttattctacttaacataatgccctccagttccatccatgttgctgcatatgacagggttttattttttatggatgaataatattcccttgtgtatataccacattttctttatccattcatccattgatgagcacttaggttgattccatatgttggctattgtgaatagtgctgccataaacatgggagagcagatatctctctttgatatattgatttcctttttctggatatatacagaaagggttaatttttgacaacagttatgacttcccttccatctttcgtgtgttactcatcctcattttaaacatatgacttggaataatctgaaaatataatagcattgcctgaaatatagagcaattctcatttgcattgatggtaacatatcctgctagaggtattctatagtcagcacagctccttcagatggatcaataatgttcatatcatggttctacagctctaagctaaaccacaaagatatgtgtattgggttgtgggaataaagggaaatgcaaagggttaggataggacacctccatcaccaccaccactctagatgctattggaatcaaaatagctgacatccatcagtttcttaatatgtactatggattattccaaacactttatatttgttaattcatttagtcttcctagcaaccctattttatagctactgttattatcatgtcaattttagatatgaggaaattaaagcacataaatatcaagtagtgtgcctaatgttacataactagtaataactagtaagtggcaaattagagctgcgattgaaatccaggtaatctgaaggcaaagctcacacattcaacctccaaacattgctttttttcacgtagagtacataactggcaacaggtagggaaatttctaacatgtaaaataaaagttttagtttgaatgttattaagtggccagaatattatctagttctagcctattgcaaattttagaatatatttaaaacttttaaactatgctatgcaaatatccatggtaacttgaaaagagagacttttcataatagacattcaatgtttgaaacttttttttggaaaatgcatcatttgatattattactaactctggataatgtttagtaaggtcttactgggtgccaggcactgttccatatgtgtcacatcctattttatttgattttcttaacaccatgtaagtaatatgttattactacctacttaaaaagcttgggagctcagagacaaagccacttttgcagtcatacctggtaagtagtgcagtgaaggtgggcacccaagttgagctgactccagagacaaaatttgaaaccattatgccatactgctccaagcatccacttcataaaactgtgtgaagatttgatgtattttactactttatgtttatttatccaaatctttgttactacttttactactttatgtttatttacccaaaaattaattttaaaaaatttaaatttaaattaaaaattaaattttaaaatttaatattttagtaggcataaaactaggatgttactttggtccatagtactctgaaaaattacctttttcatattatactgtagttgtccatttgtttgcttttctcccttcacaaggcagtaagatccttgaaataagaattttgccttaatttttgagtcctcaacattgagcatactgcttggtacgtaataggatcttttaaaaaatctgtgttgaacaaattaacaagaaaaggcagtgttaaaaggatgctttggttaagctttttcttccttgaaataggttgatacgctcataatgatgtacaaaactcactgccagtgtatcctggacaatgcaattaatggaaactttgaagaggtaagaatgacaaagaatgctttatttgaccctattatatatactttcatgttctgttcttaatgagttcatgttaaagaaaaaaatcttaacatactttttactctgcaactagatccagcattttttattacacttttggcaaggaatgcctgaccatctccttcccctgctcgaaaatcctgttatcattgatattttctgtgtttgtgactcaattctttataaggtaagcactttgggatgtcttaaacatgagccatttatttctttacgtagcattctatctaaattcttgcaatatattttcagtaaatatgttatttatggctggatatacactgtctttttttttgatgagaaagcaagcaatttaatagtgcacgtttaatagtgtatgtgttttaattgaagtttacattaagtaaaacaaactcaatttctttttacagctaataatgagtctatatgtgacacacttattaatatgtgaaaacttagttaaattttattaactctctaaggtgttttcagattaaaataacacagtggattttttttcacaatgccagtgttttggcagaaagcagaattaggcacccttatgagattaataacttgaaaatctcaaaaacctctaactttaatgcattaatgtctaattctcttctcaaaccaaatcagagttcctaagtgtctgcagaaggatctcgaagacatcctaaataaggacaaactgattgtccttctaggcaaacatttaatggaagacagaaagaggctaattcttgacagtctcttccctggtggctacaagttctaagctgatggataaaactatattgcaatgtgggtactttaaagtgagtttgcctacatttgctttctaacttaccataaggaaaaacaaaagctttccttttaaaaaataatctgagttggcaagaaaacccaagctggacgctgttaaacatttaggaaataaaatccttctaagttagttgccactatcagattctcagctttgcagaaaagtaaagcaaaagctatttatagataaactaagtccagaagcccctaagcagaccaagaagtaatgagacaacttgaataagagagtgcatatttttatcctctgtccagtacttcctcatcacaggataggagaaaggaggaataaagtacaatatattttctgcctttagttcaagttcaagttgaaaaaatttcagaggagagtaaggattgtcttgtttttttttttttttctggattgaatatgaatgccattatttagagaaaaacagtttaatttgcattaattgtttgtaatgcttaacacttgacaaggctcccaaaaggggaggggaggcagctccgtgagtgagtataagaaaagacctggggctcatgcacacaaatttccatcagaccaaagctttttggactgtcattcagtttgtccaagaaatacttttaaaacacacttctccctttaagtgatctgttttttttagtctagtataaacatcctgactttaaatatctttaaatgaacctggtttctcctcctcatggtggacccagagaggcacagtgagctctgtaagtagaacggtgtaagatgagcttctacaaaaatcttcctcccacctctagaaagtggtcagcttttcatcataaaacggtatatgattaccatggaccaatccattggtaattaacatactgagcatgtacatatacagtgctatctcttgtttttattgtcatacacactcacacacaactcatacatacattcattttggagataaaattataactttgagaaaggagttaacatgttattctctaggaagctaggaataaaaagtagttgaccaataatatgtctttctatagaaatactaagtaaagatttgtattaacctcttttgctatgattaaggttcttacagatgtactcattcctgcaacaatgcaagaaatgcctgaaaggtatgttcagttaataaaacatgagcattcctagtataggatttaactttatacattatattagaagaaaacattaggtagtaatttattcatttatcaagaagactattttctacttttgtccctttgtatttgctggaagagatgtgtcttatagctgggcctcaataaacaaaatgggtgaaacaatccttcaatccctttaatttgagagcggctaaagtgaaaaatagatttaagcactgttgatcttcgagaaatttttcaatggaaactagctggagtatgataaaaaagataattaatggaaaataaccacaagaataaaaactataggagaaattattgtattttattattaacttttgtcttaattacaaaatcagaaagtggcatgatgaaattactgccttcttttaacaaaggaataaaatctcaaatagtttattgaaacaataccagaagatttttcaaaaaaaaaaaaccttttcaatataagaacaatagaattctgaaaaaaaaaagccaactttttctctgaaaacaaaatctaatgaaatgataaaatttattttagtattttgggggtacaaattcatataggactggacatagttggtgctccaaaaatagatgttgcttggtaaaacaaattttactttttatttaccttttcctccagattatttcatctatatgatagttggtattagcctgatcaataatgtcttttaattatcaattgtagtctttaaatatctattctgtactctgaattgggtacttgaagtggagtttgaagagcttgagtgttttgaccaagatgataacaaaacatctcatgtaccccataaatatatacacctcctatgcacccacaaacattttaaaaatatagcataagaaaagatgataaatggcagatctaggctgtctgacttcaaaagtactgcttatgaaaccatagaataatagtatacctcaattaaaatatgattgtttaatgcattttttaacaatgaagcatttaacacatagccttctttgtagcttattagcagacataagaaattttgctaaaaattgggaacagtgggttgtttcatccttggaaaacttgccagaagctctaactgacaagaaaatacctattgtgcgaagatttgtatcttctctgaaacgacaaacatctttcttacatcttgcccaggtatgttggttgctaagtcgagagcatttgagtcaccatataaaaaatgaatcttctgagaaggacagattgaggaactttcatagattgaagggagctaagtagacaacaactaaatgcaacgtgagacccagaagtgaatgctatgatagaaaaagcacattagtgggaaagctggtgaaatttgaattatgtctgtagttaatagtattgtaccaatgttaatttcataatttgggtaatatacaatagttacagaagatgataagaagctggatggagagtatatggaaatattctgcactatctttgcaacttctctgtgattggaaatttaaaaaacttgaatgcaattaaacatttatttgccatgtgaatctaattggtacaaattaaggttgtgagaagtaagcctgtgtgatacttaatattgtgaaaccacaaactcaacacattttaaactgccgactaatcatggctcttttaaatagagcaaaagtaattcataagttaagaatgatgcatttgtatattgttaaaatatatttctctttccccaaaatgattatctgctttatgaaggtttcttgccttctaaattttaaaagacaagcttgagatgatttcagataggaaatgtaacatttaaaaattcttattttgtgatcatggacaaagagaatccatttatattttctttttctattttttattatactttaagttttagggtacatgtgcacatcgtgcaggtttgttacatatgtatacatgtgccctgttggtgtgttgcacccattaactcatcatttacattaggtgtatctcctataattttcagacttttaacagagatgatcatgagtctcagctactgcttttgtctttaaaataagaaaaaagttatttatgatacttttatctcaaggaactatttttctgatagctaaaaatttcttctagatacattagaaatgatatagtgtagtgtcttctttactttctctatgcagattgccagaccagctctctttgaccagcatgtcgttaattctatggtgtctgatattgaaagggttgatttgaacagcattggctctcaagcccttcttaccatttcaggcagcacagacactgaatctggtatctacactgaacgtaagtccattctctttgtttagaacaaggttttctaagctcagaaaattgacatcttgagctgggtaactctgttggaggagcctgtccagtgtgctgtaggatgtttagcagcatccttgacctttacccattagatgacagtagcagcctcccccaagctgagacaaccaaaaatgtttccccacattgtcaaaggtgttctgggctgaaaaatcacatctgattgaaaaaaaacctggtttataaaaatatttttaattaaaaaaatttatcttctaataaaaaatagttataattactcaccatggaaaagatagaaaatattgaggaaaataaaagtcatctgtaatttcattacctagaaataaatgaaatggaaataatctgaaaataatcaaattgttttgagttttgtaagttttctttcagttttacattacatgtatagaaatttacatgtgttttatagtcttgtcatcctgtggtgtgtgataaatatcaaaatggtatctcagcacaatactgcttttcaaagcagactctctactcaggtttggaccatctgagagagcttaccaagccaatatgcatggctagacaactaggcttgaatttcaagggataacagccactattttttcctccctctgtctttgaaaagacaaaacctgcagcctcctatacactggagcacaaactatggactgctctctggggcccaatctcaactccactttttatttcctaacataaaataggattaccttttgagattcagtaaaccttaaaacctttaataaaaggatagtcttaaactgcccttttaaatattacatgataaaacgttattcaggtaaatggctcaattctgctgagaagaaattaacttttactaaagataaaagatattttggaaagcaggaaatcaccaagcttaggttcattcattcacttttaactaatctgttccgtttaatgaaaacactagactcaaaatgaatatttaactacataaacaacttaatcttccctagtatgtgaatacacatataagatttaaacctatatttcaatatataccaagatatatacacttattaaaatttcgggcacacttcaagaggctgaggtgggaagattgcttgatcccaggagttcaaggccagcctgggcaacacagcaagaccttgctctataatttttttttttttttaatttaggcaggcttgttggtgcgtgcctggagtcccaactgcttgggaggctgaggcaggagggtcacttgagcccaggagtttgaggctgcagtaagccatgatcacgtcattgcactccagcctgggcaacaaagcaagatcctgtctctctctctctcacacacacaccattgaagagtacagtactaaggatttttttgttactgttttcaagatatgatattaattcttttcacacatttatctgtctttccctttcatgctatcaaagtattgatgattccaagttttaggttttctcttggattccaagtagagtacaatattctgttttcttttctttcttttttttttttttcctgggtagatgactctatcactgtgttccaagaactgaaggatctccttaagaagaatgccactgtggaggcttttattgaatggttggatactgtggtagaacagagagttattaaggtactttttaatgacagattcagaaaataagttccttgtaaagagtaaatgctaaactggctataattttttgtctggggggagaggggtggaaggctgtgtgtgtaaaggctttgaaaagcttttgatgctctacgaataaggcaggccaaatactgaaattaggaatatgtcaagatttgagagcattgggcatggattccattatatttctcctttcttgccgaaagactacaagatgctctgccttccctatcagtcaataacattacagctgagtaacatcagtagagaaagataaacttagaaactggaatgatctggcccgtttctaaaaagcaagatttcataaatgctgatggaaaacatggttctaagcatttgcatttctgaattccaaaagctcaatattttgtgttttctctgtggtttcttcaccttctttggttaacctagtcacccattgtgaaacaagcaataagaacaaatatatccatcactagttggtgttggccattccatatcaaggagactagttatagtttggagacttttttccttctgtaaggaaaatagattatcattcagtaccaaagaagtcagagttaatcattcacaaaaatatatagcccttccttcacacctcaccttctgttctttttaaagctctgtcaaagaaaaattaaaaaataaaaatattttgaaaattatttcattttgttgtctaattctattaggaaacaaagccatattgaataaagacttattacccttaaaacatcagcaaagacaggctaacattaaattccctggacagatagttttatttgatgaaataaatgccatgccatctgtccatttgttagacagtctatttacttcttgatctaacacaggatgcatgtagtactgagaggacggattttatagtttcattttgttcctttacttttagaccagcaaacaaaatggaaggtcattaaagaagagagctcaagactttctgttaaagtggagtttttttggtgctcgagtaatgcataatctcaccttgaacaatgcatccagttttggtaacatacgtgcattataaaactgttcttacatgaattatataatttgttcctcagtcacagttcctgtcaatttttaaacatgttacatcatcacttcttaaactgtatctgaatatggagctatgagaaaatggtatttatgagcctgggttttggagtcagaccataagcaggattaaatcctaacaatgattgtctctggctatgggccaatctgctcattgaagaaggggaagaatattctcttcgaagggttgtataggtactttggtgagatgatgtatataaaaacaaattgcctagcactcaggaaatgcttaatgcatagcagctattatcattacattccatcagtgcttggataaattttctttgttaaacaaatgataattaagacattattttccaaagttattattcattgcaatacggcaaatttctgcagcttttctgagcacccatataactgcactccaggaatcaaaaaacagcttagaagacacactgtcatgtttctgacccatctttcctgttctatatgacttgggagacaaatagggttaagttagctttttataaaattgaatgccttctttttccttagaattcctgagactcctattttatagttataatgttaactcatgagtagtaactctgcatttggtagctgcatttcaggaaatcttcacattatgaaagagattacaattaactaaattgtttttatttaatgttctatagaattaaataaaatcagtgaatttgtattgaagaataaacaaaacacattgtctattatttgaaatagacttcccatatttaaagttttataaaatatacagcattgaagcctggccttactacgaaaaatacttttgttggaaaatctattgaatagttaaaagaagttttagttttccagaacatatttcacttgaaaattactcttttagtttttgccaaatctaagaatattttgtttcaggctagaaagatatctctttacttgacttttttcagaccatgttggccattgtctaattatttagtacaaagtaaacagaaatagagcagagtagagctcattctccccaagttgaagcttatcacactccaatgtgtgccctcttaaagcataaagcatgtctcactttcatccgtattttcctttgatgtaattagtggccaaagagctggcaggacagtacacacagtgagcagggcaggcaatacacagaaagattagagatccaagttaagcatgttggtcttagcaggtcatttaaagtccaacaagtatttgtttatttcagttgctccttgtaaagtgttgcgagatggtcacaaagataactgacttctctttccctttccttctctttctctcccctttttacatttcacactgtcctctcctcattctccatccataaacaaggttcttttcatttgattcgaatgcttctcgatgaatacattctcctggccatggagacccagtttaataatgacaaagagcaggagttacagaatttattggacaagtatatgaagaattcaggtaacttaaaataactgttttgttttgcatatttctttgttttaatcttaagttcaagaatttataagttcagatattaagtgggtttatcataatctcagagtttttctccaaacatgtcattactaattctcaccatacagtcacactattggagcactacttttctttcattcattgctatgtagtcaaaagtactttactggaaactctgaagtatacaaaattggtgatcttaatttctgggaattaaggtgaagttggagaagtgactataatacaaaaaataactgtaattcaagacacatgtggtatactacatatgtaagtggtgtaaaaataagttctataggagtttagagaaggaaggaaacacatctattcaggatagggcaacttgcattttgaagacttcactccaaactggattatttagtgctccttatctacatccacatccgcaaatatgcagctaaaaaaaacctagcatcactgtcaagagcaaaggtctgccaacctcacttcccatgggaaacattgcttagtagtttccagattaaatactcaacaatgaaacattttcattttctttttacttgggtttatctacgaggaatgtgagaaaaaatctcaaatttcccattttaaaaactctttccagatgcgagtaaagctgctttcactgcttctccgagttcatgctttctggccaaccgtaataaagggagcatggtttccagcgacgctgtgaagaatgaaagccacgtggagacaacctatctccctctgccatccagtcaacctggaggcctaggccctgctctgcaccagttccctgctgggaacacagacaacatgccgctcacaggtacgctaaagagaactgcttaggctccagcacatctcagagaagcctgttgcttcatttttcttaaaactcataacttccagtccaggaattccaacaataaaaaaggatgatcttaactgagttttaataaagatttataatatttttgtgattttcagcaatggtaataatactgttattaacacaggtatcatgtcttgacacactccataaattatattagaagtatgaataattagttaatttagtggaagaaataattagatgaggtatacataaaattcttaagatgctttgaagatcaaaaaaatgggttgcttatttctggattttgaggagactttatttctcctcccttaaaaagtagtttcgggctgggtatggtggctcatgcctgtaatctcagcattttgggaggccgaggcgagcagagcacctgaggtcaggagtttgagaccagcctgcccaacatggcaaaaccccgtctctactaaacatacaaaaaattagccgggcttggtggcaggcgcctgtactctctcttgaacccaggaggcggaccttgcagtgagctgagatcaggccattacactccagctgggtgacgagagtgaagctccatatcaaaaaagcaaacaaacaaacaaaaaaactggattcggccattttaggataatcgttacaataattctcccttttggtctaaggttctctttgtgtcaacatgaatatttggtggcttgaactagctactcgggaatattttaaatctgcttattgccttgtgtcttttttgaaatctttttatatacattacttcatttgatatacagaattttaaacctagaagagccttatagttcaggagtccatttctaccaatggaacactggcggcccagagagttggtggcattcataaatcacattacttataagaggtgtttgcatgacattttgaattgactgctttgaagccatggccattttgacattagtgactttttctttttaccctaaaaatcaaacagtttaacaatcagctaattttttaattatggggaaatatgagcagcagacacacatgtcctccccatgctacctgtggagaaaccatgaagccatcgcagactttcctctgtagtcaccaaatccacgtctccactgttgtgatatatacatgtgttgtgattatattttttaaattctggatttttggtgcttttcagtttagttatttttggagggcaggaatgaagcaagctggaaaacaatacattaataaatcttttgaatattttttaaagatgtgagctcatctactttaatatgacactaaaggaatgttctggtgattttttccaggtcaaatggagctttcacagattgctggtcatctgatgacaccacccatttctccagccatggcaagccgaggaagtgtcattaaccaaggaccaatggcagggaggcccccaagtgtgggcccagtactgtcagctccatcacactgctccacatacccagagcccatttatcccactctccctcaagccaatcatgacttttatagcaccagctctaactaccagactgtgtttagggcacagccccactccacatcaggactctatcctcatcacaccgagcatggtcgatgcatggcttggactgaacagcagctttcaagagacttcttcagtggcagctgtgcggggtctccatataactcccggccaccgtctagctatggcccatccctgcaagcccaggattcacacaatatgcagtttttaaatacaggaagcttcaatttcttgagcaacacaggagctgccagctgccaaggagcaacactgcctcctaattcaccaaatggtattgatatttaaaagaatttttcttggtttttgagatggcaatgaggcaaaatcagacattgcgttccacctctgctgactagcatgtcctttcatttaaggcttccaaagatcatggaatcttagacatttggagctgatttctgtcacatacatatatatttcctaatttttgtggctttcctaaagttgcccttcttcctttttttttttttttttttgagacaaggtcttatgctgtagcccaggctggagtgcttggcaggatcatgattcactgcagcctcaaacccctagctcaagcaatcctcctatctcagcttcccaagtagctgggactacaggcatgcatcaccatccctgtctatattttaaattttttctagagacaaagtctcactatgtttgcccaggctggtctcaaactaccaactttaagcaatcctctctccttggcttcccaaaatgctgaggtgcctcccaaaggtgtgagccaacacccccggcctaaagctgtcctcctaaataccgcatatgttaaaaaaaaaaaaaagatagttaaatcatatgtttgagacctaccttaatagccccaaagaagaatgttctgtcttttgaaaacatttttagtggataatatttcttcctgataactaaaagcagattttaaagattgggaacaaaacagaccaataaaaataggaagttaagggaattagagagacctgtgaccttgagtcaccaaaataggctttgtgtgtaggcttctttggtgtctttctcctaagtgtaggccagtctttgtcttccctaaacatgcatctatacatgaaagtagtatttttgtgacaggcgatagtgctttttttccttcaaaggtagatcttgttaatttagataagggaaatctgacagaagtgtaatctggtcttaaagttaatacaattcttatgtcttaaattatgtattatgctataattattgtattaaattatgtatgatgctacaattcttatgtgttaaaaaacacaaaaaacagcacagtaaaccttatccatgtacaagcacaaatccagttctgtagcatgtatagatacacatgtaatacttacagtttgatatctttaggacgtcacctcattactttgtcacttttttccttcctgaaagttctttgtagtaagttaacagcaaattctcaacattttctgttacaggatactatggaagcaacataaactacccagagtctcacaggctcggatcaatggtgaatcagcacgtttctgtcatcagcagcattcgttcactgcccccctacagtgacatccacgatccacttaacattttagatgacagtggtagaaaacagaccagctcgttttacacagacacatcatctccagttgcatgtcgaactccagtcctaggtaaattattttagcagttcttgaaaacattttaagaagttgttaacctcaggtatgcaacattacttgagggagatatgctgaggtgaactgagcaagcatgtttccacggttgatttattaccttggatctaaagttatattttttgtatctgactacacagttagtaacagtttttcatttcttattctgtatatctctattatgcaacctactgctagatctgttactttttacaaaaaaaatagctggtatctattaagtatgcaaaagattaatatgacctgtcaaatgcagtctaaaactgtaagttttaaaagggcagtaataatatccttttctcactcttgattagtgttggacccagttgtagtgccaagagatatctttaggcctcatgatctccatcagtatccaaaaatcactccaagattaaaaaaaactggtgtcctgtgatgggtgctactagcattttctcattcttatgtaaaatgtgattcaacacctctgtagaaaatgttgccatttttattgctctctaacatatcatgtaagtaaaaataagaaaaacgtgtgcttgccgtgaagcctcctggaatcttcttccaaccaggttacatttcttaatcctcatctatgaagaaattctgcaataataattagtatgttattagtaataacatagatttagtcactatagatttagtttctaaaaatactaataagatttcacagggcaagtatatattcactaagtatcaaagcagagtgttaatatttatatgagatggttaaagtcttccaatgagattgatttcagactagcataagtagagggcattgacacgcaaccagagcataagggaaaatgaaatcaatttcatctctcctcactcagtgtaccttcccaataattcaataggaagtactccttctcttcctgtcactgtcacacatgctccctgagcagaatctagcagctcatcttctgctatctgcaaatggtcattgcttctaggttactctaatgaagcagaaaattccacttcaggaagttttctcaccatgagactaaaatgtactgtgttgctattgttactattagttctgtttacctgaagagatagtggaagctttgacgaaacataggttaagagtagggtggagtctaagctttagtttatcagagctggcttacaagtagattacaaagtgtgctgcagggtaaaatgaggggatagaataagtggataagtagtgcaaggagaattgagttcaactatttcttaagtataaagcctggttcttagacagagagcacgtcatgtcagcaataagaaggcagcaaccatatatgagagaaatacagggctagtgagccagttaatgaattttattgagaaccgactaggagccagaccccattctagatgtgaggatatggtggtgatcaggccatagttcttgcctgtaagaagtttacattctagtagagggacagtaaggcaataaatacatgagcaaatgcattaaaaagataatgtcaagtactctgaacctgattaaatagagtaaaatgacagacagtaaaggaggagctgctttcggtaggacagctgagaaaggaatcctgaggcagaaacatttgagttgaaagctgagtgatgagaaggaggcaaagatgtgaagatctgagggaggagttccaggcagaagaaacagtgaatgcagaaccgctgaaatcagaataaatttgaaaaaatcaatgggcagagagcaggccagtgtgtcttaagcatgttgaatgaaggagagagtagagcaaaataaataaaaaatcaggggcccatctacatagggtaagatgcttggttcatgttccaagggtatcggaagccactatggcatttgagacgagtgaaagtttgatctactcttcagcaatatcattctggttgctctcgggaaggtgagtgggtgaaacaaaggtggagatcatgggaccagtcaggaggctgctgtgttggtccaggagagaaaagatggtggtttgaactacaaccgtgaaagtgcagatggaaagaggaggttgattgggggatatattttggcggtagcacttaagttgaaatggagttttctttgtgaaatatgtagaggaaataatttctgggagactagcaagtgggaacaaatggaagaaaaaatgattgctctggtaaaccatacagactcaaatttagaataggtatgtgtgctaagtgcaaaaataaatacagggtattaaaatgagtggcatttgcagagaaaagaaaatgtcaatcaattttcaattgctgattatattttcccttacagcttccagtttgcaaaccccaattccttcttcctcatcccaatgtatgtatggaacttccaaccagtatccagctcaagaaaccctggactcccatggaacaagcagtagagaaatggtgtcctctttaccacctatcaacactgtgttcatgggaacagcagctggaggcacttaaaccaccaatgtgggagggggtgctaaaactttaaaaaaaatctctactgtgcaaatatcattattcactcagacttccataagagtaaataaaaatgaatatgcagtggctgacattgttttaaagtcactggtactatggacaactccatagtgaatggagatacttgcagagcttgtcatgcacactaagagtttaaaatgtgagctcattattaatcatagtttcaaaattatcaaataaaaccagtgaagatctgaagatgcaaacatttcaactatgaagatttacatttcactttctaatttattaaacatctgtgtgcctttttatctttggtttcttttaaaaagtatatttaatgcctttacaatacctttaatttattaggatctcagaatcattgtttactatcccttatttgacaaaaagtcaaatgtgtatgttctacctccaacggaaatgtttacaaggtcaagacttaattcaattcagacaagaccaaagttgcttgacttcaattcctgtgcattagtgtgatgatttctgtcacatagcagcattccgattctatgtaactgaatggagatgataagtgctttcccctctttatttaaaaaagattaaaaggaataaaagaaataatgtatggaaatatttttaaaggcttggtgctcttggggctggtactgtttctgaagaatgctggggatttactctttaatctcagctcctttggaaatgagattaaggagtcaagtagtgtggttaaacactataatttaaaaacatttgcatatcatatccatgcctatacatataaagaaattgtgaattgtagactatttgaaccttttcagatttagaagcagtcttttaccaagtactttcttatacattgaaagtcaatgagtgttcagggattagctagatgcaaagcctaattcagaagtgaaggaatcattacatataaattaatacaatttgataacactatctatctttctacctctgtttctttttcttttccatatgtcttcactgaaaggtctgttgtaaagttcctggcctgtggtaggagacttccataaactttacaggcttctcctatagtcttatgacaagcctcatattatttgtattaaggattaggttacactataaaccccaggtacatcgtaaaaggatctataagacccagatactcattatacatcatgatggaatttggtaaaacaaactgtggaatttttttcagcaagcaataaacaattatctgtggacctgtcagagtattgctaccatttgcttagttgtatgttcaacagtatgcagtttataatttaattaattgaacagaaaaagattatagcagtaacaaatcacaaagaatagcaaatgttctattctttgatctagaaatattgtagaaatacagaggagaaaattaataaagacttggaattaagtagtaaacaaaacagctttaaaaagcgtttggccataagtcttgaaagttaaccaaaattttaatgtatactaattaaatacatgttcagcctctatgtgtcagacacttcattatataacaacatggaagatacaaagatgggaaagacactgtcataccttatacatttttgtgtaacaatgtaggggtaatgtgatagaaaatagaagctcctagaggatttttgagtagaaaagcaacgtggggaaagtgatgtttagggaatatctaacactagttggagagaggggctgaattggatagcggagaaattagtctgaaaagggggctatttggaggttgtttctctcatctagatgtccggtggataaacacagagaatacttggaagcagagggaatgagatcagggagagagaaagaagcatcatttcaaaagaatgtatttaaggattttctctaaccctgtttgcaaaggatttccctaccctatttgtaaagcattgcagtgtaaataatttgccatatattgatgccctttttgtaaacgagagaaaatgacccagagcagggagaagcttacaagacatgtgaacagcatctctgggtctcatttgcacctggctgataacaaggtgctcaatcttgacgtcaagagacagatgactaacttgctctttttgccagacagtgggacttgagtttatctctgttaaatgcataacagtgtttctccatgcaggcactattggctttcaggcaggacagttcttttatctcactgttctgcatattgcacaagatttatatccctggctctcaaacactaaatctcaatagaactccctttcccagtcactgtgacaaccaaaaacacctcacattttttcaaatgcctctggagaggcagtgctagttctccttgaattaaaggtgacaacatctttaattttacctagaaggagcatgagacaatataatacctctctgcccttcagttacactcatcatttaaaaatggtttccttcatggatctaagcctgggtgctcaaggcattttctgatattcttgttaattttaataggttaaaggatcttgcctagcgttttagtgtttctgtttccaaaagcaagtatattatccctcaagtagtttttagaagttgtgaagtatcaattataaagtggcctgtttcagctaatgcttatgtgaaatgcaaaattaaggttagaaatcagaattcaaaaaatgcttgctttacaattcaattattttattttctttttcaatttttaaactttttgtagagatgggggtctctctatgttacccagatgggtcctgaacttctgggctcaagtgatcctcctgcctcacaaagtgctgggattacaggcataagccaccgtaccagacctataactcagtcctcgagtagtatttttcaaatgttatgttacggtgtggtggctgctatagataaaagacctattgacaaatgaatgctccaattcactcagtagattttttttttttttttagacggggtctcactgtctcccagctcgagtgcagtgggcgatcacagctcactgcagcctaggctttctaggctcaagtgatcctcccaaaactcctgagttcaagtgaccccctgcctcagcctcctgaagttctgggattacaggaatgagccacttcaatcctggcttcagtaaattcttaatagaatttagagaccaagaacctgttttacaacaacttaaaacccagctatgtcattaacatagaatcacatatcacaatggacctggtttattttcctctctgcaggtagtgttgcactaagaaaaattagaactctcatcagttatatgttcccaagcatgctttcaggtcagaatatttaaacaaaaatttaagctaaattcccattatagttgtaatgtaaaatcctttctctttgttcccctttcaaagaagaatccaggagaccctcaaggtctaacatgcccagagcctattttggaaatggaggggggatgattatcacaacgccgaaacagggaaggcacactggcatttagtgccaggaccatgcatgtgaatgtcctgcaatgtgtgggtcagatttgcacaatgaggaattgtcttacttcaaaagccaataatgcttctataaggaaatgaaggcagaccagtaggctatgaggtggttgccacaaagctttgcccaataatgacgcttcatattatctaacatctaactaatccaatcagataatctcagatgctggtgaggttgcagagaaatagcaacacttttatattgttgggaaattagttcgaccattgtggaagacagtgtggcaattcctcagagacttagaaccagaaataccatttgagccagcaatcctattactgggtatatacccaaaggaatataaatcattctattataaagatacatgcatatgttcattgcaacactattcacaatagcaaagacatggaatcaacccaaatgcccataaatgaaagattggataaagaaaatgtggtacatatacaccatggaatactgtgcagccataaaaaggaatgagatcatatcctttgcagggacatggatgaagctggaagccattatacttagcaaactaatgcaggaagagaaaaccaaacactgcatgttatcatgtataagtgggagctgaacaatgagaacacatggacacagggaagggaacaacactttctggggtctgttggggaagggcaaggaggggagagcattagggaaaagagctaatgcatgctgggcttaatacctaggtgatgggttgataagtgcagcaaacaaccatggcacatgtttacctatgtaacaaaactgcacgtcctgcaaatgtaccctggaacttaaaaaaaaaattataaaaaaaacatcctcaggaactgtgactgcaaaactcacacatagcctagagaaaaaaacaggcagaagagtaaggctgggagagggagacagagaaaagcagaggtagagagaagctgagttgtgagtagggccctgggcagcaatggttggccccctttggttggcctcctctaatgggacactgaaatgacagcttcccagacctgcagtagaaaccagagctgcagctgtgccatcttgaccaatgataaacaatgcccagttctcttctgcccacttacttgagtttgcccttggaaacttaaatggacgtggtctttgtatagtcactcaaagtacagctgctttaactatactaccaggtatactacagtatgtttcctcttctgtagaaaattttgataaataatacattagtggttcactgattttatttttcaacaaataaatctcttcttatacaaatgcagtccattaaaataggacaaaaaaatactgtcaattcttgaaagtcagcctaggtaatgcattttccttccttacccctccaaaaaggagacaagagaagagagagagagagagagagagagagagagagagagagagagaggaggcaagagaaggaggggaggggaataaaaaggaggggagtggaggggagggggtaggggaggaaaacctttgagatacatcttgtgaaacccaaacccgaagttctaacttttttaaaaagcaggacgcaaatgagagtgatatgtctgaactccctggaaaggaatattacagggacttcggtttctttataacagggagtgaaattaattgccatacaaatgttacaatagcagctatgagctcttgtaaggcctggagtagtaaactgttcacgctgtattttgaggatggatttacaatccagggtgagatatagaaatttatacaaaaaccttccagaaaagtaaacagtagtgattatggcatacaggacattttgttctttgggaaagataagaaatgatgaatttatataaaaggttattataccatctcattcaattattgaattttaaattaaatccttgagtttgtaaatggcagagaacacaacctgtccatttcaaaagcacactgattaaatgaaaagaaaataaattgtagttattccttgattataggcattagcaatgactggaaaagattggtagttgtaagcagactctgaggaatgatctattcactaattttgagacatttaaccgtaaaataaggtctctgtgttcttactgataaaaggctttaattagttctctaatatcaaaaccttataaatacagtttgcttttcactgatcttggctatataataccatcatagaaatgttttctattataaaaacaatttattttccacaacaagcaacatcaatttttacttagttttttaaagaatctaatccagctggagaggtctctgatttttcccaaatctctctttaaaaatctatattttcaaaaatattcatgcgaagtttatgaggataaaattgaccccttgttagtttgacccttttacttgtcatatgatgaggttgtagtagaagactctgtccatccaatgacatgggaagctttggacatataaatgtaaaataactctagattcttgttcctattaaaaacattatctcactatttacaaatatttcatttgatatcaatgtttaaaatctatcagttgcttgagtatcattttctttctttctttctttttttttttttttttttttttgagatggagtctcactctgtcgcccaggctggagtgcagtggtgcgatctcggctcactgaaagctccgcctcccgggttcacgccattctcctgcctcagccttccgagtagctgggactacaggcgcccgccaccacgcctggctaatttttttgtatttttggtagggatgacggggttttaccgtgttagccaggatggtctcgatctcctgacctcgtgatccgcccgcctcggcctcccaaagtgctgggattacaggcgtgagccaccgcgcccggcctattttctttctttttaaaaaacggaattaggctggacacagtggctcatgcctgtaatcctatcatattgtgaggctgaggcaggaggattgcttgatgcccggagtttgagaccagcgtgggcaacatagtgagaccttgtctctacaaaaaataaaaaaagtcagccacatgcatacctgtagttgagctactcaggaggatgaagcaggatgatcacttgagcccaggaggtcaaggctgcagtgagccaacattatgccactgcactccagcctgggtgacagagcaagaccccctctcaaaactagacaaatagccgggtgtggtggttcacacctgtaatcccagcactttggaaggctgaagcaggcgaatgaatcacttgaagttaggggttcaagaccagcctggcaaacacggtgaaacatggtccctactaaaaatacaaaaattagccggccctggtggcgcctgcaatcccagctacttgggagactgaggtgggaggatggcttcagcccaggaggcagagattgcagtgagtcggaattgcaccacttcactccagcctcggcttcagagtgagactgcctcaaaaaataataaataaataacagaattagaaaagccaatgcatgaatattgtaatgagataacgttgtagtgatctcaggttggttaagttttaagaaatgaatgtgttgaaagttccaagaaatagtcccttttatcccacattttaatgaatatgtctgctcacactggtgataacaagaacagacaagatttcttccctcatgaagctaatagttatgagggagggcagacaataatctaaacatttgcacaattaattacaattaagaaataattaattgaaaatgtgaaaagtgaaggctgctgagagaaatgataacaagagttaggctcatgcaggtgtgtgcaggacaaggtatagggcggggatagctggtcagggaagcttcttggaagaagcaacgtctaatctgagacctgaagcatgagtaggaagtgggtggtgatggggagaaactttctggtggagaaagagtggtggcgagcagcagaaccgcttgttcaggacaagaatccaacatgtgaggaactaaagactggtcatcaaagttgaaaagatgtggcagatcacagagagctagggagagcggccagaacgagtcgggagagcgactactgaggctttcaaactgtaatggtgatcttagcgatttattgttaaatgtgagaaacttgtgtgattgtgaagatctataaagaattagaagaggctggtaagaatgcctgagatttttataaactgaaatgctgaaacattttcatgatgagaacagccttgctctcctagatttcacagttaaaaattatttaataggctgtaagtcccttttatgtgtccaaagacaacacttaatcaagaaaattaatctcatgagtttttttgtggaagtttcaaattggatctcttttaaaaatgatttcagccaatataaacaagtttagtagaattttctattcttttcccctacaaacttaatcccagacatcctttcttgaaaaacacacttagataacaagaagaggaaaaagtatgtgaattcttttaaatggtgttttcctttatttctggcatgattgattttaaccctaaaattgaagagaactaaaggtgaagaggtcgaaaccaagatttttcagtgtgatgtagtgacttgacctcctttctcaaaatagatgtagagcctccaagtaagatttgggtgagaaacacacttacaaaagtgaaaaattaactacccaatatgatacccgctctaaagtaaagagaaaccattgtttttattagttaaaaacaagggtggagttcttatcaatcaatagtcagaataagggtcagagatttacagccttcaagcatctttaaacacactgaggcaaatatgagctttgtgggcagtttgttaatcaagctttgtcatttggctttgtgtactttagcttattaatgctttacacatgacctctatgaaaaaataaaacttttcatgttttttcatataatatttttatattaaaaatggcaacatttcttgcctgtgaatttcaggggtaatatatttgtactatctgctacccctgcctgctacacacatgccgttttccacgtgtttcttattgtctggacccctgtacaatgtattgtgcccattttgactttctactccccaaaggaagactcacctagaagatgtgcctgaaggtgacacctgatgtcagcatttttacaggaagcgggatattcagttgtctggggaatttgagacacttggacatcaagccagcagaacaaagtcttccgggggaatattgaacctcggatgaaagataaccccttagcatatcagtggttctcttacatactgatgttccccagggagtatatgggaacagtggccaagaactaactattaatcctagaaaccagaaagaattgcttgtctttggtccatgcttcagtgctagatggcttgacctagtgaaagtccagtatagcttttcttgggctccttgatttgagagtcagatgggggtgcagcaggcactaagatgtgtcaggatgatgtaggcaagtctcaagctttcccaggaaagacatctcttcaagattcccgtactcatctctgtgtcatagcactgaagtggctattcaagtttctattaaaatataatattaaaatataaagacagaattagctaaaatatgagtttaaggtagagaccaaatatgtataattttaaaactcttaccacagagtcagatggatctgtgtttttaaccacattatttgtgtgatgatttagataacttctcagagaaccatttttctcatctgtaaaatgggtttaataatagtacttatcaaagaaggtttttgtgagaattaattaagccatatagcatgatggttcttgacacgttgtacaggctcaataaatagcaatggttgctaattatcattattattcttcaaatcccatgaaatcagtagcagtagtaaaagcaatgcagaccgttcttttatgtctttatgtgtaacatgaactgctctattgctagagttgtctagtaagataacgtaggccagtgccaattaaataagaatttattatgtaaaagtaaagggaaaaaagcaaaatgtagtaaatcattaactactccaatgtggtttcatagaggtgatactcatgggataacaatatggtctgaattgttagatatgaaaataagattacaagcaatattttaaaacaatttgtttttatacatatattactggtttcatacaatcatacaaattctttctctattaatcagtaattctacaggagaattgtcaatgtttatttcagtctaattgtatttgttttcacagacctgcaataaagtcataaaaacatgaaatttgtccgtgaaaatttctattataaaaaagtatttttcatggattaatttttcttccttaaaagtcatttaaattaatagttctacaagcacatgtgattaaatttataacaaaaaattattaatgaattggacatttctaatgtcttcataactgcttagggacaaggtgctttctgatctcttccttattattataaggaagaccttcacgctagtcaaaaggccagtctcccaggccactaagctgtacatccaactgtcaattgaaaatctcccccaaaatgtcccccaggcccgtgaagttcggtgtgtacagacttggagccatttgcttcattcttgttgtattctgaccatgtatttatctccttgttatagtgccacaaaagccagaaacctgggaattatcctaaatgctccctcattgccccctcttctggtcagtcttttccttctaattatcttcttgagccctctcattctctttatcttcgtgtacaacccagtgcaaactcttcttgtcaggactgtgatattagcccaattcaatcagtttctccatcgtatctggagagatctttcttaaatacaaaatacacctctgctcaagattcctcacctgctcctctttgacctcggaacgatgcccactctcgtctgtatgagtctaaggttttttcacttttcctgcctggagctagtattgatcattataatgtatacacttttgaggacttcatctgcaattggaaggcttatagaatttttagatggcaaaaataatcaccgtaggtactgggatttcctttgtgttttgttgtcagagtagaaagtgtaggaatataatgataaaggatcaatagagatgaaattgcttataaaaatcaatagctttaatggctttaaatatttcaggacattagcatttgacacaaacaacattgaaagaaaccttatttaatggacgtttctggctcaattctcagtctctttaatttgtgacaaagtgatattgaaaagctgaggaaataccttgatagacccccatgacataaaggtatatcgagacttaattgaggcaaaggctgagataagaaaattaatacacaggaatttaataaactctctcttctgcccctcttgtgcttggctgattttttaatcttccggtataggtgtcttgttcccaaagaagtctctcctgaaactctaaactccaggttagtgttcctcccataagctcccattaggtccttccccaatatggcacttatgctatgttatttttctgtatcctgaactagactatatactctgggatggctgaggcaattttcaggtttattgatataatcctgcaataaatacatgattaattaaaattgcaagaaaacaccattaaactcagaataagagtagtcacctttgggttcatcactcaagatgctgtgcaccaaataacatcttgaggccagagacagtctagacaacaatcattgtcatctaatgggactagaattgcacaaagtatagaaacttaacggaggctggacttgccatggcataattaccaatctaaaactccttggggaagaaagttgtgttatatatgcacataaattttgtctacttactttttgtctttagatttgattttattttgaatcaacggcagggttgaaacacaagggggttctaagaactaatgtctagttatttattttcatagactacgctctcagcaaatattgattaatgcagtaattgattgattgattgattggggagaactggaagatgcctttgtaagtcacgaaacccaagtgtacatcctaaataaatgattgtacttttgctcaaggagacagatgataggatgttcactgtattctcaaagcaaaaaattagaacatcttaaatgaccatcaacggatggattttcaaaatgagtaagtgttcatccaatggaatactatacttgaggcaaaattaatgaaatctctacatattaggaataaattttgaaaagatcatgttgagtggaagtccagttcaaaagattaaagtccagtatttatataaatttaaaaataaaaccataaaataaaactattgtttataaacatacatatgtgatgaaaatataaatatgtgattgggaggtatgtatagttatatgtattattttcagtacatgattacctttgggaaaggaggcagggggatgagattggatgagggtccatttgtatgtgaaagacttggtttcatttttaaaaagatgcaaagcaaatataacaaaatgttacatacttgttcaggtacgatgatggatacattgatatctattatatttttctgtgtacttttggtaacttaaaatatttcataatgatttattaaggtaaaataaaaataagccataagaaaagagatcctattcagtttcaaaaattcaaatataatttacccattgatattagttgaacagtacagcagtaagtggagtaaaatatatgctattgaagttaaggggttatttaagtctcattagcaaacgtttatatctccagggaggctaattagtcagtaataaatgttttgttagagaagatggagaagactgtttttcctttgacaaaatacatattttttctaactataatacaaaagcaaaagatgcttagaaatgcataaactgacctctcataagtaaaaactataaaacataattttacacacatacacatataagcctatgtgcacatatgatttaacaacatgattctatgcatattggtttacacttatgtattatatgtgaacctttttttctatattaactagcttccttcgacagaaaattttggtagctgtgtagagtttctaaatatggatatttataacttacttaaccaattccctactgttggatatttaagtggtttctagacttaaaaatatataaatgtagtgatttcctggttcattggaaataatatggtttagaagatccttcaatccccacattttatttattgagccccaacatataaatacacagagttgattttttttaacataaggagtcatccaggtgatgagctaaattttttatgtattttcagcatgtcttatgtccaggagacaaaaccagtataacaccctggccacctattagcatgtctggaagttggcatccctagggtaggactacatccccacagtgatttttatctgcctactttggagatagggaaaagggttgccacactaaaactgttcaaagtgaaattcttaggggataattaaattgtttaaatattcttaaatgggaattctttccaaaatattaataatattgatcaatggatgtattcctctagtccttacaacaactctattaatatatttctattcatgatgaatgtcagaagaacctgctttttgatagttttagggtagacatagcaaaataaccttgttggcctaaattcgccgcccccctctccaaaaaaagaccttttgaaagatgaacatccatttgcactcaaattaactgtgggcttatctttggagacaggtagatgtgtgagaatatggcaacagtctaggtaagagatgatgaacacaatgcacaatggagaacatgagcaagtaaaatttaagtgaggggaaatagcattaagcaaccatgcttagtgaaattcaggcactatggaggtcgtgatttgatccactatcaagggcaatgtcacaattcattatttcaagttcagttaatattgatgaggtataaacacatggcttcctcccttgaaattatttcttcatgtaaacacacctctcaatagcctagcaacttgtctgccttctgctttcaaagctagatttatcatgcattcccttagataaaaggaatggttcagacacatcttcaacatcccttcccaaggtataaaatccaaatttctgctcacggtcagtgcaaataacctccaacaagcaaatacttttctgttatattaaggagaaaacctacagaaaaaccaacttgaactggtttttctgaggcaggtcttgtgtttgtgtttgttggtgaagtacaaataactcacgggagaaaaccctatgcaacacataaaatctgtatgtattacctggaatcccttaggctattataatttttataataggtgaagatgatactgcaatactgcaggtaaaagatggttaaggcttcaactcttgtgatgaatttgataggtttaaaatacttaataattgaatgctggggagggaaatggtagtaagagagacaggaaagaaaagagctgatctggagactaggtatgtggtgaggccgataattgagtaagaactataggaagtgtagtccttctgtcggagacattctggtgaagagcgacgagagacatgatgatttcacacagttttgtggtttctttgaggtcatgcctggactggcttatttccagtctggaactcaggggaactataaaggttgaaagtatgcacttgatggtcattaagataaggtgttagttaaaactgtaagtagtaaagttctttgcctagggagagtacatagactggccagagcggtgaaccaaaagaagatccctgagaaacttttctttttaaagaggagacacagagaaggcatccttatagagactgagggccagaactgggagaagaaaaagaggacagttataacttgaagtcaaggatgtggagagtttcaaaaatatgtgcttgtcaatagtggtaaacaaaacatagatgctccataaaaagtttgaaaaatatctattaggcttggcaatataaagattgatgggctttgctagggcagtttgagcaaaagccagtttgtatgagtttagattactcaatccaaatgtatgcaaatttaaatgtaaataggaagtgagaaaaggtagacaaatgagtatagaacactcgttaaaaactttttctgaacttcttgcacttgagaacatgggctacagggttaagagagggatgttttattttgttttttgactggaagaaatttaagcatgcttatgaactacagagaaacaactggcagaggaaggcattgaaggtataagagagacagaggtagtggatggggtggcagacaggaagcagtatctttggttgcatcagcaggacttgctaatatttttcttctcactgccttcccatggcactctctattcacatgctattcaccatctattccatcagattccttggtagcatctgcaacactacttatccatttatgagcattattcttccaagccctccctcaaaatccttgaagaagaaaaatgggatagccttggtgattggtgagtgaaagcagaatctacaccagaagtatttctctatttggttgtgtgctttttaattgctatatcggcaatcaagtgacctaatcagttgtgtatcccccctaatgatttggtattccttgcccaaaagcaagccctgttattaaagtgaaacagccacaaaaatcttcataaggtggagatttctacaaaattcaagttatgcacacatctcataaaactttctgactgcctgcattgaattagggtaggattaaggccactgtactatacacatgtatacagagaacacacaaagatatattacttttctggtgaagcaggaagttctgatacagcaataaggcacagacacatttaggctagtctaaaggtagatcttaaatttttggctttttaattacctagtgaaatgcacagtaggtgcatttcctccattgctaacccccagcccacttctcagattcactcatatacccccaggagtaacctggaggactgagtgaggtttagaaatgcatgaaggtgtccagctattacatgatcatttttataagctgaaagtttagtgctttgtcattttaatttcattaatgtatgtgaaatttaaaatggtcacaatgtgaaaattgcatgaaagcagccttgtcagaaggacacgtgacttccttagattactcagttctagcttttcctcattcttcaaataatcatactttctatcaatgaccatctccttttttttcttttcccatctttgcctcttgaagtctatggctgatatgacaattctttatcctctgcccctactccatggccaactatcactacctttcagcagtcattctagaagccttttctgaaatgatccatcaaaataccaaccaacaagtattgctaagcactagggactattattctgaggggtgggaacatagtttatagagccaacagtcactagcagctttgcttcattttattttctggcacttttctgtacagagaacgctactaacatttaaaatctgagttctgagcctcagaaacagtgcaaagaatgagacatgggcaagaaaggtgcttgtaccatcaaaatgacctggaagttcattgttgtttatagtttttcacatcagaaacttggatctgatgtattaacatcatttgaatgacttctatttgaaaaataggattcgtagagactctaagacactataaaaattttcttcaagtgcagaaagaagcatattagtagagcaaacacctatggaaacctgaaatgaatttcctctcttgtcatttttcttcacaaatgaagaacctttgtcctggaaacgatgattagcatatatctactgcaaagtatatgtgcatgttttggagtttcttggcataaaattgagatttgtgtcctctcttaaaatttaaagaagaaaaaggagaaataaaatgacaaaaataatgtagtaggacaagaaaataaaaaataaaataagcaaacaaacagcaaaaagacacgctatggctctttagatgaaaagaaatcagctaagcacacatttccattcacagaatggcagtttctacacatgcatattcaaagcatctttaaatgttcagttcctattgtagctactccatttctgtagatttttttttcttgatggtggcacagatggactcacaattggagagaatgtaaaaagattctatttagcaggtgaactaggaaagctgacctaccttcctctggcttggttgatcattacctttgatcaaataaaagaccacatgttccagctgcccttatgccctgcttactgcagtgagagaaggaagggagagaaagacagaaaaatagaaagaagacttagacaagatagatattatgtaaatttgcatatcatctgaaggcaagcatgtttcatgtgtccacattcttcattaaaaaaacaattagatgagttgaaaacagctcacaatacatttgtttactcttactgtagagtaaatgataatctcttgtaacaaattcaaacttctaaaattaaaaatgtcatgcaatatgttcatagaaaaaaaaatctggatgctaagataggcataaggaagaagagagtgaggggtgaaaagaatggatgtagaaagagagccagagaacaattattcttcatgacttcatattgaaaccttgaggattcagatatgcagagatccatacaaccacctctgccatctggccatgtgtagtaatgatagaattcgtggatttcttgatatactttgtgactttggaaaatgctatgctttaaggagcattagatactcaacaatatcttcttgttttccatttgagtttactacaattggtagatatttggatttagacaagatattactaaaagggaacattcaaaaaatgaggtttttgttttcccaaaatgaattttagaacttagttctcttctgaaacacacagaaagatacctaaatgtgatagaatatgaggagacagataacaaattagaatacatatcacatttttcttaaaaatactgtatgtagttttttttcttgttataagtataaataagaatatgttgagaggggtaatttggtatcaaattgttgataatgattttccagggtgggaaaattacagggaactttctgtgtaatgatttcctgtaatcattaaattttgttgactactatttttaattagaaaaaaatctaaaacattttgtcttataagttgtattaggagttggtaattaaagtataattacagtggctatcctagtcaatgctggataatttgctagtgactaggggctaatctgcattttctggagaattctgctactgaataggccctctgaacttgatggcctgtttgaacttgatgaatcacatttgagaacagatctaaccgaatacttgccttgtttttaaggaacttctttgaattatcccattttattggttttacatcaagcaggaaatgataggcatatattgaatggtgacagatatgcactcagtaaatttaagagttattgttgtaattgtccaaagcaaaatgaaagtcaaaatatagtagactattcgtacttttccaaaccagaattaaaaccatagctgtttaatttgaacaagaaaagggttttggagactgtgtctaatgaaggtaaataaataaacttggaatgtgggaagctctcaagtctgaatgacaaaaggagtgtttggaaggatgaaaggtcatgagaagcctgaagacagccctagaatgatgtcactctgagtatgagattgtctgggtctcaaagataagtatatcttctttcagtttttaaaggaaagtaaagctaagtaagagatttcattttattcattaacttttaagagacaaagactaagattttcaagtcgaagcctgaaaaaaatgtgactggacagagatgtcattttatttgatgtttccagggctgctgagacagagagacttgaccagtgtgcagtgtcccgatagaaacatgaggataaaactcaaagtgtattcttctgacatcaacaaagtcatttgctgaattctgatagtataatttcaaattgtaaagagaagaactttgtacctcatggtaacctgaaaccatatgtatctagtagtaaagattactttaagctaaatttgttaaaatggaatttaatggccataggtattcacaaaagtgaaatcagaatctcttcctaagtcacagggataacaagatcaaaatgtgtttttaagatttgtatcgcatccttgaaagttaacagtgtgattatattattgctgctcactttcaaaagctgaaagtgttctgggggaaagtggagaatatttggctgctgcaatgcatcattagtctctccagctacacctaaaaaaatgaatcaataagactttcacatcatacacaattgttacttagctgttgctgataaatttcgtctttctcagggagattttgtaacttggataaatagatgcctgtcattcattccacagttgcctcatttctgtgacttcttgaaagaagcatatcccatgtatacactgagataactttcagtgtatacatggctagacgatagcatttctttagcatggtattgtctgtaatctgctgtctccatgaagagcatctgcaactggctttgtcaaacagtcagactgacatcaaagctggggcctttgtgagccagcagactggcaagatgagcacagccagaggagaacaatcggtggctgaggcacagatgatgggttcccgtgctttctctcacatctgatttacttcatcttatcaatgctgataagagcaagaaaactatctgaactggacaaaggcaaataatagaatattattaatgcattcacataaacatctaaaagaatacttagaactttgtgagcaatatcaggttgatcttttaactatgaattgtgttggccacagtttttcctcttgagggattttaagacttttccacctcccatgtcactgattatggactgtgaagtaggatttttaaaattattattttagtagagtcggggtcttactatgttactcaagctggtcttgaactcctggactcaagcaaccttcttgacttagccttcccagtagctaggattacaggcatgagccacagcacccagcagaattctttattgtatagaatgcgtaggcagtgaataggaatacctacattgccaaaataattttcatttctttggaattctttttctcatgttagctttagttccttttcaaacatacatattttacatttttcatgattttctataaatttgctatcaattaggatagttatatatcctaatttgcccctaatttgtgagtttatatgatgctttttatacagaatttttataaacacttataaatgcattgtattaaaaataaaattatatatatatagttttcttaaacataaataggacaaaattttatgaagtttttgtttgtcttttcatatcaatttaataagaaccactgcatacatattctgtcacatccatggtttcaggataacatacatcactgatgcaactcaactgcatgcatacatttttagtaatttgtatgtgcccagcagtgtgcttttaaaggtaaattactcctcatcttccatcacaggataaaagtgattgtttacctattggtttcctggcataaacatggttttaataatagtttctattaatatggtcatagtaactccataaaaaaaaataaaaaacccttgagtttgtcagaggatcagtaagctcacaggagacactggatgcttttaactactttttttttttgagacggagtctccctctgtcacccgggctggagtgctgtggtgggatttcggctcactgcaacctctgcctcccaggttcaagtgattctccagcctcagcttccccagtagctgggactacaagcacgtgccaccatgcctggctaatttttgtatttttagtagagagtaatttttgtaattttagtagtacaaaaaaactttgtatttttcaccatgtcagtcaggctggtctcgaactcctgatctcaggtgatctgcctaccttggcctcccaaagtgctgggattacaggcctgagccaccatgcctggccccttttaactatttctgtaccttcataacatcaattagcaactctcatctcttgaattccaatatacaataagcagtcatcacatattatagcactcttttaataaataatacatctacatgtgtctgctatgtgccaggcactgtgctaagtgtgttatacacatgagtaaaccttcccatcagccttatgaggtaagtgctattgctatctccattttacagatgacaaaactgtgtacggaagacaggcaggtttccccagactctatagctagtaggtagtggaagctagaagttaaagctaggcaccttgaataaaggtttcattctgagctatgacaattctgccttagatggacactgtggtctctctactcctcactcccatcacatccctatccaagatttatggtcagttattgttggcttggcacgagctatttcagaggactctctcaatttcacctttggctcaaagtcttcaaattattttttaaaaagggaaggaaggaagaaggaaaacacagaaagaaagaaagagaaaggaagaaaggaaaagtcttaactaataatgaattctgtgatagctggcaattatttcccagttttttttcctctccctgaatagacataatatgacagatgtcagccaaagagaatgaggaagttgatttaagtccactattaaaccacatattcacttattttttattgaggaactacattggatttaaaggtaaaatgcctcaagaatttgttttcagatagagcaactgattgtaatagaagtaaaaattttattatacttcttaactgtaccaggtactttaatacattatctcataaagaccacacagcaaccctgttatggaagtaattttattttcactaccttatagatgacgggaccccagcttatgaagattaagtgactcccccaagtccatgaactaaaaagtggcagggccatgacttgggccctggcatgactccaaagtttatattatcaaactctttttgctgcatctcccaaatggcaaaaggtgcaatttatggtagttcagacattctcaggtccacagcgtggggatgggggatgggactgattctatgccctttaagaaggtttaacaggtgcaaatttggcaactcttctgcctcttctttctgggaatgaaagacagggcctacagtttttacattaatgcaagtcaatatatttcataagccacttatttaaaaaatattttacctttccctgaatattctacttgtgctctgtgagccctctctatgatacccactatagtactcttagattcctgacaatatcatgacaagttagcatgaaaagtttccaatactatgtgtcatattaaaacttgtctttttaaaaaataaattctaaaaattgtgggtacatactaggtgtatgtatttatggagaacatgagatattttgatataggcatgcaatgcatagtaatcacattatggaaatggagtatccaccccctcaagcatttatcctccatgttataaaccatccaattatactctttatttttaaatgtacaattaaactatcttgactatagtctctctgttgtgctatcaaatactgggtcgtattaattctttcaaactatttttttgtacccattaaccatctccacctccccttcaccactccccactacccttcccagcctctggtaaccctccttctactccctatctccatgagttcagttgtataataaaaacccgtctttacccagtgctgactaaagagacctctgctaggcagtgtctgggaaataatgttctttttaaaaaaagatgggtgaagagaggacctatccttcccttccttccttgttggtatgtttgatgtcaggacacaccacatgggactgctgcagctattttgggaccatgaagaagaggccaagagaactctagaaaaggcaacccagttatctagctgcattgaacttctgaaccagcctgggatgcacatttccagtcttcctgttatgtaagcagtaaaatatccgttttgaccaaaacacacacacaaaaaccaaaacttgcctttaacatcacattcattctctaatccattaataataactctccatgtacgagaggaaacaaaacacctttgaaaaacagcagcaggtaagaagatactttcacctccatttattttgaattctatgacagtctttcttttccatctctcagagataaattttttccttttttttttttaactgatatgttaagcaaatcaatgccctaaaatcagaactctgacgtttaaggaaaaaaaaaaagccctgtagttttttttttctgtactttgaggggaaaaatagtttaccttctcactacaacagatggttttaaatgcagtgattacaaaattctgaaggtaaaatggtttaattacaaagtcaataccgcctctaacctgggctgagtctttagcgtaaaaacaacagacggagcagtgcaaacgctgggacaatgtttaaccagaactttgcatagctactgcagtagggctttccatggggctttagtaaaccacagagctcacgattctgggtttctattcattgaattaccttaaggtgaagaatcataaatgtgtgtatatatttcactatgcaatatacgcatgcacacacgcaagtctgatggggtctactcctggaacctgaaccccaatagtatgagatggggttcaatttcagcaaaaatgagtgataagaaaaaattaaggatacacagaaaaaggagtttgccacagggataaattttcggttcatttaaaaaggacattattctgaaattatatgttagtaaacttgatttctaaacattaaattgtcagtttttgcttaaaatccaaaggaaaattaatgacatagtagaaaatgattcaattgctagatgtttgtaaagatgttttaaaaacacacaagaaagctaagtttgctttttaaataaaaaattatcatctttttctaaatagaaagatgggtggatacaaaaattattcgtggattaaaccctaattcttattaaacttgtaatactgaaaaatcactttgagtgcctcttgaaaacttccctacatgctgaattacaatatacttttatatcaaataactcggttagtgatttcttttttcattttatccattaattagaatgagaaccattcatgaaaactgatgtaaaagaaaagtgcacgcgttctccctaaggtggcatattcttgcctcacatccactaagtatttaatacaggccattacaagatagtttgggtcattggactaagcagatgtgggaggtactaaatagttaagtaaaataaacatttcggatggtcttatctcggagtcttctgatcttaataaatgtcaccagaataatctaaaacgactctttagcaactctgcagggaattaaaatcagaaacattttgcgatttctaatctgtttaggttgctctgaaaggaaaaatgcctcattccagcaggcagtgtatggaattatattcaacaaaacttggaaaggttggtgttgaggttaaaatgtgaagaaaagtaaaaagaaataaatagtgcattctaaaaataaaataaaaatgccttaaaaagtgcaatttttaaaacattacattaaggcaaagtaagtcaactgaatcataatgaccacaccttaatatgtcttttggagaagtgttaaaatttaatcgcccaaattcttagttataggacatagctaactgcttgcctaatttcattctctgctacatgttttctaaaaagtcctgaagcaaaggatgaacaatcttagcttttaaaactcacttagaattaaggaattctttggtatttctcagtgagaaattcttgaaaaccattcatttgaaattcatttaattactctttcgtttcccactctcacgccccacttaataggcaaccattctaatgtatttaatgtacagctttttacattttgcactgaattagaaatagagacaattctaggtatacacctagaattgagtgcatagaattcactgagtgtatacctaggataagtaggtattcgtgaaaattcacagagtgtatacctaggataagtaggtatactgtgcaactagtcccaagatcaagaggcagatattgccaacaccccacaaattttttgtgtgtccctttcaagtcactatcagctcagagaaaccactatcctgacttttggcagaggtgattgactttacttatttagtacattatatcaacgggaccataccatttgcactcttatatgtctggcttccttagctcaacattgtgtttttaagatacatccatgtttttgtgttcagctggagattgttctttcttactgctgtataatatctcactttgtgaatataccactatttattgcccttaatttttgataaacacatgaccatatttctgtcaggcatatgcctgggaatggcgaagttaagttataatgtgtacaatatgttcacccttagttaatatggccaaagctggatgacaaactgaatgtttgtgctgagccctttgtttctatgttcttatagaagatgaattctcatttggtatacacacaactttacatatattaatggttttatgttattcatctcgttctgctttccatgtttttttcattcaggattatagatttaagatccatgcacgtggctatgtgaacatcaagtctgtgacttataattgcacatcattatagaatgaatagtgacatttttgaaataatgttttgaaataatgtaatgtttaacgacagaggaatggtttcattcaacaacaaattactataggcccatttaaaacaagtttttaaagactttatgaaaataatattttggaaaaagaaggacgtaaaactgtttacaaagtataatctaaattttatttttaaatgtataatctgcaagggaatataccaaatataagtaatatgtactatagtataagatttgtggtgcttttttcttctttatgtttttgatattttccaaggatattatgatcaagaaaagctaaacaacaaaaaggtaacctatgaactacaaaacagagtactgtctttacatgagctaatatgtgttataaaacattcttttaaatatttttatcatgtgttttcccactgtttcacatcacttttttcatagtcattatttgcactttgtgttaagtcattagtttcgtctctcaaatacaaccttgttttaatgtcttcacctttcttctactttagtctcttcaattttgcctcattattcattatagaggcctgctagaagtcagcacgtccctctcttctcaatggagcagctctctctcccctcaaagctaacagttgatatttttcatattgttgagtgttatggaaaacccacatcctgtaattgtgtgttaagatgcctttcctcttctcaagttcatttcttaattacctgaattattatatctaacccacattgattatactataagtggtaattgttaacattactaagtagaaataggatctcacattaaatagagcttttctgtgattttaatctttgttagggcaaaaacgtttgttcctcaattttgcttctcctttaacctgttctttgtccttgactacaaacagaaatggaagtgggcattccctcaagcaagacccaaacccaacccttcgaatgagagcacatttttttttacagtttagaaaggaaagtagaaaggagagatcatctcattctaatgacgaaggctgagtgacctttccaacctttcataactggataaagcctcatcagaaataactggaggtagtatcttgacttcttttccaatgcttttcaaccaccatatactcttccatctcaatgtaaccttagagatgaaactattccttctctggttgttgttgacatctaacttaaagtgtgttattataggagatccacatgctattcttatgtttatttctcaattaaccaaattataatatgtaacctacaatcagaataccttcaatcatagaacagattaatatttgtcaaatgggaatgcataagcagggctgcatcatgactttcactggccccaggcactttttgctgtatgggttccttccaccatataaaaatattaaaaatttgtaaagttttacaatttagtaggatggagaaaagcaataaagaaaatgaaatggggagggtgatgagaactatgacaacaactatctggccacgtagctggctgggtaggaggctcctctcctggctggtccacatttattcactacctcccttgtttcatccccttggagttgctctagggagcccttagaagaccactaccaccacgctcccaaactatcctgcctgcttacctctctctctcacagaacattttctgtcatgcagcttgtcctctcagtcccctattctctgttatgaagcaacccagagggtggatcatcatataaataaatgtcccaatgtgttcactggagaacgtgctgctccaagtgggagtcacctcttcattctttttcccattatagtgaaaaacatgccccgatgtttactgatggcctgatgtttacaaggtggtcatctgacttgatgaactgacttgcagaattagaaactctggacagaaagcatggtctcttactggcaggccagcacccttttcacagccagcctcctctgcatccaagcctaaaacatcactgcatagcatctctgtattcctgttctatggaaaaataatttcaaagcagtacgcaatccaagggtaaataaagcagaaaatccatacatatttaagccttttcttggttaacgacttttactaatgatggcaacaaaattattgaagcctgcaataagccatccagtggtcaaataggtcaccttatgactagtattaagatttaaatatcctttaaaattaaacagtttggggttattaatgtttcctttcctctcaaaatttttgtgttgaggggaggtatgggaggaaatgtattagcaacagtaggatgtgaagaataactctaagtacattaaacatctgttgatggagccattagcacaggttgtagataccgccacctggcctttattccattttgctcgaactttagtacctgaaaatatactgtagtaattttgttccacttcttttaaatcttttactactgcattaagtggaacataagcactaattagttctcactgagacaaaaagacctgcttatggcaaaaatcaaaagccaataagaaagtggcaagggttaaagcatcacttagcatcttgagctggtggtgttactgcctgtatgagaggaagtccttaaaacagcaaatggaggtgaaagcagctgtagtttatataatcatgttattcagtgagagaatttcagctccttcctctatcatttctataggttatttttaagtgtaagattagatttttcatggtcaaggcactaaataaaataggatcttcaaaaaataagtctccatattccccaaatgctaagcctaaactgttttttttttttttttttttttaggaaagtcatgtgaacaagtgcttgttctgaattttcatcagatttacaaagctcaattaaaggcattaagccttctcctgaaaggacgattgactttcttgatttatagcccattcattcagtcttctataaaacatggtccccaagctacagaagcactgtgtctgactcaatcacaaaatcaggcttccctgtgtgctggcacatgggctccttctatattaacgttttcttcacatacaaagagattcatcaagttttgccgagatgctctaagagaactaagcaatcagagtttcatttttcaactcctctatgaagtgtccccatttccagcttggccatttgagatttgaggcttcaatctattaatgttaatgtcatgaatggatgagttccatagttccacacaccgtagatctgcagtgttccttgaaattgttcttagctctaaataatgttatctctctgttctttatgtagatacactatattatccattagatgctgtggaactctgtggctggacatcagtcccaatatcatggctaaaaagatgtatcttggacctaggtttgatgtagttgccctgggttaccaattataattatatcaaaggcatctgctttccattcttaactgcaaattgatggagtgagttgtgataacatttaagtttcacgtattctttgacaattcaatctagttactgtattcactttcatacaatttgtattgaataacttgtattgaacaacttgtgctttagtttccttctcttcaaaatgatgaaaatgattcctgggctatatatttaatggattacagatataaaatgaaaacacacatgtatcttgaagcatggatgtaaagaatagctgttgatagcataacattgtttctgaccttttcttctccttcccatccccagtgtcactcttctagtttagaaactttgtatgccttacctattacttcagtgtagtcattctggaaaaaaaacaactttccttcttctggctgaaatactactgattcctgaagactcaactgacctacttttttctccctagagacttcccagttctttcaggccttttctcacagaattaattgcttacttaccatgtcttatgtagcattgttggttttgtttttttgtttgtttgcttgttttttgagacagggtcccctctgtcacccaggctggaatgtgcagtggaaatcatagctcactgcagccttgaactcctgggctcacacaaacctcccacctcagcctcccaagtagctgggactgcagatgcaccaccatgcctgggtaatgatttttttaaaataacatttggtggagatggagttatcactatgttgcccaggctggtcttgaatttttagcctcaagcaatcgtcctaccttggcctcccaaattgctgggatacaggtgtgagccaccacatatgacccattgttggcttttggtcagtctatttcttcaattaagttgtaagtcctttgagggaagaaatcctggtttggtcacattttcatcccctaaagtacccagcacagtgtcttaagtcttcttggattgaacggaattgaactgaataaggctaatgaagaaacctggcaatgaactttctattaataccaaagtaaaattattgatctattgccaaattcagtggccagttctttttatcttcatatttaggacgtcttgcagcatttgacacagcagataactctccttcttgaagcacttttcctgtaggtttttgagacatgacactctcctttttttcctcccattttactgactactccttaatcttatattctgactccacttcctctgcttacctgcaaatgctaaaatatcccaggcctctgtctttaacccccaacccattgatatagtttggaggtttgtccccttcaaatctgatgttacaatgtaatccaacatttcaatatcaatgttgaaggtggggcccagtggggaggtgatagggtcatgggggcagatccctcataagcggcttggtacccttccctttgtgatgagtgggttcttgcttggttagttcataggagcgctggttgtttagaagaagccggc

SEQ ID NO: 378 - DNA, 84120 bp, Homo sapiens
accagcaacattagactaaaaacaaaattctgtgcttgttattcacttcaagatgactttttctgattctcaaactttgtgcaaatttgtatgtgtttattattataaagtttaacttaatagaacctttgtttcatttccaattattgtcataacagatgttttttagcaaatttatttcatattgttgttgttttatttgtgtagcttcactagtttttctttaatttggtttcggtcttcactttcaaatcagcttatattgaatctgacttagtaaatgcagttgccgattgaatctgatttagtaaatgcagttgctatgcattaaactttcaggagatgcttctttgaattgcacagatgaaattttaggtcagaaaatttccaggaagtagttaaatatatttcagaagtagcaaaacaaataggattatagttatttgatgtgcacattctacattctttgctcccttgaaggaacattttacatttttaaagaagataaatggttatgatatagaaataccagtaaagcagaggaatacctacattagatttatcgatagaatactcatagccaacattgagtgttacctcacttgggaataaattagagtggattagaaatatataaaatgatttaaaaatctgagcctgttttgaagctctttttttttcctttttatttaattactatttatcttctttcttttttctttttttttcagaggtctcactatgttgcctagtctgatccctaactcctgggctcaagcagtcctcctgctttggtctcccaaagtgttggtgttaaagctgtgagccactgggaggccaaggcgggcggatcttgaggtcagatcgagaccatcctggctacggtgaaacccccgtctctactaaaaatacaaaaaactagctgggcgtgttggcgggtgcgttggcgggcacctgtagtcccagctactcaggaggctgaggcaggagaatggcgcgaacccaggaggcggagcctgcagtgagccaagatcgtgccactgcactacagcctgggcgacagagtgagactcagtctcaaaaaaaaaaaaaaaaagtgtgagccatcatgcccagcctaaagttcttaatttgaaatatagagctggtttctggtttcttatttgtgttaaagtttaaatgacagactcaaaaggcataattttttcaacagaatcttttcccaagttatatcacacattaaaaataaaaatagtcataattcctgataatatttttactagtttcaggtttttgtaaggagatatttatttttcccaagttatatcacacattaaaaataaaaatagtcataattcctgataatatttttactagtttcaggtttttgtagggagatatttatttacatattcttccaattctctcatcaacaattgaaaacctagatacgacttgcttttttgacttgacagagttgtatatatttctaaggaaacgtaagtgtatctttgtctaattaccatatgtaatgaacttgcaacaaatctagttaaaatccaaaagatgatctatcagagctattgtgttacttctaatgggtattattgaaatagatgtagaaggcataattgctttataactgctttgtgtactgtcttacaatattccatgtaatttaagactactgtttgttctctttctagtgataaaaagttgattgcagaaggacctggggaaacagtattggttgcagaagaagaggctgctcgagtggcccttagaaaactttatggattcacagaaaatagacggccgtggaactattccaagcccaaagaaaccttgagagcagaaaagagcatcactgccagctagccgccatggatgcagcagcctgaaacttgagagcgaaagtgagataaatgtcaaaggtgtttcaagccagacattttcacaattgtgaagaaatagatgttttgtttctgttttttactgtgttcccaaaattaaataagtgttaaccaagtcacagtgtttttggttttgtttttctgaaatcttggtttgatcaaatctttttttttttctcttgagatggagtcttactctgtcgcccaggctggactgcagtggtgcgatctcggctcactgcaacctccacctcacaggttcaagcgattctcgtggctcagcctccctagtagctgggattacaggcacacaccaccatacctggctaatttttgtatttttggtagacatggggtttcaccaagttggctaggctagtcttgaactcctgacctcaggtgatccacccgccttggcctcccaaagtgctgggattacaggtgtgagccactatacccgaccagatcaaatctttttttgacatttttgcaaaaaaattttcctaatgttcttgatttaattgtatagaatttgtataattaggtgtattttatttgcgtctagctttgaggtatcataatttatgtatcttatgtgaattttttgctgtaataccaataaagttttttttctccacatgttaacattgcattttaatttgatatacccagtaatggcaggaggttgatgaacttcgcttctgtaatacaattttaactaaaatagtaatgttaaaactctttgggaaatgcatagtacagattataagtaggcagctatttacatgatccctaaattctaagtttaaaattatgtatacttctagtatgtttcttattcaatttctattataaatagcaggaaaaggcaaatttatgcttttcagaaattgccttttctaagaagttgaaactcaaaaacagcttaaaatgttaatggtgaagggaaaataaagccagtattagttcaatttagtattctagtcataataatagtatgtaccaagcagtgttgtaagtattggaacacatttaattcagtagagaggttttggttttctaatcctttgtggtcagttcaataatcccctaactgcaaattccttttgatttatcatttgttaaaaactttggcaacagtaatttttagtttgagtcttccattagtcactcccaggggttaacaagaatagcaggacctacgagttgagaatagaaaagaggtaaaatgttaaaaccaacagtacatttgccatgaatttatttatttattagacagagtctcgctctgttgcccaagctggagtgcagtggcgcgatctcagctcactgcaactttcgcctcctgagttcaagcgattctcctgcctcagccttccgagtagctgggactataggtgcgtgctaccacacccagctaattttttttgtattttagtagagacggggtttcaccatgttggccagggcggtctcaatctcctgacctcgtgatccatccacctcggcctcccaaagtgctgggattacaggcgtgagccactgtgcccggcctgacatttttttataaagaaagatgaaggaactttgaaatgcctttcctgagcctggctaggaaagtggaacttgagttatcttacagggtttatagctcccaaaggtaaagcagagactttttggaggggaaaatttgaaaaattaactagttgactgaattggcaggttaaaagtgagttaaagttgaccctcgaacaacgtgggttcgaattgtgcagatcagtatatatatgcagattttcttctgcttctgccaacgtgagacagcaagaccatcccccttttcctcctcctctttagcctactcagcgtgaagacaaggatgaagacctttttgatcatccgtgtccacttaatgaatagtaaatatattttctttgatttctttaatatttttagctttgttgtaagaataaggtttataatctatataataaaatatgtgttaattgattatttattaatatatcatcagtaaggcttccagtcagccataggttattaggagttaagtttttgggaagtttaaagttaatatacagatttactgctacatgaggggtcaacatccctaatccctgcattgttcaagggtcaactatattttacctttttttcagagttaacttcaactcctagtaatggaacacaaggatagaggaccaaaaccagtggtaaaatgccatttatatgtgttactcacaagtaaacatgatttgataagcatctcattggcactgtaggagaaaagagattatatgacaaacttttctggaaagcaaaagacatgtcttctgaccacttatccagcatctgtgagatggcagaatctagctgtggtatgattctaattttttttaaggtaaacattaagaaagtctagggaattcatttgcaaacccagtaatccttttcttccccctccccgccccccccccccccccgctaaatagtgctgattgtgcgttcccaaatttctcctgctcaggggagtttgcaggaccttaccctgcaagcttagaggggaactatccttttaggttttcaaacttttaaactttgaatgcttccaaatttacatgtgggacaagtctggctctagttcataaaactactttgcaagtagagatccatatgccttatgtagaatgtaatttcaacatatttctaagtaaagccttctttgaacttaaattgttgtactttttaaaagcaccctctaaaatagggtagaaatgtagaaaatttagaaaaattgacatacattttcaattgcatatcaaatatagcttgaaatttggaaccagtctctgagtagctatttgtcctatgagcctaactgcataagtatgatatgtgggtagaaggaacatgtgggtacaagaatgtcatcaaatggtgcatgtgaccaagagcattcagtgaccatgtgaaggactagctctttgactaatgcctcgtccatgttgagaagacagtcataagactggaagcactgacatttgaatttaggttcacaccagaggaagacattagtcatttactttgaaattctgactttttccaccttttcccactctccagttccctgtgcccaaagtataattgtaccaaaaaaatcctctagccaaaaatgtaacattaatgtctacagacttaattacataacccctattcttttaaattcatactctttattatatgcatatgtataatgaggaatatttttctcaaagtgttgtatgtggtcacaagaaagtaaactggaaactaacactaaactccaagtaagaatggaacaaattggagctttttgtgttcagagctgtactgattttggccacaagatggtgctgtaatcctattgcacaatttagtatgtgaattggccattatggggaacctattttctaccgatacaggaaagattatgtctatatggcacaggattaccatgaaatatgacttttcaaggcccctttcggctctaatattccatgaatacttcttcaggagccagctcaccttgttcttccctcgcctttggatgttacaagaatttgatgtatgaacaattcacctgagatgtgaaggtatggatttttgagctcttttctattcaccggaaagaaggaagagtgcagggctgccatagataaaacttttagaagacctttttgcaggcctcttcttggtgtttctttcttcctacttccttttgttgataggagaagatgcactgcggaggcaagggaatcctgtgtccatcgggacagttcctgaagccagacgtagacagtcttcccatcagggtggccagctcacagcagccctcagcagaggggtatgcactgaggatgctcagctgccagcatgctgcccacgttcttcatcctaagcccactttgtttttcttcccctcagttcatccctgttccatttcccccagccttagtttgcaaagtccctcaactattgtcctctgggacctagagtctcttaactttggttgagtatcagagcacttacttgaaagccatggttctctctgtataataccaagaatgattgctagatctaatcccatcatgcaaactaataacaatttttcctggaacttatacaatcaaaaatcacaatcacacatgctcctgaaaaaagaaagctgttttggcattggtggtctttgtgctttccatgactatttgttgttcatttatctgcctgcctattagtgtttactaatacagaagactaatggtttaagaaaactttctgggagaaaaacaattgggaaagttgaaaacattaacttattccttcttcaattgaggaagaacgacattatttgattattcagaggagttcaaggagtatcttttcacctgagctgttgtgtattaaaattgcaaatgaaggcctggcatggagacttatgcttgtaatctcagcactttgggaggccaaggtaagaggattgcttgagctcaggagtgagaccagctgtgatgcatagcaagaccctgtccctattttatttttcaaatttcaaatgaactcagtttgttctattctgatcctcttttttgcagaagacatgagtaaagaggtcattgacagagaaggatatttccgagaggggaagagtttgactttctgacaatgtttcctgtacataaactattgatgtcagcatcttcacatgaagacatatcagtaagggccaggagacgtttagcaatagacttacacagttaataagacaaatctagtaaaaaaaaaaaaaaaaaatcagctgagcgtcatcagatgaactgacttgacagtgatgttcatgaggctcctggcagtccgccaccaggactcaattcttggtcctgggatttttttattgttttttgtctaggaaggataggcatggaggcccgccattcttcactttacctttggcaagagattataaacttcagatgaagggggtatagcactaagaaatttaaaatttcattttcattttgccacctaataatttttttttttttttaagagatagggtctcagtaggttgcccaggctggtctcaaacccttgggcctcccaaagtattgggattataggagtgagccactgcaccaggcccctaataataatgttatctgcaaacattaacaatgtacttggtgtgaagaacggtgatttcttatcttgcaaatttctcatttaaatcacaccatctctatttttatcttcaagattcaagagagggtcaaggtgggatcataaacttagatgaaggaggtatggcaccaagaaatcaaaaatttcacttccattttgctacctaataataattttatctgaaaacactaacaatgcatttggtgtgatgaagaacagctatttctcattttgcaaatttctcatttaaatcacatctctctttttcttcaagatttaagagatggtcgaaggcacagtttgggaatccccagagaaatggagctttaaagccagtagtgtcttccactcttgggcctcccaaagccgactctcagtaggcaaatgacacagtgtctttcaacattcacaggaggtcaaggacatagaagtcacttcccagcttaccgagctctcacctctctcccagctgtcaccactgatcactcttaggaagtgggcaattgctactctgctggcccaggggaaacgcctgcatccctgctctttcgtacccgccctgcatgtgaatctcatgtattattcagtttttcattttcagaaaacagcactcccggtacaaaggccactcccttgggcctctttgtaaacttctgttgtgattgggattttcttttgcttcaaaatttcctgtcacctctcctttttaggacagagtgaaaggccagctaagtcagagctttcagtgtatttgggtcggtacctactctcttcctccacagtgaccaaggcagaatcggaagtacccatctcatgacctgtcaaaagagtgactacactgatggtttgtctcagttttaacaaacgtctatcattttgttactttaggaaaactgcagcctctctcttgttcaaactcagtgtgacatctaatctataagatacattatttgctcaaacatgtccatatactggggctggaggactgcctgaggccaggaatttgagagtagcctgggtaacacagcaaagacccccatctctacaaaaaaattttttaaaaaaaattagccaggtgtggtggtacgtgcctataagtcctagctattcgggaggctgaggcagaagggctgcttgagcccaggagttcaaggctgcagtgagccatgatcataccactgcattacagcctgggcaactgagagaccttggagtgatggtatgacttaaatgagaaatttgcaaaatgagaaatcaccattctgcatcacaccaaatacattgttaatgtttgcagataacattatgattagaggcctggtgcagtggctcactcctataatccctatattttgggaggtccaagggtttgagaccagcctgggcaacctaggcaacatactgagaccctatctctaaaaaaaaaaaaaaaaaattattaggtgtcaaaatggaaatggaattttaaatttctcaaaaaaagttttaggaaaaaaaaaacatgtctacacagcaaaaatgatctatcacaggcctgtaatttttgtggcagtctctaagtctaaatttatttcaatttccctcagggaaaggaggttccataaatttgatcattttgaagtaagacaaggcctacagatcattgacttaaagatatcaaaatgtagtccgggcgcggtagctcaagcctgtcatcccagcactttgggaggccgaggcagggggatcacctgaggtcaggagttcgagaccaatctggccaacatggtgaaaccctgtctctattaaaaatacaaaaattagccaggcgcagtggtgcgtgcctgtactcccagctactggggaggctgaggcagaagaattgcttgaacccaggaagcagaggttgcagtgagtcgagatcacgccactgcactccagcctgggtgacagagcaagactctgtctcaaaaaagaaaaaaaaaaaaagtacacatacatagttgggaacagcaaggctcagcccacttgacaaataataattccaaatggcaaactgatggagtgccgaatgtgaggttttaatgtatagtttaaggcaagtagaactcaagggctaaaaataaaaaaatgtttttaagttttgataaatgttttaaacttaaattctgatttagcttagactgcataaatctttaagaaattagttttttaaaaagcaggcaaatggtaaaatcagaattatgatatttgtaagctgaatgccagtggctcatgcctgtaatcccagcactttgtggggctgaggcaggtggatcacttgaggtcaggagttcaagactagcctaggcaagatggcgaggcatgtctctgtaaaaagaaaaaggaaaaaaagaattatgatgtttgagttcaacttggaaagttaccttgaaaaaaacaaaaaaaaaacaaaaaacaaacaaaaaaaccctgtcatttcaaaaacactcctgcctatcatcaccaaaaacgaaacagttcctgttcccccaggagttccaaaatacatggtacccagcaacttcattcggcacttgctacaaaatccgtttctttgctgagaattcttagccattgctggagtgaatgtagctaagagtagaactaggattactgtaatagttactctgttgaagtgatctagaaaatgagatgtgttgaagcggggaagtgtttgattgtcaggtctagaggaaaagaataggaaaagtctccgagctttgaatttcctgatgtttacatagtacaaaggtttattagaagaggctgacgaatgtctaaaaggctcagtttcttctattgtattttcaaatagcagagaaatagctttatttttactactcataacagtttatttttactttgtacaaaatacaaaaatgcaaatccaaggagtacagaccagtagtgacaggcacactgcacaacagcaaccttgtctagcaagacaggagttttttaaattttattttagtgaatacatgcattatataaaacaacaacaacaacaacaacaaaaacacaaagaggctagagatttcaccgtttctaccaccaaaataacgcttgctatcaagactttggagggggatgggggaaaagaatttaaaaggcaaataatttttttttcataaaaagtaaaagctaccataaaacatttttttttctgtcacactgattaaatttcttctgaaaagccgcacatatagacaaaacaaaacaaaaattcctgaactggacaaacagcaaatactcaacagggttgttaacctaggtaacagttcagtagtttaaagaatcttttagacatctggaagcctttctattcattcctcagtacagtgttccagccatcctgcttgttttttccctccaatacctcccagaacagaaacacttgcatcgagtctgttcctaagaactagttttgaaaaagaagcgatgtacaaaaatatttaacagaactatgaaagatgcaggaaaggagtctttcttcgtagcaaagtagtcgttgctttgcatggtttcttttgtatactcttcagggtttgtttatctgccccatgaataacacagcacctacagaattaaaagaaaacaatgcatgactctgtaaattaataatccttaaaataagatggaaggtattctatttaagggaagggaaacaatcatgtttgacctcttgctcagtagtgtccagtataactttctgcagtggtagagatggtctatatctttgttgtctagcatggtagccactagtcacatgtggccagagagtgcttaaaatgtggctagtgtgacttagaagttgaattttaattttattttttatttcttgagacagagtcttgcactgtcacccaggctggagtacaatggcgccatctcggctcactgcaatttccgcctcctgggttcaagcaattctcctgcctcagcctcccaagtagctgggattacaggcacccaccaccactgccagccaattttttgtatttctaacagagatggggttttgccatgttggccaggctggtctcgaactcctgacctcaggtgatccacccgccttggcctcccaaagtgctgggattacaggcataagccaccgcacccaaccagaaattgaatttttaaagttaatgttaaatagccacatgtggccagaagctcctcattggctggctcagttctggggcatgccaattagaacatcacagatgcaatgagataagagaataaggaactatctcatattactgattaaataaaatagtaaaagctaaaatatattagtgcctactcttgtaccaacaagaagccaacctctctacaaagatgaacttatacttcataattgtaataagcagtcagcactactgttgtcctcattttaaagatgaggcttaaggccagagccaagtttgaaccatgactcacagagcaaaaatctactgtattaacaattcccaaggtataacaatagagtgggcttacaaagtggtatggtttggctctgtgtctccactcaaatcttgcctcgaattgttaataatccccatatatcaagggcaggaccaggtggagaaaactgaatcataggagcagtttcccccatactgttcttgtgatagtgagtgagttctcatgagatctgatggttttataaggggtttcccacttcactcggctctcattctctcccctgctgccctgtgaagtgatgccttccaccgtaattgtgaggttcctgaggcttccctagccatgtgaaactgtgagtcaattaaacctctttttccttgtaaattacccactctagggtatttcttcatagcagggtgagaacagactaatacacaaaagttgaagttatatagcttctagcaaaattgaaccaccacatttatataaatatggaaaagtcaatagatgtcaaaagtgttccaaagggatgctgagcctctctgttaaaaacaacaatccgcaaaacctaaaatcctgtcagtgtgtaaaagattccatcacatctgtaaacacagcctttattttcctatctctttaacatgggtggttatattattcaaagtgtctgcaactattgacattagggaaatggactatgggcaccactgttggatataatgaagagtgcaatataccttttgaaattctaacagagagggcatgatggaagaggagagtcacttacctgtaggattatgtcggatgaaaaacagaaaaggtctgtctactataaaccagggaggcgatgatcttgcaatgagaattgcagctacgggaagaaaaggaaaatgtgttgtgcacattacatgagaccatgtaagcataaggccagcaagttagctagcttcatggaccctcagaggctggtgtctgaagacacacttcatgcttgttccataggctggccatgttacaacaggctcaatggtcaccatttactaagcctaccttgggccaggccctttacattactctctcatgtcttctacacaagcaccatctctgataaacatacttactcctcatagagttttgatgagaattaaatgacataattaaatgacataagatatattatagctcttagaacagtgtttgccactaaacacatctaatgcatatttattgttattagctattttttattcacaccatctgctttgctgataaagcccccagtccttttttttggggatggagtctcactctgtcacccaggctggagtgcagtggcgcgatcttggctcactgcaacctttgcctcccgggttcaagcgattctcctgcctcagcctcctgagtagctgggattacaggcatgcaccaccacgcctggctaatttttgtatttttagagacagggtttcactatgttggtcacgctggttttgaactcctgacctcaagtgatccacctgcctcagcctcccaaagtgcgggcattacaggcatgagccaccgcgcccgacccctggtcctgtttagcttctctaaatcttttctgtatataaaggcccagtccaattcttagcttttgtgtctgtgccttctcctttggcacattatttaggtttcctctgcactggaatgtagaccactcatccgggacctactaccttatactgctgttccactcaccaggtgtaggcatctgacttggaaagcaaacttctttagcctcatgggtcttggccattcctcgtctgccaggcttgtttccatttaataagcctgaaccagggcctcacgggagggtaggtgtgtggcattactaccacatgcctgttgcaatagctcagtcctcttgctcaaaccccatgaagtattgaacacttgggcttgatgttataaaggaaacagctgcagttatgctggggcaagcccttttacccagggttattaaaaacaaatattaaatagcaggtgttatggactgaaatgtgtctccccccaaattcatatgctgaagccccaaacccctaacgtaactgtatttggagataatgcctttgaggaggtaatgaaggttaagtagggttctattctaataggaccgttgcccttatttgaagtgggagagacaccagggatgtgtcacatggagaaaagaccatgtgaggacacagggagggggcgacctccggagatccagagatctcaggagaaacaaacctgccaacaccaacaccttgatcttgaactcgcagcctccagaagtgtgagttctgttgtttaaaccactcagtcaacggtattttgtcatggcagcccaggcggactaagacaggaggacctgggcggttacatggggccctgcactgggtttaatactctgctgttgctatcttgaaattcttatacattttgaacaaggggctccatattttcatttggcacaggaccccacaaactatgtagctggtcctgatagttacactcagcaaaactggtcaataacttttagatgttacttaaaattacctagaaaagacaaaaagcatcttaaaatttccaaccctcttatttcagggtctttgttttaaatgcttctttaaaggaatttttaaaacgtttattcgagaaaggcaataacacatctattgtgagtataactggtatgtttcaatgaccagagatatttgacccagctgcaagtgtagctaagattttcactttatgggctcacagagttggccaaatctattcatctattttcctacggataatgaggggtgaaaaaactgacttacgattgttctgttttctccttcattatgtaaaccactgaggaggaagcagatgtggatgttctaattatcaaggaaggctgtacagcaatcctgccgcaattcaacagatgctggcgaattcttcggtttatcctggatagacctgattgcctattttcctttaagtacttgttgtttattttatgttcaaatctgaagattggtcttttttgccagtaagaagccagaacatgttttatcctcctgagagcaggggtcagcaaactattttcctcaaggcaagtctaccaggacaaatcctgtttttataaataaagttttattggaacacagccacatctgtttacttgtattgttgattgctgttttcatgctacagtgaaagagctaagaagctgtaatggagatggtatgacacacaaatctgaaatacatactacctggctctttatagaagtttgctgactcctgtcctagaggaatttctctcactgaaatgcttttctttaatgaaacagattctgagctttgtggttacaggtcttcagtctgtctgtactcactgctgtctcctgagggttaacccacacacactgcctggctggaaagagggtgcattacatatttgctcaaccaatgagtatacaggaatgtgtttgctcccctgctagaggaagccctgccacgtgacccagtgcttacttgttgctgctgaagctttggttccatcttcactgacttcaatttttgctttttgcaagatatgagaaacatggaggttttctgaccctgcttccagaaaataaaacagtatcagcatttgtttgataggcaggccattggttggttggggaagtaacctcaaagctcaaagccatggcaaattccaatttttaaagtgtcagaagacatgacctctgacagtcctggtgttgaaggctgcagacagctgttacttgtgaatttcagtccctgctaagtgaactgtgatactcacttctggagaagggcccaggccctcaaatgatttagtgcctctatcaattcaattctgatcactagaattgttttttaaaaatgaaaagagcagagctttaaaaaggaagcccggttttctggaagcagcaaggcaacaagattatttttcagttacagaatgcagatgcagaagggatttcagacagcatttacagatggggaaactgaggcctagaacgttaagtaatgttccctgcaatcatacggctagttagtggcagagtaagtcctggctcttcacaacagccactcatctcatgggcatgctagtaagagaagagtgtcgaacaagagaagagtttagattttcctggaagggccgatgtgtaaatgcagttgtgcctcagggacattctggtgaactcactttacttctcagcaaattctgaccattccagcaacacccactgggtgtagctttcacagagaatgaaaaacttaagttgatattagtctggatgggacataggtctggatgcaaagggaaaatgtgctttttgtgtcatctgcttgtgaactatctgcaccaatgcccagctctaatatgaccaaattgtgactgagatgcacatttatagggcccaagtcacatgcagtgttaaagaggactttccaggagaatctggggcacctggttcttcctgtgaacaccccccatttagtatttcagctaccatgaacaaccttgaagggaaaagtgcagatgaaaatggtgcttctcagtctttgctgggctgagggactgtgttaaaatggattctggttcagtgggtctgggttacacccaagattgtgcatttcaaacaagctcctgggtgatgctaatgctgctgggctggaggcctgagtttgagtcatgagggatgaacggctatcagaatatccatggagctgcaggttcaccaggggagtcatgtttgtccccagaacaggtactaggtgtttactagcatgcaactgaagctggtaatgagctaatttcttaccactcaaagttatttgcaaactggagtgcaaataatgttcaagccatggcttttccttggaaagattgctatgttctaaatttaaagaacaaaggactgaccattcaaacataactctagaaaaaggtacatatactgctggcaaatgaaaagcatgccttaattgctttggcaaaggaaagttttaatcagattcatttgaatttatatcgtttcatattaatgagcatgaaatgccaaaatacatatctgggtacagtgaatgactgcagtcttgactttttttcaagcaaaaggaaaaagttggcatttgaaaacagagcgacaacacctaagtcagagccaatattcataaaagcaatacatgaaatactcctttaggtagtcactggggcttcccatgaaatgtacgtgcaaaatgtggggacgctgatttaaatgaaggtcaagagcaatgactagataaagaaaatgaggtatgtacacatcatggaatactactcagtcataaaaagaatgaaataatatcttttgcagcaacttgaatggagctggaggccattattctaaatgaagtaactcaagaatggaaaaccaaatactgtatgttctcgcttgtaagtgggagataagctacgggtatgcaaaggcatacggagtggtataatggattatggagactcagaaggaggagggtgggttggtgaggagctaaaaatctattaatacatattgagtacaacgtatactactcgggggaggggtgtactaaaatctcagacttcatcgctatataaactgatccatgtaaccaaaaaccacttgtatcccaaaaactattgaaataaaaagataaaaggaaaaaataaataaatgaaggtcaataaataaacgaaggccaatagcataatttggcaatgtatcaaatgaaaccttgtacagtttcagggcaacacattcctaattctgatcctttttctctgcacaaatcagtctcagtttgtaacactttcttcaagtatacaaatacattttaaattgaacatacttgttatttttgcaaaatttgcctttgatgaatcaaacatgtcagtaatgccaagaactttcagcggctccttcaaatctgtttgtgctacagctgtgaacctagcatgaaagcagaaatggagaaaaaaaatcacgaggctataaatgctacatgatagagtcggtgcatgtttacaaactgattcttttaaagttaatatctgaataccgatctgaattgcatcttaaatttgaattccaaatttaaataccagataagtaaaggacaactcctctctcaaacacttagctggcaaaatgagtcatatgtactaacggcaagaataggcgctcccaccctcaggtgtaatgggccccctgttccaatacttaggaagatctacaaacatactttcttttatactgacgtggaggttgagtgttaacaagttcctagtactctggaatatctattattcttccccatatccaactaaagttctccatatccatcttggctgctctaagacctgccatccttattgggattggagatggtcaaaagagaggagaaacattcctgatagttcattttgggattcttttttttgagacagagtcttgctctgtggcccaggccagaggacaatggtgcaatcttggctcactgcaacctctgcctcctgggttcaagcaattctcccgcctcagcctcccaagtagttgggattacaagcacccacgaccatgcctggctaattttttatatttttagtagagacggggtttttccatgttggccaggctagtctggaactcctgacctcgtgatccgcccacctcggcctcccaaagtgttgggattacaggtgtgagccaccacgcccagccccttttgagattctgaaagtattttactattaaaacaggagcaaagattaggcataggtgacacggtattatatttgggtataatataggtttcttgaatatttgtgacctacttggccttggggatatatggagatatatgcacacacacacacacacacacacgtatatatatgtgtgtatatgtgtgtgtgtgtgtgtgtgtgtgtgtgtaaatgtcagttactgtcatcagaggatgctttatcagatttgatctcatcctgtggaagagcactaaggagacgtgggcagattctcaccacagatgggctataatggtaaagaacctgttcttcacccattgaggcctacgatgccaccatcttatttatttatttatatcaagcattgcctacttgaaggcttattttacaaaaaaaaaaaatcttgagagaattagtaatacttattgtgaatgtcttactctgattacttaactcggtgaccaaagaatcaaaagctattagaactctccactaccaccaagacctgggttgttaaaagctctggatggtgggaaggcagcaatgttgaaaagttcatagaaagggaacaacattcattgcttcttcacagttctggacaaagcattctctgacctgttagaacatgaagattcatacaggatttggggttacttttcccatggcttcaagtcataacagctcaaattccatctttgtcttactcttagggtataatagaaaaactggctgccttggtcttcatgaacttctagttaaataaataaataactaaaatgaagctccttatgaaagcacatggagttctattaaacctcactgtactttcatccatactatgatgacacacgtgtgttttcagtcttttaaatacaatgagatatgtcaaaaagcccctgcagtaccatgaactgcttatgctcatgtggaggtttagagaccaaggttgccctctctcctttcttatgatccatatcttaccatacaggaagcacaggcattgaataaaagcgtttagaaaagcacggcctcgtaatcccaccatgaaatttctgcagaacagaacaggcttcatgatgtgccatattttcgcctcatgttgtctggtgtccgacataacacctgctgattgaataatgccactgttttctttgaggggaaggggccacttacttgggcaggatcacctgcaccctcttgggcaccatgatgctcatccagctgtctatggtcttggtgctgatgtgtgggatgatggcagacagcggagtggagctctcagtcggcagtgcaatcagcatgctgatgctttccccgtggtagggcagttcaatgaagttgtaccataaatcattgggggcacttgtcgaccctaaagaaatcagaagcaggttcagtgtatccttgttgacttctagaagcaggatgagtgcttgctggtcaccgggatagcttcagagagcaactcagttggagaacttcccttttccacaaatagcttccttagaaggacaaagacaaggacaattatttcttccttccccagtgaagaattctcctttcttcagtctagacagaatgcctttgggaatcactgaaatcactttaattctgttaaggagaatttaactaaatcacaaagtgcttaaaattcagtgctttgcaagaagttgaccctcacatgaataaaagaatacattcaagctgccttagaatcattccttttttttttttttttaaataaagtgtattgtgtatattaaggtacacaatatgacgttatgggatacatatagatagtaaaatagttactatgaaaaagcaaattaacatatccattatctcacataattacccattttgctgtttttgggacaagagcggctaaaatttactcattgagcaggaatcccaacatggtgcaattttattacctctagtcctcattttggataagcctacatgtgcaggtgaagagagacagggatacagagcatccacagggctcactctgtgccaggcccatatcaacccttcaacaggctgaggatctacagcacctcacggggtaggcgtaagcagtgctattttgcagttgagaaagccacctttagagaaatgaagtaacctccaaaggatgcacggctaagaagtgaggagccaggagagtctaatgccaaggattgtcttcctcctacttcaccaccctgccctattcactcttcacccattccagtaatcaccactggagttttagatactttatggtacttctacttactaatgaaaacccaagaataatttaagccagcatttctcaaatgttatttggagaacagtctacctgcaagatgctctatagacaaaacagattccacatcttagggagttcagcaaacaagaagagagaaagcaagtttcttgcacgattttcactgatcttttctttggagatgacatgtgccaatcactgcctttgagacagggaacttcaatatgccagttctccatagaacagggttgggagggatggacagagggagagatgaagagaaagataccaagagagggaaagagagtgtacttgatgaacactgaaatatcataaaaatactgaggttattagaatatatggcaccacaggatgacactacagtttttccctaaggaagaaacaacatagagaactggcagaggaactggggctctcctggtcctagcacactgcatttcctgcagggctgttcagtaacccgggtgcagctcgcctcagctcccatgtgtgttgaactctcacccaagcctggcttctgtcttgcggcaacctaagaatgaaagagaggattcttcgtctttactcttagcctgcataacaaaatggtctcagcagaaacggaaaaatcaatgggaaagtgagaaaaaaatcacttcctaatgagctctttaatccttgaagaaaacattaaatctctattctggcggagctaattttcagaaactgtgaaatatgggaagtggttaataagtgattgctccagggcatgaaataaggacctggaggtgttaactgcttctagaaatgtttactatttctgttaaggaggattgaagtaatgaataatgaaaagttatgagctggaatgtgttcaagggaggagagagatcatctagcttcaccagttaatccatccttggctggacccattattaactgatcagtaatattaataaccatgaaccgcatccagtcacctctgcttgatgactgatttccccccactccttctgcttctgaccacagaagctgatgaccagtggtagccagggtgcatcagacatacgcatgcttacctttatttggtgccttgaggagctgggagataaaataacaccttttctgtctttctacctggtcactcaagtactgcatccttttatagaggacacgtgccaaagccacgagatctggggttataagacctgtattcaaatcctgcacttgtagcacactagctctgagactttggcaagttccttgactccaagtcttagtttctttatctgtaaaagcctacaataatagcacctactttacagagctatgaaaattcattgagacaacacatacaaagtgctcagcataagctggcccatagcaaaaactgccgtcttttgatgtaagaagctttgtaaaatacctcacttcttgcaatgtgaggtccctgctcacagtctaaacacaaaatcggcccacccaggtaaactacatggaatattacgtagctgataaaagcacaactcccaagcagaatgaatcaagtaaggaaggggacttgggagccttgtgtcagagcatggagcctctcatcgtcccagagcttttccctttaaaatcccctacccgatgctctctattctttaacctctggaaggcagactgagtattctttaacaagggtcatttctgcagtgtataaaaacgtaagtataataggttgattcattctgaaaaggagcggaggtgaaaaagagaaaataaggattttctcttagatgaatggtggtcaacaaaacttctaatgggagacaataagtgaagaatcaagcattaaaaatgtggaggagatttagaactttctctaagtggtgttttgggtgacccagtttttccagaaagcccctgaagtaatctgatttccactttaagtgctactagggaagacgtaactaggctcactgaaatgttaagagctcacactgtaaaatcaaagagggtatcttaaatatttaatatcaggaaacctttatagatgaaagtccctctaattaccttctactacaagtaaatatggatttcctgaggacttaagaaactttttagactgcactttagtagaaattgaaatggatattttggaaaaacaacagcaaaatgctccatcgtgtgcaatactctacattctaggctggagtccaaagggagttcggggacagtagctggggaaggaggggtggcgtaagtaactgggtgagtattggtgccatttgctgctaaggaacgatgggttgagaactaaatgggcaagggcaatacatatatttatttactgagacagggtcttgctctgttccccaggctggaaagcagtgatgtgatcagggctcactgcatctcaacatcctgggctcaagtgaacccccgacctcagactcccaaacagctgggaccacaggtgagcaccaccatgcctggctaatttttaaacatttttttgtagagacagggtctcgctatgttgccgaggatcatcttgaactcccaggctcaagccatcctcctgcctcagcttcccaaagtgctggaattacaggtgtgtgccatggtgccttggcataaatgagtttcatctatgcaactagaatttagtaggcaaccaagttaagacgtaatgtgaacagacaggtatgagttagaaactcaggagaaaagaagatggaaatataaatttgttattcttcatgttttttttccaaaataaagtctcaaatgtctaaattcataaccataaaacatttgtaacaactatgacttggagattcctattccattcctattcctatcccaggaaattacctttagaaatttactgatgcaaatattgaaaaacctatgtacaagaatactcactgcagtgttgttataggaaaaaagcagatggctttccataggatagcatgatacatttgtattatggaatattatgtggctgataaaaggatcaagtaaatccttatgaattggcacaaaaagttgtccactctctaatgaaagcagattatagaacagaaactacagtacaatcctatgtatgtaaaaagtttcatagacatattttacatatacctagaaaggttctcaaatgacaaacttgatacttaatagggaattttatcctaggaaataggattttaggggaacttttggtttctgccatatatattgtacatggaggtatactgaggattttgcaatgagcatgaaatataaatctactaaaaatgattttaaggcttctctttttcttaatagaaaagtttctacccttgaagtacttctactttatggggcataaatcagaagggttttcttctcttctagttttcactctctttttgttatcaagcaaatattctcagagctcttaatgatatcttggggaaaacagtcaagaaggcagataaactgaatgacaatgttttggcaaagtgacccagaatagtgaggcgtggctgaggcccaggaagcatccgacaggtggcaccctgggccctgtgagtttggacacagcagctcgagctgggccactcctgcaggtcagagtgaggaaacaggcagaaaatgacggacagtctgtggaaatggaaacaatcagccacttggggacaccacaaatggcggtactttcttcacagccctgtcaagacaatccttccctatcttatcatgataagctgggttttggccaaggcaagaaaacagggaacttatgacactctcatgccctgctgcatggcccagaacagagtcgcatccagttccaggttcctcagtgaaacctgatgacaggcatggaaaggagggtgagaagggtgagctaagctgttcgccgtgtttacttgtgagggaatgagaacaggagtgagcagcggactttctttttctggtccgaattaggtacagatcagtcagggtggagagtaaacagataagacatcaaattgggccatttaagcagaatttgatgaaggaccagttgtaaagcatagacaggatacagagaaacatgatggacagtaccctggacaagaaacggtgggcaccatggctagccttgggctgggagggaggaagagaggggtggtgacccagagagaaagagctcttgggcacaccccctggcagaagctgaaacctttggtagaggaatgcagctggcccatgactctgtaagggggggcttgggaagttagtaccctgacccctttctcctctgtccttcctatcgcctgcagactcccagcagcaaacccagcaagaagagagagggcaagggggcccagagcagggtggaagcgggtaaagaagagaggcatgaatcggggaaagtggagggaagataccaacacactgtgggggttctgtagggtttaaatctttgacaataagaatgtatttgtgcattattttctataaaacacacatgtatattcctaggcaaatcagtttccaaatgaaaagctaccctgacatgtaactctctgggaatagcctgtttactcaagaaattcatgttatatttctgtaaaaacaaacattttaaaatcttccataggaatgttaatggaatccttgcattttaatcttgaactattaacttgttttttttttcagcaagagaaacatacagtaaatgagggccccctcactttttattttatttttttatggactataaagtgtgtacaaaagattgacctaaaataaaatcacttcattgaaacactaacacggccaccggctcatatcccaggcaaagtgattttagaagttcatttgagcctggtgcggtggctcatgcctgtaatcccagcagtttgagaggccaaggcaggtggatcacttaggcccaggagttcaagactagcctgggcaacgtggcaaaaccccatttgtacaaaaagtaaaaaaattagctggccgtggtggtgcatgcctgtgatcccagctacatgagaggctgaggtgggaggatagcttgagtccaagaggtcgaggctgcggtgagccatgtttgtgccactgtagtctagcctgggtaacacagtgagactctatctcgaaaaagttttttcaaattcagaaataatttttctgaaatcctaccattaatattttttactgaagatcctctgagacctatctctattgacgtgtgaatataaagaaaagaattttacataagcgagattgatatctgctgttttatatctcgttttctgaaatcaatcatatattgcataatctttccatttatataaatctaagtctcatgatcacatacgttccactgtatatttgtatttggcttctatttatttgtcattgtgtgcttatgttcacagtataaattccctggagcgggactgctggagccaggaccccgaggaagtcctcggaccacagatccctgccacgaacagtgcccaagggtcctgcttcctccccaccaaagccaccgaaggattttaccaatgtttttaatttttgctgatctgctaagtaaaaaaagaaatccaatttttaatttggtaatgtaagactgctaatgagttgctgtgtttaatgctcacttatactcatttcatgaattgtcctttcatctttaagttttcaaccaaaaagcctactacacacgccatgcattaatactttttgtacataacttatgcatatattatgcatattatgctatgcatggtaacttttgtacataacacagatttacatgagctttataaaaatcctgcctctcagcaccctgctctgttccccagttttttaaaagatgaaaagttagatttgctctggaattaagttaaagcactcaagggcctttctgccgccagcacatcctagaacaggcttcgctgagcatgaactcaccacaccggaacacggagagctgggccagcattggcacttgataggatttcccgtcggctgccacgaaagtgcgtttctttgtgttctcgggttggaaccgtgatttccacagacccttgaaatacactgcgttgacgaggaccagtctggtgagcacaccatcaataagatctggggacagcagattgtcaatcatatctgtgaagccaaagaacaaacaagggaaaaataacctcaggactggtggccggcttgagggcaaatggcagctgtcatcaggtagactgaaaaatcaaaggatttttaaggagtgttaaagagaatcttcttaaactacccttttgtactttctaggttcccctcccccactaaatattaaagttaaaaagaagttaaaagagaaacagaaaagactttagaaacccctagctaggggttacaaaacttttcatcaagaaattcttttattatcaattccctgcaagtccaggctttaaaaaaatcttactcatccaaataagctacatttgataatgaattatttcttcttcttcttttcttttttttgccaataaatgactgatagtaagggtttctggtcagtacaagataaacaattttgttttgttttgctccacttggtttaattcaatcccagtcaaaaataaacacttcagcctgtatgttattaagggtgaatgcttcatttctcttaagattttagaaacatcaaacattattttggaatctctgggtatcacaaggcctcctaactgcttaaagaagaaaggaaacaaaaaatcagtgtctttgtttatgggtcaggcatcaagcaaggtgctaatattagagacaacagaagagaggattttgaatgttcccaccataaagaaatgagaaacgtttgaggtaactgaaatgttaattactctaatttgatcattacacattgtatacatgtatcaaagcattaccactgtaccccatatatgtacaattattatgggtcaatgaaaaataaaataaagcccaggcacagtggcttatgtctgtaatcccagcactttgggaggccgaggaggaaggatcacttgaggctagaagtttgagaccagcctgggaaacatagctagaccccatctctagaaaaaataaaaattaaaaacatattagccagctgggtatggtggcatgcacctgtaatcccagctacttgggaggctgaggtgggagggtcgcccgagcccaggagttcgaggctgtgttgagctatgactgcaccactgcactccagcctgggtgacagaatgagaccctgtctctaaaaaaaataagataaaataaatctttaaaaagacagaaaaaattaaggtctgtcctagaactcctaattttgaaggaaaatgctctttacaagacgttgggaatggtccgtcttacttgtatcaggagtgaaggagtgaacacaattcttctcatttcaggatgcttccaaaatgctacccgtggctgaaagagccttccaaaatgctacctgtggctgaaggtttggtcttccagttagcttccttttattatacagttattatacagttagcttcacaattattctgaggtctttgaaggttcagttgtgtgtgtgtctgtatgtatgtgtgtttttaaatagggatcagtaatgcccaaagctattaaaacttagttcactgcattattagctcaaatatatgtgtgtgtgtgtgtgtgtgtgtgtgtgtatgtgtgtatgtgtataaatacataatataaatacaagttatactactttaaatggtgagagtaaaaccaacagcttttgaagaagcaagaatatctaattcaggggtgagagtattaagtccttttaaatgaaactcaagaggattctgatgtacagtaaacaagtgtttacataaatcatgataaataaacactgaagtttcccacagcgtgctgctaagacagttccatcaccactcactacttccacaagggggcactaacgccaccttaagtcaggacaaagaaggaaaatatctaagccataaacagacatcattcaactcaacacaaagctggctgcaaacagactgtcctgtgggagcgaagttagaactttatgccatcccactagcaagctcataattgacttcctaatagtgaatgttgtttcttgcctctgctgggaacattacccagttcaattcctacttgcctttaagacatagctcaatggtcccctggacttctaaatcttctctgatcatcctcgccacctcctaagagatgtctctgctcccgatttctgtaaagcccaatgcctggccccaccatgacacctgcagtattttattctagccaattttaatgtgtctgtctccctcagctacactgagacctgcatgagactctgccattcactttttgcttactcctagcactacatggagcatacaggcagtgctcaataactgtctgtagaaatgtccttagcccctttttacagagacaaataatgcctccaactgcccctgggaggactaagatataataaggggacatgaagaaataaaaagaaaatgcatagtttagaggcaaagaggcacatggaaacctgccatcagtaactgccacagacatgcatctatcatccgtccgtccatccatccatccatccttggatacctacctgcctaccatgtgcctggtactctcttaaataagaaaccaagaaggaaatctggtctcaaaaactacgaatgagagagaggtgcaggctgacataaaataacttggaaaagtatacagctgcaatttaaataaatatctggaagtggaattactcaaggctatggagggctaagaaggtgacctgacctagttggtgaggtctgagatggacagtacctcagaaatggctataaaaatagctcacactggttgaacatttactaagtgcagagtcctttgctaaatgctttctatgtattattcacatcctcacaccagccttaattgttgttagaattatttgaataggtatcactattacatctctccattttacagacgagaatgctgatgcaaagcaagcttaaataacttgcccaaggttatacaggtagtatgtggcagaaccgagattcaaactcagaatgtgtgcttttaatgttcatgcctgccactcatggtatggtacagaaatgagttggccttaaccagggaagagggagagaaggcagcaggagtgtatgtgtgcggttctccaacaggagacaggatggtgggtaaggggactaggaagaggcctgtgtggctggaacatagagtacaaggatgagtgagtctgcagaggtcaacaggccagacccatccctgatgggtctcctcctgcaaaaggcctgcgcgttgggctctcccactctctgtagggaaggaactatcatttccgtgagacagacccagcaaccttccagacacaaacagttgagctccaagtcacttctgagctctaccatgtggtcatgtacctttcagtgggggcagttcacccccaggtaaaggcagtttggaatttggcagggatgtttttaattgagtgggcagtggccagaaatgctatctgtcctgcaatgttcaaaacagtcccacccaatgaagaattgtgctgcttctcccgtggcttttcaataccccaccggatctctgcattggtaggacacctacttataattatctgagcccagaacctcgttctttttcgtgtgtaaacacagggtgttttgggttttttgtttttgtttttgtttttgtttttgcatccttttcatgtatgctgaatttgccaggaatgtgagtcccacgcaaatcaagcagagcctgtgctttgttttgttcagaaatttatcaaaagtcttgcaccgtttcagaaaaaattgcatcagcaatagttaacacagctcatgtttatgagtcaccaggacaacatgcctgtctctgtctgcttttgtagctgtcaattcacaattattctgagactctgactactttattacgtatttgagtgtagttgtacccaagggtttacctattgaactacatatatacatttcttttgttttcctttgtattacagtttggcactgtctcaaatttttaaaaatttgtgtgtgtgcatagagtaatatgatgtatgaatttcatttcagaatagtaaagagagtattaaaaatatttgttacaaacggaggagctggggctgacagggctgcaaagtgctgcaggagtctccatgcttcttcccagcacacgtgggggttttctccaggtgctctgaagactgtcacatggtctaactaatgtggtttaatattgccattctacagatcaaggcagcggctaagaggacaaaatgacatgtcacagtcacacagcctccagccacagagtcaggaccaagaaccagtcctgagggcgtctgcttctgaccactcttcacaagcctacagatgccagacacctggagactccactgaacaccctcatgtgtgctgacctcccgatggtttatggttttaggaagggcgcccagactgcatggtccaggccccactgagaagggacgccacgaatttacccaagtcacctggggtctcctccaccctccctggagccttctttgtccacctcttcactagttctgctaatgggtctccaacatctgggtgtgtaagaatggtgatgggaggcagaggcagactgggagttgccagccactccctcggcgattccaatgcagtgggctgggctccagggatctgccttctcaacacatagcccagataattctgatgcagggacaccagtaaccacacttttaagaaacatagcctgaaaggcgacagtttccctaggttttgtctttgggcttcttcttcctattgactctctcccttctatgaaaaaaggctctatagccaggcacaggggctcatgcctataatcccagcactctgggaggctgaggcgagaggactgcttgaacccaagagttcgagaccagcatgggcaacacagtgagaccccacctcttcaaaaaataaaaaaattagccaggcatggtggcgcacacctgtagttccagctaccggaaaggctgaggtgggaggattacttgagcccaggaggttgaggctgcagtgagctatgattgcaccactgcgctctagcctaagagacagagtgagaccctgtctccaaaaaattaaaaataaaaaaaaggtcccaaatctgtactcccatccttcacattctcctgttgttccagacctacagctcctcctgcatgtttccaactggacctccacgttacaaattaaggtttttttgtttttttgtttctttttgttgttgttgttttagacacagtctcattctgttgcccaggctggagtgcagggttgcaatctcggctcattgcaatctccccctcccaggttcaagcgattctcctgcctcagcctcccaagtagctgggattacaggtgcccgccagcatgtctggctaatttttgtatttttagtagagatgggataaaccatgttggccaggctggtctcgaactcctgacctcaggtgatccacccaccttggcctcccaaagtgctgggattacaggtgtgagccactgcacctggcctacaaattaagttttaaaacaccaacgttagactctcctttatttaatgggagaagagacacttacaaatgagtaatcattttgagatgtggaaagggctgtaatcgggggggtgtaaaagttgtaatcatgtgccaatcataacggacaacagggtacctatgtctttggcaatggcagaagcaagaggcatggaaggcaaagagatcaatcaacctggaaggatgaggaggacattccaggtaaagggagaggcagatgcaaaagcaggaaggaatgagcaagaaaaccttcaaaatcaacaagagcctgtgggcaaggatgctggagaccagatatggcaaggagaggagacagtggaggggctggattctgttctgttgcccaaactacaggagaaacacctcccaggagcacagtgagcaatggcagattgaaggggaaggagggagactgaatagagcttccttggtccaggagtttctcaacccacaggccattgaattggacttgcagacaccactttgaaccctggagtctaactcatgcttcattcacaaactatgcaatcaaatgacatactgcggccactcacccctggtttcatttttaacccatgcattgatggaatcacaggcagaggctggatcctcaaagttcacattccggacctcacactggaacacatctttgttccttgtaacaaaaggcacttcaatttcagaggcattcttaacaaacacggcgttagccactgtcacaatgtctttattcttcttggagacgatggccttgttgatcttctttaatattttaccaactcctaaaagagaaatcagaagatacagcaatacttccataagaatctagaaaagtttttaaaatcttttatgttgcagcaagtaagaacagtataggccaggtgcagtggctcacacctgtaatcccagcaatttgagaggctgaggtgggtggattgcttgagctcaggagtttaagaacaacctgggtaatatgacaaaaccctgtctctaccaaaaatacaaaattaactgggtgtggtggcacgcctgtgataccaactacttgaggaggctgaggtgggaggatcgctggagcctgggaagtcgaggctgcagtaagccatgatcgggcccctgcatacagcctgggtgactaagcaagaccctgtctcaaaaataaaaataacagaacagtataaacaggatagctatgagtagcaagaaactaagtcttctgttctctcaggggcctatttcttaagaaaaggagggagtggggttaaagtctaaccactgaagctctcaaaaatcaactgtgcttctgcatcaaaacaggaatattcaaggtgttctcaccaccttcccaatgcagacctcattctcatggtagcctttctgggcaccaggtcagtatgaatgctggcacagtcctcagttctatagccaagggggaacaaatcaaagggaacttcctaatgctttctctctttcttgtctaacgttattaagtgctacttcctttcttgccaaagatttaacaatgtaatttctttttttctattttggaaaaaaaatgaataaaataagcattagaaagactataaaaaattaccatgggccaccatccagaacaatgtggtttttacttggtaacaagctcaaagagtaaggagattaattttatggcaacgtaagctttattttacatgagccattcatacatgctccatttagtttgagagggtgaaaaagaggcaaataagttataaggatgaaatgtgtttctaaagagagctcaaattacagatccttcttcatcgcttggggtctcttcaaaatggcactgtcctaaaacatcctgccagagtcaccttgatggtcctctaaagagccgatttgtcactctgaatgtgcgtcctcttcaggccttttacacgggggaggggggcagtcttctcagggcccacaaacaggggcgtgtgtagggctttacaacgtgcatggccctctcttagatgcccatgaccacaccttacaattgttctatggtgcaggcccattctacaagtaagaaaacggccggctttggaggctgaaagacaattccaaggccaactgccagctcctggcccttttggggtaggggtgaggcagtggtggatggccaacgggccaatattcttagaacttcagaaataatggcttaaaatcagtgtggctcagcattaaaacaaacaacaaaagtccagttgctattttggaactgtctcggccgacacagcctggatcacactaggaaaggtcataaattttagcagtgatccaccatgaagttataaatcaccaggagttttctgaacttccaagcaaggggcagaagagtgtgttccaagtatttagtccttccatgcttccaacaggtgaacaaactgcaaactcgtacagaagtgtaatgctgcatcaacagagcagtgagattaggcatttggtgctggcagccctggaggccacgctgagcagagtcggaggcgggtgcagagcgaggcactgaaggacacaaatcgccacctcactgatcttactctccagctgacgacgccagtgcagtcaagattctcagaactttcgggccagcctgggtggaagaacacgggcaggaagactcccttgtttccaacgaagggagcagacctagatgtgaatgtgacttttgcaaggtcacagagggtgctggtggccaggaagagggggggagccagtcctgctcccctgagcactgcatttatggagacagcaggtgggacatggctctgggcaagacccctcagctgaagtaaaacagtgccagaggatgaagctcgtgcagttaaatgggtcatttaagaaaggtttttctttaactcaaactaaatctttttcattgggccttactttaaaacaatttttttagctcgctctctctctctacgtatctatctatctatctgtatcttttctttaagctctgggatacatgtgcagaacgtgtaggtttattacataggtacacatgtgtcgtggtggtttgctgcacccatcaacctgtcatctaggttttaagccccacatgcattaggtatctgtcctaatgctttccctccccttgccttccacccctcgacaggccccagtgtgtgatgttcccctccctgtgtccatgtgttctcattgttcaactcccacttttgagtgagaacatgccgtgtttggttttctgttcctgcgtttgctgagaatgatggtttccagcttcatccatgtccctgcaaggacatgaactcactcttttttatggctgcatagtattccatggtgtatatgtgccatattttctttatccagtctatcattgatggacattcgggttggttccaagtctttgcttagctttatattttgaaataattatagatttacaggaagtggcaaaacaatatgcaaggaagtcccacgtgcctttcacccagtcttcccagtggtaccgtcgttgcatcaggaaatttccatcaggtcagtccacagggtgcattcagatttcactcattttccatacactcctgttgtgggcttggggaggggggtctgtgcaactttatcatttgtgcagatttgtgtggccaccaccacaatcaagacccaggatggctccatcactacgaggcccctgggccctccacagccaccccttcccagctcctctcacaggcttcacaagcacatctacgatcacagcgcaactcaaccctgggcgccatggaggcggtaagccaggaagtgtccccctcgctggaacgagggctggagccctgggaaaggagacctagtggcagaccccaagctccaaaagtacaaaaaagggaccagagtctagttctcctaactgccagcaccacagtgtttgttctttagaagagactgaccccaagccccaagtggcaccagcaaatccccttctggctgctctgcttcttggggttgtcagcaaaaaccaagccataaaccctcctgtcacaagactctcaggcaaaggctccgccagtgagcaattgtgcacacgcaccatttacgccgtatctcatcaccatggcgagctgcttcttggtcctgccgtccgcccccagctgaagcatccccaggaccgacgcaatcccatggggagagatcacgatgttgtcatgaggcctcgacttcacaatctgattgaaaacctggatccccgtgttggagcctagttcctcgagagacagaggattgaagtgggagcagatggaaggcagcgtcacagaggccaagaggaagagggggagatgccagttcatggttccttccaccaaggacgacctggaaaagtaagttaaaaaatatttaaattatacttaaatgggtactttactactttttttttttttcccccagatagagactcgttctttcacccaggctggagtgaagtggtgccatctcagctcactgcaacctccgcctcctgggttcaagcaattctcctgcctcagccccctgagtagctggaattacaggcgtgtaccaccatacacggctaatttttgtatttttagtagagatgggatttcaccatgttggccaggctggtctcaaactcctgacctcaagtgatctgcctgactcagcctcccaaagtgctgggattacaggtgtgagccactgtacctggcctgcgaggccattttgtactcacctagtatgcttgactgtactcagcataattgaatgccatgtgaatatatttaagacagaacagtgtaattaaatcagttttcaaaacacaccctggggaggtggggagggaaaggaagcaaacttccatctcttgggtccttacaatgtgccaggtcctatactaatcattatttaattctcggttattttatttttatttatttatttattttgaaacagtctcactctgctgcccaggctggagtgcagtggcgcaatctcggctcactgcaacctccgcctcccgggttcaagtgattctcacgtctcagcttcctgaatatgtgggattacaagtgtgcgccaactcgtctggcaattttttttttttttttttttttagtagagatgaggtttcactgtgtttgccaggctggtctcgaatgtctggcctcaagtgatccggcctcccaaaatgctgggattacaggcgtgagccaccatgctcagcctaatcattatttaattctcataagtgcccttcatccaattaagccaatatttactgagggttcactgggtgtcggacccttttctaagtgttaggcatatgacataactgaatggacaagactctcacccgcactgagcttacaatctagaagggagacagaaaataagccagcaagcaataaagcattttcagaaaaggataaagagcacaatgataaaatacagggatgcgagcagatgaggggccggcagggtgcggggggtggtcattagatagggtgatcagggagccatctctatggcaggaacatcgtgatgagacctgaatgggggaaggagccagccacactctgatgggtaaacagtacgctgggcagagggagagcagggccgaggccctgacgtgggaataaacttggtgtattagaggccagtgtggatgtgaaatcaaggtcgtaaagaagggagacaggtgggtgaagccgaaggagagttcagatctggtaaggtcctgtagagcctggaaaggcactgggatttcactccaagggttacaagaaacccctggaggatttcaaacaagggagtgaatccctcgggttgctctgattatcttataaccacaagcgcttgattcttttaccataagcacactgcttttaaaattaaagaattattaattaaaataaacttaagtgactgctttaaagttacaatagggtaggacaattggtaaattcatcaattttgaggatggtgttgcttacacggatgttctcaactacagtgatttgttttaaagaagcttccttccttaattaccactcacagagctttctctggctatgacaagtaagaggtaggaaatttacatgtatttatggaaaagcaaatactttcattaagtaagaacttaacagtggcagctggtaaaacaaaagcagcattcgtgatgttgctaattcagttcttccccaagaggcccaagctcctgctaagcacagtctcccgtggagccaatgtgtcccactctgttgttacgtgtgggaggttaggggtgactgcagagaataaaacagaagggggccttttaagagacaggtgacctggagggagggggaaatcatgtctctgtgtgctctgggggaaagcatgggcacaaccacagtgttaggcaaaactggccccgtatttggtgtctccttgccttcctttctacacactttctgtgcttcccaccctagggcgtaggagatgttcaataaacacttgtgagattaatccgatggctcataaatacttcctatttttattaattaatctttccctgcatcacaacagcgtttatggagtgtggctaagaaaacgcttgtgtttaatcctgatcctcacggtcagctcaagacactctctgagggaagagccaccatcacatcgagcaaggactgtgggcacacgcagaactccctgcctggccccccgacacagagggccccactgtgaaccactgaggccatccttccagctgatgttgcaagtttcttatatgttgtgaaacaagcgcttttctaaagatttagaatgttccgtgtttctccagagcttcattgtaaaacaattgtatcaactcagcccgtctaaattcaaaacatgtaagtgacctacatacgctgctcccgcttgggctcaacgggccagcgtggcctattttgactttggcacctaggactggctctaatgccacgacaatccctggagtttcctggagcctactggactttggagagcgtccaaatcatgaccgtggaagctttattcattccatctaaaaactagaaactgtgttctccccttccttcctccctcttgccttttctttcttttgagcaataaatatcctctttaaaatttaatatagcacaaagtcatcataagtataaaacattgtgtacaatctttcttacaaatggccaaatgcagtgaccaacttcatccatctcaattgttgtctcttgcattatagtctattctggtgtctacattcggcccactataatctgtactcctgaagcctccccaaagaaatgctcctagattagtgaatatttgaataaatattagaatttggattcagaagacatgaacattaaactggttttgcctctggtagcttaaagttgatagactcaaatactacatatatattatatatatgtagtattatatattatattatataatatataaatatattttatatattttatatatattatatatatatatatatatatatatatatataaaacattgtaaaaacagggtgaaaggatcagtgacagtgagaaatctaacagctccaatgtcttaaagtcacaaggacagtctcccaaataaacagccatcttatttagcagaattctgcttcattataaattttcgctaaaagaacagttttcctatgacacggaagaaagctgttatgggtgtttttctgggtttcttggacttgggaagtttttgagagctgtctatgtacagtttcataaaagtgcactgggacagtgttagagctgtgcagaacttggaatcagagctatttttgattgatgtgctgggcagaacttctccttggccttggtttcctaggccaaatgctcactcgtctaaactcacctggcttatatacgtgtctaagaataagctttcatttttctccaaagttcagtagccaggagagtgggtgttgatctataaattactttaggcctgcataattcctaacaatgaaacacactcatgtccaaatagacaatcgtttacatgaagtaacttggagttctcaagctttgaaatgcttgatctctggaacaagcagatgccataatgggaagtacatagaaacctcctgtttattttcctttttaagagaaattacactttaaactttcaaatcagagagaaataagagtgctgcccaaatgtactgcatagcaacaagatggaagattatcatttgcttgaatattgtttcacaacagtaaaaataggtctctaggccatcattggagggaagatcataagcccatcagtagagccatcgccacaggcatatccttccaaatgccaggtatctccttccctatgttcttctagtttctcttacttcaaacctttctcctttccaatacggggaatgtttatgaaatagctgggtactgctttgagttttaaccatgatttaacgtagtaaataatgggatggtagttttgcaaatgccagactcaaaatataaccctaacatttataaatagactgcttgccaatagcagacattagaggaacccactctctatagacccaatggcgtcaaccatctcttctacacaggtgatgctcaaatatgcagctcaaatcctcaaactctctgctgaattgcagtgctatactttcaacagtttgctacctgttttcacttgatcgttcagaaaaattatccactggtggggaggggtactagtctccaaaaatctaccaactcttctctttttcaagaatcatagtttctgttgaaagagcttgcttacccaagcccgagcctctgcttctctcccttagcctccacctagcaacagtgacacttctacccaactccttccacggtgtgtgtgatgtttttcctgattgttaaagatgaggttctttattctcttctttgaattcctatagcatttcctatttgcctgtctcattttagttgttttccaagtatgttttctttcctcgcaagtagactggaagctcacggaaagcagggactgtagactcctggtgcccacagggtcagtttagggccttaccattcattggtagacacaaaatcagaggttgacccgtgggactaatccagcaagtgtttgatgtgcaatacagagtattctaaaaatatttttagcaactaaaagtcaaaaaatgtcacaagtctagattagggttattctcaggaaaaatgaaaaagagtggacgttctagtactactggaccctcacccccatggcaaatgttctgcacagacgccaccccttatgggctgggcacccactttccagcgtgcctcgctcccgctgctccctgctgcctcacaccctgccatggccgccactgccatcacctctccaggctgtgtgagcacctgtgacgagaccccttagcctggaaccagtgctgaacaactgaacagtggcaactaggatagccagacacaaaacatgaagctcattttctacctaataaattctttttatgaaataaaagtttacatatagtgcatgaacaaatgataaataatatgacactagtctgctctatgtagcataataagtaagttgtaggcagacagcttggtgggaaaaaccactggaaagactcttctgggtccattcatagctggatggtgcacacctattttgggaggacacagaagcgtctaatgaaggaaaagttctccatgctctctcattctctataaaaggtttaaagtgatcatgttttataaaacatacatatatttttaaaaacattatatcatgggaaatatcaaacatatgcaaatatttaatactcccccccatactcaacatccagaaaaaacaattattaactcacggcttggtttatttctactcaaatcaaagatgattttggagttaactgcagacatcatataatatcattcaaaataatttcaacatatagactcagcctaaggatttaaaatagatatccatgacatcattatcacaccgcaaaataactccttaacatgtcaaatatctagtccatgttcgcattttttatagtatatttgaattacgatctaagtaagctccatacattgcaactggttacacctcttgcctttgtttttttggttgtttgtttgtttcatcttccactagttgcttcatttttaaccttggaattttttctgttgaaaaaaacaggttatttgccctgtagagtttccccagggtagattttgctaactgcattaatgtcatgctgttcaacaagtttctctgtcttctgtccttcctgtaaactgttagagctagagcaggggtctgcaagctacggcccatgggccagatctggccacgcttttttctttgtttatggctgcatctgtgctatgatagggagctgagcagaggtgcccggctgcaagagagacggtatagcctgcaaagccaaaaacagttattatgtggccctctacgtgaaaagcctgctgaccccagctgtagggactgatcagattcaagtcaattttctctttttgtaagaatattttgtagaggtgccgtagagggtggtgaaatcagtagacggtagctgactgtctctttttgtggtgttagcaagctacttatgatgaccgcctaagtgcactgttttattaagagttaccaaatgtgggtgctgttataattctaactttcctccctcacttattaattagaatatttatataaaaagaagttttccataatcaactacttggttgccctgaggtttattttgtgttacaagggcaggacaaattcttcattcatttcccatatccaacagttttcaaaataattcaaaataggttgattgaccagagggttctattttctgtatcactataaactcgtgtttttcaacatactttaagggtctcgatccactgcaaatttattcttattggtgctcaaaatgagcctcttcacactcgttcttaaaccttctgatacaaccctacagtcttgttagcctccttgctttccggtttgactagatgtttaggctcattttatacatcttctgttccagatggaatcagccacttctccagggagctctggttccttttagtgagaaacagtagcactgagcacccttatctaataaaccctaaatgttttaaactgtggaaatgctgagcaacagtgataaggaaaatccaaagtccatttacaccactctctggaatatatccaaatactgaaattcaaattatgagagccagactggtgactgtttcacaccgatggctcaaacatcactggaaaatcaaattatgaaagaccagctgctgacactgaacgggtttgcctcccatggccatctagaccgagggaggctcgctggatgatgacaagataaaggagtctgctgggcattaaaagctgggctgggagaatcaaagtggattgccctcgtgtgacagcagcgagcctcctgaatcaagcccagcctaaaaatggaatcctaacagtgcagatgccagcgacaaacaaccgacacacagcacggcaaggtgagtccccggatttatctcagcctctcccctccccgcccctcagtgaaagctgacaccttctcaggcactgggaaagtctcgccatccttctagtctctgtgttgctaggatcctggttcttggaacctaaggccccttattaatctacaggggctacagcaggtagagaaaaacagcaggtatgttttgtccgaatcatgacatctctcaacagcttttcctgccagggcttcccaaagaaataaatgtacaggccgggcacggtggctcaagcccgtaaccccagcactttggaaggccgaggtgggcagagtgcttgaggccaggagttcgaaaccagcctggccaacatggcttaaccctgtctctattagaaatacaaaaatcagctgggtgtggtagcacatgcctataatcccagctactccagaggctgaggtgtgggaatcgcttgaacccaggaggtggaggctgcagtgagccgagattgtgctactgcactccagcccaggtgacagagtgagactctgtctcaaaaaaaaaacaacaacaaaacaaatgtacaggcaaggtttgtggctgccaaactgagacttctgaatggccttaagtaaaatcgtgctgtccagcattcagaccaaacatttctcatcagtactttgccaacactcaacggtgtttggcaagaggcattctagaaactcttcaggaggtgagccatggagattaaggctgtctctgtaagatgacagtaattgttaatgtacaagtaatcggggttaagcctcacatatggtctctgtctctcaaatctgtataagcattactgaaataatgtccaccaagacctgtattcattttccaaacatctaccacattttcttatgataccaaatcaggtgaacaagcaaactaaagtacatcttggttatccttgggaagtgtactaagtactagcaaaatgactcagcatctttaaaatttagagaacaaacaggaaatgccaacttatcaaggggacagcagcttggtagttttaaaatgtgtttttcaggttagtggagaaagacttagagacatctgaattttttcttaaatttttgtctgccttcaaagtgtatgctcattctatgacactaattaatttggccaaaaaggaacctaaaaatgtttaggaaataccttttcagccgctgaaaagtatggcagcaacatccaaatggtcccttcaatgaaaagacacatattttattataaagtacactctgacatcaagtgccttttatccatatattatccattctgaaatctctttgggttgatgggaaaaggctagggggaaggaggggattagagctttgttagcagtctgtcttttaaaattcaagattacaggatattcattctattttcctctaagtttccgggaaaattcacctaaagttcaaattccaatcctactacccattaaccaagagatccaaggcaagtcacaatcttcatccgtcttagctttgtcctctgccatattagaaatcatatctcaagggtggccatggaaattcaataggtgcaaactgaaagacatagtaaccagcctaatacctggctcagagcaagtgttcagtaaatgctggctctcttcttctggtcctcttcaatgctcaagacctgaaatactctgatttgtatttcagcaaccatttagaaagtctcaaggatcaagctaagaaaacagtcaaacactgctaccttgataaagccttgtctgtatctttataacttccttagactatttaagactcagaaataaattaagacaatgctggtgcgttttgccgtctctgtaagagaactgaggggtccattactgtgggaatggagggggaggggtgagtatgtcccagaaaacctttaatagtgctgagatatgtttttcggtctgctgactcagatcattaaatctggtttacctatgtatcaagtcctatagacttttctttttgatatgtctttaagacgtaatggtccaaatggctgatttcctaatccagcaaccaagaggtgacccaagacattatagtgacattgaccaatggttctcaatctttaaaaacaaggaagtacctttttaatttctctcttcagcaagagacatggaagtaccttttttagacataaaaaatattacacatagttcatgaccatgtttttagtattggtaaaaatacataaaatacaaccatgaattcttaaacatgtcaataaaatccaaattctttttatcagtacctagatacattttaagaaatcatattttgagatattatttatcaatctataatcaaaactgggccatgaacatgatttctctgatcctttagaataaccctgatatgcctatgggcctccaattcagagacgagaaactaacactctctggattcttgccaattaaaaaatgagtgtcaagtgttagaaatgtaaattgattttttaaaaatcttttttaaaggcaatccctagtacgcataaataatcttaataatgtatctatctattggaacagtaataccccttctatcaatcaatcctaatgtgataataaaaaagattcaggtccaaaaatgtttactattattttcagtagcaaaagtattgcaatattctctgcaataaataattgcaatagcaattataattgcaaattaaatctccaatggaggggacactgtgggtgaccttttaccagctttgtgcacttatctcctagtttttatctgctttgttgctaatggtttatacctgttacctcggtcaattactagtgggagttgaaggccactttcttggttggccctaagtggttgagagttcacaaacaccactccctccctgaggactaacagccattgactactggtctgcttgttaactgactctccagagctccccatgagctctgagtgtgggacttcacctggtatttcttgcttggtttcttccctttctaattcccacttctccccttcccttactatttcaactgggagcacttcctaatgaatcacttgcactttatgcttggctcagggattgcttctgggagaacataacctaaaatgtccaacaataaggaacagttaatgacatccatccaacacaatatcctttggctgttaagaacctatctctgaagaaaacttaaagacatggtaatacattctggatatatcttaactggaaaaaagtatggtataattaactatgtaaaaattatacacaggcacaaattagccaggtgtggtggcgggtgcttgtagtgccagctacttgggaggctgaggcaggagaatggcgtgaacccaggaggcagagcttgcagtgagccgagatcccaccactgcactccagtctgggcgacagagcgagactccatcccaaaaaaaaaaaaaaaattatacacaggcacaaaaaaagactaacaggacagatattaaaatatctatatagttatttctgatggtgggaatatgaatatttattattctgtataccgttatgtagccttcaaaatttctgtaatgaaatcaccacttataacaagcatcccttttccttttatcaggaactgagactctggaatagctgaaatgtgttctaaaggggagcagagaaggttatggagcacaacagtggctaaaccaaaggatcataaaactttaataaaaatggtatttactggaaaaggagaaagagttgagaaataataaagtggaatctttttatatacactaagatgaatgttacaccccattacaacccacagaccatttcatgttgagttttttcagtaaatggtggtgttattttggtgaacatgatttgacctatgtatgtggccaaatctacatattagatatttaatggtggggattatgacttaatttttttattctctgtgtttagcatagtacctggtatatagtagtaactcaatatatgttgggtttccttgcctttctccccggctcactgaaataggaacgtgggagctgctgagttcctgcctgataaaaccccatatcctccatgaacactgccaaagtggtgctctcacagcctagaaaaggcatctctgtttatccataaggcatggactctccttgtgagaaaaagagggcctcccagcagacaggacaggccctccttcaggtggcctttctggggtgacttgcacagggcggtttggagacctaatgcagtgttcacttgcactttccctctagctgggtcctgctcccttttcacgaggaagaggagggaagcaggggtttgggctccgttttgcttagctaagcaggtaactggataaaattggtttagaaagctcccagggagtaagaacagtggttgtaagaataatttagattatatatgaatgttttaggtttttctctcagtggctggctgttctgtttcctgaacctgaatgatagagctggctttggcttaggaagaaaaaggcagcctgtaaggagtgaccaggcggtaggtggggaggactggtaatgtcatccacggttccctactgctgctttgtgggtttcaggaggtgcaccgtgtcaggaggctggggctcctctattcctgcagaggaacagctgcccagtcactcagcctggggttcacaccttccgcagtgcttgttgcaggaggttcagtgtagtgtgtgcatgtccacctccagctgccaaacttctcaacaggatgtagatgaacctgggctgacaaattggataaggtgggctggcaggccaaagcttcaattaccagtaccacatcctttcccttctaggatacacaaaagtaactggcctcattccttcctctcccaaatagagaagccttggcttgaaaattccagggagtggccatgcgaggtggctcatgcctgtaatcctagccctttgggaagccaaggtgggtaggtcacttgaggtcaggagatcgagaccatcctggctaacacagtgaaaccccatctctactaaaaatacaaaaattagccaggcatggtggcgcacacctgttatcccagctgctcaagaggctgaggcaggggaatcactagaaccgaggaggcagaggttgaagtgagccaagatcatgccactgcactccagcctgagcaacaatcaagacactgtctcaaaaaaaaagaaaaagaaaaaaagaaaaattccagggagaaccactaggtaaattggtatcaatgcagtcattgcattgatgagaaacagtctaggacttcagacggagactctgattctaaactaaggaaagtcagagggaaagtcagagggatcattgtgtggcgcctggggcgagagtgggaatgtgtgttctcttgtgccctagagcaggctttctttatctcggcactactgacataactcttcagtgtgggggctgtcttgggtactgcataaggaaacccatatccacctgaatacagaagactctagattctcctgggtctcaagtgcccaacaaaacccactttgttcctttgaagtcagggtagcatttccaaggctgccgtgtaaacaagtgtcccctattaagttggtttatcccttaatttatcctacaaatattaatgaagcaccacagtgccaggcctggcgctgggatgctagagagagaataggcatgaaaaggggcttggtacctgccctcccacctctcagagtctcaaggcatggttctccacctgggtgactctgtcgctcagggagcatttggcactatctgaagacattttttttggttttcaccactaggtgggggccagggagggtggtgccatggcatctggtaggtgggggccagggagggtggtgccgtggcatctgctaggtggggggaggccaggggtgctgctgagcagcacccacaatgcacaagacagccgcctgcaacaaagaattatccagcgaaatgtcagtagtgccaaggttggggaagcctggtctagaggggaaacagaccttaatcaaatcgtcttattacttgatatttactttcattttcacgtatttactttacaaatgctctgacatcgaggagagtgtgtaagaatggaagcagaggcacacctgggccagggtgagaggcagtggccagggaagtgctcctgggaagggccacatgggcagacattggaggatggactggaagtgactggacaaaggggcggagagatggaagcaaggaagagtattccagacagaagctctcaagtgcaaacaaaccttgtgttgggaggtaccatggattattctggaaatatttttcctttcataccatcatcaccttacagcctttgcaagacaagggcaactctgtgtccatgactccaacaaataggcagctcatcaagacatactgcagaacccaaccggacagaaactggaagaatcattcacactccagtgtctatcttgttccatggctctctttctcaccacccggcactgcgcatgacaacaggcaggaatcaaaaccctaagttgacattaaaagcctgagtttcataaaacgaaaaactgataaactgaaaaactgatcaattggacctcatcaaaatgaaaagttttactctgcaaaagatcctgcaaagatgatgaagagactaggagaaaatattctccaatcacgtatctgtcaagggactagtatctagactacacagaaaactcttaaaccccaactgtaaaaaaaaatcggattaggaaataaaagacatggatagatattccattaaagaggatgtataaatggtaaatacgtccattaaaagatgttcaacatcattagccactggggaaatccaaatttttaaaaccacaatgagatgtcactatatgtccagatgaatggctaatactagtgacaacaccaattgctggtgaggatgcagagaaactggatcactcacacattgctggtgggaatataaaatggcacagccgctctagaaaacagtttggtaggtcaggtgcagtggctcacgcctgtaatcccagcactttgggaggccgagacaggcggatcacctgagcccgaggtcatgagttcaagaccagcctcactaacatggtgaaaccctgtctctactaaaaatataaaaattagtcagtcgtcgcggcaggtgcctataatcccagctactcgggaggctgaagcaggagaatcgcttgaacccgggagatggaggttgcagtgagccgaggttgtgctattgcactccagcctgggcgacaagagcgaaagtccgtctcaaaaaaaaaaaaaaaatagtttggtagtttctgtttattatttatttttttttaatgtaagtttggccgtttcttacaaaactaaacatgcacttaactgtataatccagcaatgctggacatttattagagagaaatgaaaatcatttcacataaaaacctgtataccaatgttcacagcaactttattttttaatagtcccaaagtggaaacatcccagatgttcttcagtaggtgaatggctaaactgtggtacatccacaccacagactactactcagtaataaagagaaataaactactgacacacaaaacaacttggttggatttcaaagaactatgctgaatggaaaagcctatttcaaaaagatgcatagtgtgtaattccatgtatataacattgttgaaatgacaaaggtgcagagatggagaatagatcagtagtcaccagaagttagagaacaagagagggaaagggatgtgtgtgacgataaaagggaggcatgaggggtccctgtggtggaaatgtcctgtatcttgcctgtggtggtgcccacacaagtccatacatgtgataaaactgcatagaagtaaatgcacacaccccagtgagtacctgtaaacctggtgaaatctgaatagggtgggtggattgtgtgatgtcagtttcctggttgtggtactgtactacagttatgcaagataatgcctttgcaggaaaccaggtaaagggtacacgagagctctctgaattactacttttttttttttacgactgcatgtgaatctatataactatctcaaaataacaacaaaaaaaccctactgtaaaattttagtcagcaaacaaatgccaatgtaccttaagacagatctttttatttcttactttttccctgtactgcaaatgtacaatcacacaaaaatgtaatatttttggtcctttcaaaaagaatagctacagttttagggtgcttgcataattgtacattctcataattatttgacttataacagtattaattcttattctataagaaattaacaaaaggatttaggacactatacatggcccctgcaggttcctaagacaaaccacccaagttcaaatgtcacctccactgccaattatctgtatgacttttgacaagtgctagccttcagtgtgcctcagctcctccatctgaaaatcggtgtaatagtagttcttactttaagagttgttataaggattttaaaaagtactatgtctcaggttcttaggacagttcttgaggccccactcgaagctggcctctgctgttaccccatttaccaccatcatcacgaaggcctggggtcctctcttcaggctttgaaggcctatactacagtccagcttaacatttcctcaagggcaaaatgttcaaatattataatttctaaaaatcaaaacacatgtttaaagctgcctttaagacttgtggtcttttttcaatttcctttatttctttgttattagagggagtcaagggtctctagtatgtgactttatcagactttcacatctggtcacaggtcctcagggaaggtgacttgagaggccttgccctccccaggggaagcagctcagccctgtgactccatcgacagccctgatgatgggcttaggaaatgattgatggtcactggcgactgaggaaatgggcgtcaggctctggcgattttccttgtgttctttccaaggctgccaacctcatgaataaggaagtgttttcctaccagcctgaaactgaaatagggtgggattatactaacataattctttaagaagttttagtgtgttaaagccagaccagccctgcctcagtggtcaacacattccatgatagaagtctagagtttaggccaactctcatcacagttttgtttagatggatgaaatacctcatatagaaaatgcttgatcattgctcaaagagatcgtttagaaataaatctgagctccactggaaagcctgtaacaatggtaactggaagatgaggtaatccaggagaaaaaccctccatttttgcaagcagactctaaaacacagtacttctcaaaaaaaaaaaataataataaaataataaaaggggtagaaagatatatagaagtccctttatcatagaaaaccaggatgagaagaaaaagtactcctcaccccaaccctgctgttctcccaggttctatatctttctaagtgacaccaccaactgttcatccaagaacctaagccaaagtctggaaactgtccttcatcatttcctttatcccacagaaccatcaacaaggaaaagctctccattgtttgaatgatccacccctctcaagctcctctatccccagcccaagccaccaacatctccggaggaggacactggtctcctagacccatctctctgcctgcactgccccagtgactctaaaatctgagtcaatccctatgatgacttctccatgctcttgcaagaaaattcagcaccctctctccataggctctgagtcggcctgtctggtctggatttggcttccttttccacagacaggaggccccctcaactgcaggaaatacgttctaagaccctcagtggatgcctgaaaccatggaaaatttggaaccctatatacactatgtttttttcctgttcataagtacctatgataaagttgaatttataaattaggcatagtaagagatgaacaataacaatagtacaataataaaaatatattgttttttatatattatacatatggataatatactgtaataaaagttattggaatgtgatgtctctctcaaaacatcttactgtactgcatgtaccaattttcagactgcaggtaacttaggccaccaataaggtggagactacagtgccctgtcctccttgcagtttacagaacgtggttggttcttcctagcctcaggccttcatgcctatgttccctctaactggatcactgtcatcttcccttgtctttgtgcctgtgagcccactggggaccttgttcatcctgttcaccatggcaccccagcctccagcatggcaccccagcctccagcatggcacatggacactgaagtgctcaatatataatggaggcattgatgaaaaagcaaagctttcaatgatctgttgattaccatcatgtattaaggtcaattacagtggccaccatcttataagcaggtatggtctaaagcatttgaggaagtctttttttttttttttaaaaaaaaaaaaagaatgtacacatttctagagcaaagtttcacaaccttgtcactcttgccatgtgggtctggataattattcattgtagggggctatcctgtgtattgcagaatgtttagcagtattcctggcctttactcaagagatgctaatagcaccccacccagatggaccaaccaaatgtctggagacactgacaaatgtccctgaaggagagaggaaggatcacccctggttggcaaccactattacagagaaagtggtggtggttagtattttaattctgccttcaaaatgcctagttaacccatactttgtctgaatcacacaagtaatgatgcattttaatatggtatcacttaaccacatttacatcattttagtgggaacatgcattccaaatccctagtaatatttatgaacaaccatggaaaggttgaactgtctaccctgagagactcagcttagcctcctgcatcagtattccaggtgacgtctgaagtgaaatggtacgaagaatagaaagaaaggtataggagtcagaagagagttgggggatagatgggtctttccatatctggtctgaccattcatttgtgtttggcatataaaaacagaatagaaacaagataacaccttagcgtttcaggtccttctggaaagcaccatcccatatatttccatggtggggcaaaacccaggaatgaaatgtgaaagactaggactcaacactgatctcactccgtttgcccctcttcaactaatataatatgctgctgagcttggaacacctctgcaggaatgcgaaatgatttcctagttttacctgccacattgcaacaatattttcaattattggctaaactgcaaatgccccacgagtcatttaaataaatctcacatggatgaaatagtcaattgtgttctctgagcaattcccagctgtaaaaatacagccacaccgaacatatttttttctgcagctaattgaaaatactgcacatataatgcatgatttaaagcacccaggaggaatttcaatttgcattccctattttaaatgtacaatcaaatgctgtcttaaagtgctccacacatttaattcaatattgcttgcctgaagccccactcctaaattttagcactatgaatggatggtcaaaggtttttaatgctccaagtgactttttaaaacaatggctttaacagggttgcttttcctgagaaaacaaacgctcctagacatgactggttcaaacctctacggcccagagaaaatttccaaaataacagcaagatgcctgccaggaaaaagagaccatggataaggacatccttcgttcaggagtcaaacctgatgtggtctcataagtgctcatagctgttgccctggcgttagaaatgcccttgacattcttggcagttgatcaagatggttcatcaaagggtgggtgaaggcagcatctgtggaggtgaagaaagaaagggtgcccggaagcttgggatctgggaaaaaggggtgccacaagatgtatgatcatcttccatttcaaacggagcttgagaggttgcacaaacagttcatgtgctctcctagtcaacaaaacagtgattcagggcctacatcaagagggaagcacaagagtagaagcttcaaagatgaagggaagacagagcctgaccttaagagcctgcagactaacagatgacagaaatccttaaggactaagaaaagaggtagaatgtgacacattgagtttcagtcaaatgaggaaggtggctatttgcctttacttaacatgaaataacactatcagttgatgtgtttcccaccacagggtaaattagtaagaggaggtgaaaatcagaagagcagccacatctatccctactgggaaggataagacagtgacccacagtggtagcaaccaacaaaccataaccaaagaattaaaagtatctgaatttaaagttaaggcgggtacagtggatcacacctgtaatcccaactttaagaggccaaggtgggtggatcacatgaggtcaggagtttgagaccagcctggccaacatggcgaaacctagtctctactaaaaatacaaaaattaggctgggcgtggtggctcacgcctgtaatcccagcactttgggaggccgaggcgggcagatcatgaggttaggagatcgagaccatcctggctaacacggtgaaaccctgtctctactaaaaatacaaaaaattagccgggcatggtggcgggcgcctgtagtcccagctacttgggaggctgagacaggagaatggcatgaacccaggaggcggagcttgcagtgagctgagatcacaccactgcactccagcctgggcaacagagcgagactccttctcaaaaaaaaaaaaaaaaaaaaaaaattagccaggtgtggcggctcacgtctgtagtaccagctactcatgaggctgaggtgggagaatcacttgaacccaggaggcagaggttgcagtgagcccagatcacaccactgtgctctagcctgggtgatagagtgagaccctgtctcaagaaaaaaaaaaaaaaaaaatttaaagttaaatgacataatgaacaccagatatgtatttattgaacaaatgaaagtactagtcataacttagtgttcttccttagataacccttaacttttatttcacgaattaagaaacagataggaaataatgaaaggactcagaaattatctatttcaatcacctgtcaccaggggctattctcttacattatctgacattacaaaattagtcctttagacactcccaatctctggaaatgaagggacctagtatgtgaaacttggctgaaccactaaacctcttgtgctaactgactagaaaattccctacaagcaacacagaactaaaacaaatggttttagttctatgacatgggccattaacttgctttcacatggtacttaccaattgatatggcttggctgtgtccccacccaaaatctcttcttgaattataatctccataatccccctgtgccaagggcaggaccaggtgggaggtgattggatcatgggggcagtttcccccatgctattctcatgataatgagtgaatctcatgagatttgatggttttataagtgtctggcatttcccttgcttgcactcactctgtcctgtcaccctgtgaagaaggtgcctgcttttcctttgccttccaccatgattgtaagtttcctgaggcctccccagccctgaggaactgtgagtcaattaaacctctttccttaataaattacccagtctgggatatttccttatagcaaggtgagaacagactaatacaccaatcaagcctcctataacaagtgggcttcccatgaagattttgttaaggtgaggaaagtccttattggtcagaggaccctcttgttatttatccgtctcttgtgagtctggtaattgttagtcagtctctctgacctgcaatgaccctgggtatcctgacaaactcccaagtttgtcttctctgcttcatgctggggatctccctcagtgatgccatctaagcagccagtgtctctgacaccatacaaataaaatgcagcaccatttggtgatccagcctatgtttattcttctccctttggcaacagacactatttacttactatctttcccagagcaatagagggaagccaggaaagtgctgagcttgtattctacaacctgagaaggaagtaagggaaaggaagagctcagtgcagctaaatcagcttcctaacacatttaagtctacaggtaggttcatttaagcagttcagaaacttttaaaaaggttcagaagaaataaaacagagaacatctttcctaccctccctccaaatatatcaaaggtgtcatattaaaatacatggattccagtagtacacatggactaaacatttcccatcttttattaggtgactaaagggctactttgagatatgttttggcacccacaaaagtaatcctgtgacactgggtagacattcttttctttttcagttctccattctggctcttgtaatcaaggtgggtttcttgcaccaagcctctctacccaggcctgttgtaagaaacccatgcagctttggtccatccatatccttcagtgtaactttttggcatgaattacacataaaacagtgacccagaaagagtttgaactgggtacaagaggtgggtggtccctggttcccacattttgacttctggggaaaaatgatatgagccattttccaaaatatagtaagtaaataaaaatatatgtatctgtaggcacaaggtatagaaatacttctaaagtaggaaaagggaatgagggatggggaagatatgagaagacaacttccactttaagaaaggttcctgtgcttttatctccaactctttgcgccttttgctttcttccttcagtacaaagagtttgcaaagaaaatctcaaaaaaattttgtaaaaaggtgatcactgcccacctcttcctgccaagcaagcacctatcaaacgaaaaaagttcttcaaagctcagaaaccatgttaagtgatgggaaacatggttccgaacctggatttagtcacccagctactgagcttcgtcctgtaacctgactccatttcctttgctacagttgatgctaatgccttgtgaagggatttaagggccaggggacgtttgctatttcccagaagaaacctatgcccatttaacactactgtggaacaggcctgttgtctagtcctgggcctgcctgcaatgggtaagtcacatacctgatctgcaactcagtttcctcatctataagatcagtgataagcctccttccccaccaatgaacttcagagagctgctatgaggattacgcgaagatgctgaagaacaagtcaataactcttaggttccacagaacttttcttcacaagacccgcctgctgccctgctgccaacatccaaagctaagataggagaacagggacttctagaattaaaagtcaatgacaatggaagttctccttctcagctttatctaacctctggtataagaaactgcaccaacgaatctttagggatgaagggggctgagcttctttttgtcatgaagttgcattttataggggagaacatctccccagttactcacagccaattatggagacaatgatccccaacaatggggctggtgagtagctgcacagaagatgggggaagaaactttcataaagcccctactatgtgcacagctctgtgaacacatcatttcacagactcttacacacagagatgcagagaggttggggaacctgcccacatcacacagaaaaaaaagagagcacacgggggtacccaccacaagactggcacggccaagggcttctcccagggacaggtcacctgcccgccccttgcccagtcccctgggtctcttttcattccctcagagtgcaggattggcactaaccccattccccagctttcacctctctttttcctcccagatgtataagtgtgtttccagcacatctgaccaacttctcccacattgcaagagtgaggctcccctcctccagcgttaattctttatttctttgattaacttctaattcccatgcatgcttggatatagggcatcccccagataagacagccctcttcttttcccaatgagaaaatccctaccccctacaaattttggtcaatctgcccaaataaactttatgactcacatgaaatcacataccctatgagttagaaatagtacttttcattccatgtccaccttccatgaagcaatttagctcacagtcttcccaggtagtgtccacatgcctgtcctcaatttgtgagttgtgtaaccattcttctaagcacagcacctccttaccttccaagttgcctatcacacagcacttttcaaaacgatgtgcaacactgccactgaaacacctaccctaggccatcagaagcccttcagagtgaccaagaaagttgccctcagaggcaaaaatatattgacgatccacacagcatattagtgatcgtgttacttttaaagtgaccttcaatggtcttaataaaatttcaaatgacagagggcagctagctcttcaggaaacccatttcctcttcttgccaaccgcagagctgggctacatttcctagccttcaaggtaggtgggcgtgaccataaggctgaactgttcttaatgaaataggagaagtgacacattccactcccaggcctagcctatcaaaatctcccatatgcagtcctccatgatctttctgcttccgccagttcaatgctgacaagtacgtgaccttagcagctgcctgttaaataaagtggaaccacagacaggaagaggctgggtcgccaaatcaccaggtttcacataaacacgcccacttcgggctttatacaagtggaaaataatcttccatcatgtttgagtcacggtacatatttgggtttatttgttacaacaactagcactaccttaactaattcaacgttcaatatctggcaactctgaagttataacctcaagaacaagtactaaatctgtattcaatttctttgcctctcttttttaaaatttaaccccttttcatgaagcaacctcgataagcattcataatatgcattgactgagagaatttcaggcgaatttgccttccccatctgttctcagccagtcactcatggatctcatctatctagtttttttgcgaactcttaatgattttgtaaggaccctactagacggcaactccctttctgaagaacaattttgaggaaattttttgcttcagacacagtttccaagccgggacactcttttccatagagaaacttctgtatttcagtgccttttcgtgacatactcagaaattgctcaggtaccattttcagcttatgtgcctggcccagaagggatcaggccttaacacaggcttgtgtattcccgtgtcttgctgtcatagatatttaatgcttcacacctttccaaagttgtccatgaaaacttttgtcttcctttctagggaattaatctctcctctgtgaaggagttacctgtttttcttcagccataaagagcacgtcagagactaaatagccaactcttagctggtacaaatcaataaataccaattctacaaagtttcgggcaaaaaggatttagtggagagtcaagtaaaagaaaaaatgaggacggttgtgcccaggagggctacctagacactggtgtttaccagctatgtgccaacatttccctctgcagagagatttacctctggcacaaagtagtaactgacacttaagtcacttctctgcatgaagggcttggcattagcactactgagcccccctgctggctgtctgaaagctgggcgttactcccctaatctcgcataggaggacacctgtcactcacccagattcctcagctacagaaccatcttgggctatcagcctctcacgtggtgaggcaatgcacagaaagcactttcctggcccatggctcgcatgggcatcagggactgctgcagtcttcagggtcacagactgctctcctggtgtcctgtcctaactgagagggaggggaggggacttccacgcagccttccccaacagttcagtccacactgaccactgccagcttgacctcccaaacatgtcactggtatcaactcattttggcaactgattattgatccagtacaggacttagggacaaggtgggagtggtagaagtggttgggtctggtggaggaatattttatcaccatgataataaaaaaaactgaggtaatttcatttttgctttcagatcctctacagacaatgctccctgattgcctccccctcccccataccatatgccactgttctagactatctcaaattgttattaaatatcatggatgtgccctttctacctaaataaacccctcaaagattggcctgttttgcagatacttctgtgcccctctaagcacctcttacagagtaagtgctcaaaaactagctcttcagctgcacgtcacccaaatacaacaggctgccaccttcaacttccttcttgtcctgtgtggggtgtatacattaagaacaagtcttgtggactctcttttaccctctagaatgaatcttcctcgagaacacaggagtgaatacagagacgacacaatagagaaaaagagcatgaatcagccatgggactctaggatcgggttgtaagagccaccaagttatgtgggccgctaagggctaaccaagggtgagtggcaggtgatggcagttctgtcatcaaactgtacccagacttggcatctggagaggtaacaggtgacaggagtcaaagacgtgaattctcaacctgccacagccctgcctttgccaagcaacttgagtcactgtatttcctatttcccatttccctgcatgttaactggggacactgtgatctttctctgcaaggagggtaatatcctcatcattctctattctctagctatggaaataaagcacagagagggaagtattttgcctaaagccacacactactaagtgtggacctggggtttgaaaccaagtttgtttgacctctaaactcatcctctgcccagcaatgctctgaccttcaatctgtgaggccgtgcatcactgctcagccacatggcttagcctcaatcattcctgaagatagcgtttcaggatccaaagtgtccaccacagagagacacagacccggagtctatatcccatcagtgggaatcggagccgggtgttctacacacctgaatctcatttttctcacctataaaccaggaatgatttctaccttacaagggttgttaggattcaacaggatcgtgtataaaagatgcctaatagtacttgacacactgatgatgcataattttccacttccctctccccttggaagtactttttgggctcctctgtgccagctatggtgggaggagcccaaaagaataagatactccacttgcaggttcctaacagggcagagaaaacacacgcagaaccagaacacaaggtagagagcagtacacaagcacaattttgccactgtacatgtaaaaaatgtacttgccccactcgtagaaattttaggctaagaagtgacatatgcattggaaaaactatgtcttcatactttccactatgctaaattaattcaaattagtatgatcagaactttgatattcatgatttaccaccttgctgcacaagaacagatttattatgaatactgtggcatccttagccaatcctccaaattgttattttaactaacatgtcattaagaaattagcacaggtttggcataagataataggattcttttagtatacacatttcaaacagaaaaatccacacctttagaaagaaagctctcccttacaattaagtcatcacacagattctccctggcatcccctaatctcactgttagagcaacaactcaggtgtgggcatatactcagactgctgtatgaagtccaaagtggataactgccagtaaaatccttaaaaaaatcctatcaatggtagcagaaaacacatttcctatctgggaatgcttgctaaggttaacccaacattcttagaactcttttgcatattgacggaatcaaatcataattaaatgaccatcaccatgtgctttaacaatattcaccatatgtttaaaatagttatttcttggtatctggacatcactggacacagtagaatgattttttcacagtcagaaaaacaagaatgaaaagagaagcctctggatgctacccttgcagagacctaaatattaaaccaaatagattatttttcctactgtatagacattttttgttttgttttattttgagacagagcctccctctgttacccaggctggagtgcagtggcacaattctgcttactgcaacttccgcctccggggttcaagtgattctcatgcctcagcctcccaagtagctgggattacgggcgtgcgtcaccatgcccagctaattttttgcatttttagtagagacagggtttcactatgttcaggctgtttttgaattccgagcctcaagtgatctgcccacctcagcctcccaaactgctgggattacaggcgtgagccagcatagacatgtctggccctgcatagacatttattcgttattcacaactaacctaatggaaaaaagcagccagcatgacagggctacctgcaacgtgttccctggaagacctcttggtaacactgctgtttacatctcacaaatgcaagggtggagtcagaaggaggttatttcatgcaacagccttcctttgcttcatggccaacgcacaagagcctgaagcctgcgggcaggacagatgaccaggtgatcattggggagtactgcccactgagagtgcagcaggaaaggtgtctggaaacaaagcatgcaaagacacagagcaagtcactcattcatcaggccaaagacacgaggaagacatgagtctcagagaagtgctcacctgtacttctgtgacaaatattacccaatgccacaaccacagccacctcgtgtcccgaaagtcagctccattcctgccactgtgcttagcgcctaagatatactcttcgcttcatcctcacaacacttcaggggtggcccttaagcctaaacacctttaggcccaactcacggatgggcttggagatgtttagaaatttggctttggctcataccctccaatatgtagcctctagattcaaaccaaagcccgctggcctccaaatcctccacactcttaattactatacagtggaggaaaaggaggaaacacatattttaaaatgacaaattttgaaataaaggtaactataaacctttgaaaaagaagttaaatcgcaaacagagttcaattaggcatgtttgaaaagtcatggcacacttgttctgtgattctgctgagttttatccagctcagcttaagttattcgcttggactcttgtgtaaatctctctaccttctcaatccaaaggtcagtactaattttagatttcagtcccagaaaaaaacaagtgtctgaggaaggaactagggggccaaaggcataaaaccatgattcaaacgtaccacacagatactggcctctttctgtatcatgtgttttggttgtgatactagggctatcacgcagcacggcgaggaggtagtcttgaaaggaggagtgtgctttgacacaaatttcttctcaagaaggtataaacattgatgggatgtaaatctttgaatatccatggtatcagctcacggttcacacatctacagacccgggtccaggctctggcactgacacataaaggctgtgcgaccctacatattcacagggtgtgccactttggcatacaggctgtgtgaccccccacatactgcgtgaccgtggaccctttatctctgccacacccttccttcccaactacatgagtgggaatgatatcagcatctagctgagaggcaggcacgaggctctaggagaccacatagagattccgttggggggaaaacagaaagaaaggcagctggggaacgccaggcagcacggtcctctccactccctttcctcctaaccaaggattgaccatgtgatttgggattcagccaatcatagaacctccctcctccgcccacagccattggtacacggaagggcatgtgaccacgtgacctagcatcagccaatcacaggacctcactcctctgcccacagccattggtatcgggacgagcatgtgaccatgtgacttagcatcagccaatcataggacctcactcctctgcccacagccattggtacagcgaacagcatgtgactgaaactaagccaatcagaattcctccctaggatttccaccccccaccccccccgccggctggaactggctgaaaagcccctctttcctcctcactgaggaggctgtagggaggtaagcctggagctacctacagtcatggtcccggagaggacaaccacaatcagcagacagaagcagagatgagaggcaaggagaaagagaagaaagcctccaagtcctcagtctttggttccagtcatcttcagggccagagtcacctctcccatgcttgagtgggcagtgtcagccaacagctctccgccttgtttccgagttattttgatttgggtttgttctcttgtaagcaaaagataatgcagtagttaatagttcctataatcttaacagtgaccaaatcctcagtaagaataacttcttgagtggatttcttatttaaaaactgcagaaataaattttagtagaggaagcaaacattgcctttatttacatagcactttccccaaaggaagaaagaaacatccattttcatttgtagtcaccttattcatttccgagtgggctttgtatttggcattaaactctttcacatacccacatccaccttcaagatttggcccataaaaacttaggataaaaacaagtggttattttttctatagctatatttgctggaactacatggagggcgaaagttggggtaggggtaagagaaggcactgatgctatttttggtatgctctcaagagaaattccccaggttacgagttcacactaggggttgggggtggggcacggtttacaaaaacaaagtgcatttaccaagatttgcagccgtaacaggaaatcctttctgactcttgatgggattttttcttttatattaaagtctcctcatattattcttcaaagaattaaataagaaaaatggaaaggcacaatggatgtaaattccaattctcaaatgatcttctgaagcaaaggataatgtcttacgtcaaactgtggcaaaagcctgggtgttcctgatctaatcttgaactagggtgtccaccccaacctttggaggaatcctaggacatgtttgccaaaacatacgagtggaattacaaatagaggattgcttgggctcagtggccatcctcatgcacagaaagaatcccagaagggatgccgacttccctggactgggcttacatccagacctagaaatctaacagcagaataaaggcaagactcactgactgtagaaatagacttggcctgttggatgggaggtggtatttctcaaaagagaaataaaatcatactaatctctcagtattcttaaattgggaacttgcagacaagagataacctaaagatgtagtttattgcatttgactccattctgtatctaagggtattttttaaaaacccaacattggttttcagattaggcgtgcaatctactcatgaggaaagatggtttgcaaagagaagatgggcacatttatgtgtggagaacaggttgacaagattcaagtatatgggacctaatttatttaaaatttttataaatgctctaagtgggaatacaaactaaatcttcatgttggcccatgatgctgtttctgaatataatgctgaatgattttataggcttaaaaaagtgagagacaagaactttaaggtgtatgagcacaggataatgcatttacgaaaaaattttatctagacttaacacttatgagaaagccacatcaaaaggaaactgagccaagaatttataggttttaaaaataagacaccttttagatcatttatttcaatatacccattatacagacaaggaaactgagttctagatggtaacctacacgctctattggtggtgcagcccataccctctcccagcctgctctttccaccaaatgtgactgacgataccagccaaaaaagttccatggcaaaaaaaaaaaaaaagtcaccaagaggtcatatatcaccatcaccaaagttaatagaaataaaccaaaatgcattctcctaccctgtaaaaccacgaaatgcagagtgcagcccagccaacagacctcaaggagggcagaaccatgccaaagggaggttcagatgaggataactgaagtgaacacaggcacacaagtgcttctgtattagacttccgcttttctctaagtaatgttttatctcaaaagacaaggttaatcaaaaatttaaaatgtctgaggatatatattaaatttgctagtaccaaaatgagggctggaggtctggcagagagagctcccctttgagtctggaatacaaacactcttccataaagcatgcagtaaacttacaaaaaatatgaatatggtttagttcagacatctgttaattgcctttgggccacacaccaccgctggtgcaaataaaactaaaacacaggcacgtctttctggagcttagagtctactggatagggcatgttgctacaacacaaaaaactgccatcattgaggtaggcacggggaggggtgacgtgtgtgtacactgcacatgtgccacagagggctggggtggtgactgccagcaaggcctttttgagcctgagtcttgaaaaaggagaaatcagccagacaatgaacacaggaggagaaagggaattccaggcagaggtacagaaggagcaaaggcagaaaagcactgggcggtaccagtgcagtttacgggaggttcagttttgcaagaaaagaatgtttcaggcaggggacaaggcaaggagatgggaagggagtgaagaaagctttgactctgttgggtcattacaaatggccagcagcctggtgagcccatggagcactgtggaaagttccctggctgcatgctgacaggaactgagttctgggtcaagactctgccctaaggtgtctaaatgacctcaggaacacactgtatgactctggataccacatgtaaaacaaggttccccatgttccaagggtgggggactccctgggatggcctatgcctccatatttacagactccccactgctgtttgggatatagaatcgaccctgccctatctccacccaggggggctgcgaggaagtggggcagtagtcaggcttgtagaaatgctttgtaaacagcaggactgtcatcaacactagaactctgtattaactaccctacagaagctcaaaagcatcttcagaaactcgggtacaacactgtataaagatagcggagagctcatctttcaatcttgagataccaaacttgtgatatgacatggccactcctttagagtcagggatttaagcccagatcaagagggagccattgaattttattaggagggacccaagaagacttggatttggggcagcaggaggaaagtcacaccagcaataacatggaagagagttagaagggatgcaacatgaggtgcacgacactgtgcagtaagcactaggcattcccaggctgtcgatgatcgtctcagcctagggtctctagctctgaagcccatgggagccagaacgccactataagcaagggtcacaggtctgggggaaccagaaagcaacctacctccagtgtattcaggcactggaaacccagcagcagctgaggtttgccacatgggaatgtaagcttcctattccaggttttttttgttttgtttttgtttttgttttgagacagagtctcactctttcacccaggctcgagaacagtggcgccatctcagctcactgcaacctctgcctcccgggttcaagcgattctcctgcctcagcctcccgagtagctgggattataggcgcagctaatttttgtatttttagtagagacgcggttttaccatgttgatcaggctggtcttgaactcctgacctcaagtgatccgcctggttcagcctcccacagtgctgggattacaggtatgagccaccacgcactgcctcatccaggtcttctggcttttaggagaagctatacatccaagtggcatctccagatttctaaatattaactcaagttgtatatactttgttcaggccaacaacactgctgcctactgctagaagtggcacaccggccaccattttgccacttttgggctctaaagcaaggcaaggccagcgtgactagagcggacctttgtggaatttcacagcatgaagaagcaacaggatctggtgacagcctgcatgtgggcagtgcgggagcctggcatcaccgtgagacccctgctccaacatctccatgaacggtggaaccactgccaaaaaaaaacggacaaatcttcgctaacaatgaagcggatatggggtgggtggtgaaaactaaaatcaattttggatttattttggggtgtttttttggcctaaagggcacgggtaagcgcaccagactgcaggtaactgattggaacacaggagcatgctcaagctagcttaacatgccaatctgggactcgcttcatattggtgagagtcgaagctgtgggaacatggttcacccaaatacacagagcacaaaagggatgacagcgaaccctgggtaaccccaagaggtagcagagatgccagggaggaataaggaaaaccagaaggtggcaaccagggatggaaaaaaaaaaaaaaaccatcagaaaggaatagaagaacctcatcaaatgccacggagaaacctagtgggtatccataagattgcttgttcagatgagaacacagggacacagggagggaaacatcacacactggggcctgtggtggggggcggggagtgaggtaggggagggatagcattaggagaaatacctaatgtgatgggttgatgggtgcagcaaaccaccatggcacgtgtatacctatgtaacaaacctgcacgttctgcacatgtaccccagagcttaaagcatattaataaaaattaaaaaaaaaaaaaaaagattgcttgttcaggaagtcacaggccttgaactttgaggagactctggccagcttgcaaagagctgaacaggaagggcagaccagtttaagaagcctggagagacgtggttgtcactacaggtgagctgaggatgcagggacaagggaggttaaggcattcttaaaatactactaaaaaagaaaaaagctcacagggagagactgaagataaaagtaagaaaagggagtaacactcacaaggagagagaggcactgggagttgggattcaggacacagctggagacattagtcactgccccaaggaggccatctctctatatttctctaagttctcagtctaacttgatttttctttataattctaccttattcatttatcatacattttacaacatattatgtttgcttttagttggttttctcccacaagaatgacagtttcaagcgagcaaggatctgctctatttaccacctatgagtatccaacaaagtacccagacacagtagatgcttaagaagatttattggatgactgggtaaacacagaaaagtctgtacaggggagatgggggaggacgtgaggagatacttatgacctctattctcctggtagaatgggctacaaagtcacctgccaaacccgcaagaggaaaagcattggagatcgcttgcattgaagattacagtgggagtccggtttgcaacccggaaggaaggagcttgcgggttggaggcactaagagttttcagaagttgagcatctcaagagagggcaagacttggaggtacttagaggacttggtagctggagtacatggaagacactggatttgagacagtcaaggaagtgcgcatctagagcgtcccccacatggactttaggtctagaggaggagaaatagcccaagagccaaagtccccatgcgatgggaaaagaactggctggaagaggacagcaaggctgagatgcacccagggacgtggccaggtcaccacctcatttccaactctaccacctcaaacaatctctgactggtatttaatcacccttgtgtggaagtgaaaattagctttttttggagacagtacttttaaaattaaactaatatgaagttcatgggacacggaaattttctgcatagattcatttttgtttttagaataaaatacgatgacattttcatgaccttcagtaattgccctgcatggtacgatattttcaaacattattttaacaaagaatcaaaatttgggggttaaaagaaaccttagattactcaggttagtaccttcatttgcatagccaaaaatttttctattgaaatactgcaaatagcaaataagtactgatttagaccttcagatagtgttgaaactgtcttcaattttcgaagtgtggtttaggatatacaaattagcaatgttgacaattcttccagttatctgtgctcaagttttgatataaaatcttcaaagtacacaattatcacatatattgttccacaacaattcagacaaataaacggcttcttggcttgaaagaggaagtcacaccttcgaacacctttttatgctgatgctaaatataagaacgtcccctgcaaagtagccaaagcaagacagcagcattcgagatttctccagagacacacacacaaagaatgtgtttcgttcattaaaacactaaaaccttcaacagcatcttccataatacctgaaggtggagtgctgtcttatgtaatagaagccttccttccccgctcagtttgtggacacattaaatgcctaattccttccagaatttctgagtaccgtactttcattttacctgcagtcactcatccgcctcgcaactcccgtttctacagatgatgaaaatagcaaagacctgctcgctcgggttaaatcggctgccagaggccaagttaaaggctttccccacaccgcgcgtcacctccctctgcccaggcagaggtaacaagtaagagtgcgccagtctctccccatccggcggcgcgcagcctaagtccggggtaggggttgccggcgagcagctggaaacctcaggttcagggtcagggccggctcggatggccgggcaggagccacgccggccccggtgctcccagctgcgggtatcactggacgccaccccggggcggccccgccttgccctgcccgggtcccgctcggggctcccggcgggcgggaccgggatgcccggcgagcacccagccccggccaaggcggcccgcgggaggctgagaaagttctctgctccccgacgtcggcgccccagggtcccgctggccccgcagcttcccggccgggcgcaaggtcagggagcagggccggtggcgcgcggagccccggggagcgtcccccgccgagggcagcgccggccgcgcccgggactcaccgcgcagcctgtactcaccgcgctcgctggatccccagggggcggccgcggagggcggtgcggccgcaaccggagcgggagcctggtctcggcggcgcggggagtcggaggacgcagccaagcggcggcggcgaggagggtcacagccggaaagaggcagcggtggcgcctgcagacgccgcgcagcccgggcagccccacagcgcaagctggctgccgcggcggcgggggctttatcggcggcgccgcgcgggcccccgccccttcctgccgcccccgcccccggcccgccttgccccgccttcccgccgcctcctttgtgtggccgcgggccgcagcgtccccgcgcccggcctccaggacgccccctctccgcctgcgacttctcggatgccgccccgccaggggtccgtgtcgtggggctgcgcccggaacgcgccggggagacgcgcagaccccgaggtgcggcgccagcccgggcccagctgcacgtgggtctcccggatgggggtgtgtgaggtggcggggggaataccagggctcgtaccgcgtccctgagacgcagggcatgtcgtcttggctgccccctggaagagacagagggcgccctgagacagcgctcagtcctccgggtgatggggaaacggtgccaggacgcggccgggaaggggcagataacccctcgaggcgttttgcagggtgtcctagagctgacttctccctgcctaggggacagaggaacggcggcaagtcgccttaggcaaatacagacgaggggaaccagaaaactggattcccggctatggtgatagcatgaggtacccgcagcgtcctgggaacccagcccttctcagccggtaaccactgctgctgggacccggtgcgcgatagacaggcacataccccaggggcctgcaacaaatgaccgtcccgctccgggctctgttacctggacctctcttagttggttcctcctttgcctctagttaggtttctggggacccaaggacccaactttaatgacagtaatttatgtagccgttagtgtagaatcgtcgctagcaggcagacggccccaacagcgaggaagaaatgtaaatctccctatacacagccctggattaagggtacagctactgatgagagccacttggaagatcagcctgcagtcaccccttggcatgcaggtggccgtgccagagtgtgcacgtgtgtgttggggaaggggttgctctgaaaagtgtaaaatctggaccagcctaagggtgttctcagtctctcatagagggaaacaggctatgggaggcttggtcctaaaataaggagcaaacagtctacaaaaatgagcatctgtttaattattttacagtcataccaaatatttatattcagttacagggtaactttcttattctctgtgcctgaaatgctttttgtcccaggatcttctatgttgtctgcatccttacacttgaggtcacaactcaaatgtcctctcccctaggaagcctcccctgaccacttgagataaagtcactttatcccctctaacctatgacttccttcataaccctcatcatgaattgattttttttttaccttgtttcttgctagttttcttctactctctctcattggaatatactcccagagaccagggaagagaaactaatttcaatattgtttccaactcactctatccctagtgcctagagccataccacacatatagcagttactcaataaattttgttgacgagtggatgaactactagccaagtgacttttagacatgctaagaactgtttcagtgacagtattgtgcttggtccagtcagggcggtgtgggctggagctgggaacaattcaaaggaggggggaaagcccacaggtgtgaatgagctcgttcagtgtgtttgaaaagctgggagtatcctcttccagatggaagggagtcattcaagaaactactggagaaataactgggaaatgtgggtgaagccagattattatgaaaatgtgccagaatccctgcatccatttctgtctcaatcacatttctaaattaaaatttgtaatagaggtaattgtaggctggcatgcagttgttaagaaatgattcagagaggtctcttttacactttgccaagtcttcctcatggtaacattttgcaaaaccattgtataatatcacaatcaggatattaacattgatacgttgattcctatctcacacactttggttaattatgtgtaactttaaatttttactaaagttactcaaaccagtgagagaaatgcacaaaattactattttgaagagtttcagtctcttgtcttgaaggagccaatgtttttcaagaaaaaacaacaacaagccttttttgctttcccaattagagtgtaaatagggtccaaattcttcatctatgaaagacgttagaagtccttaggacttacctctttgggttacactttaatgactgacatttacttccccattctttcctgtagtgtcgaaggaacattttgagcaatactgtacgtgacttgtcaattctgaaatcacagtggatgcagtgctaactaatatgctaaagtaagcctagacactaatgttcccttctctctcgctagacatgcgatgaggccaacgatgaggtctcccaaaggaaagtgattgaagacaaagacccattctgccagtgggatatgctgggaataccaactatacttgttactgagtgtgcatggctggtgttggccagccttcctgatgccagcaagaggagacagaagtaatgacccaagctacactttccatgacactcaaatggccaggctctttgacacccaccgtgaggggctgttccaaagatgttgtgttcctacctcagttggtccccacaagcagcaggttcctcctccagtattctccaatatttgaccctttttgagatgcatttctcatagatgtgtacttccaatccacatttccttcctacctctacctcggttttgtttgagaaatccaaatcatttaacacttctacctgctgtttctttgtgacttcacattcacagtgaaatttcattttgtcctgcaattgtgtggcttgccttaatccgcaaatagagcttcaaattgtttattcctttgacctggagtttagccagctccagctaggctctgagtttggctttgtgtccataagccacagttgggagaaatgcaagaactgcccaaacagaataaaacaaatgatctatttagtcttgtttcctctcttggaagaagtccagcgttgagtgccttggaataaatgaaaatcccccaccccacctccactgctctcccatgcacccaaacagtatgaccttgtgtttaagtaaaaaccgtccttagctcccagtgggatgatggtgttttgtctggaagactgacggatgttatgataataagataatggatactcacttctctcctatctaacccctatttaaaagacattacaccgtaacagtgcttgttacgcaatattatagttgcaaatgttgttatggaagattgtttcaaccaggggaaaagagactggtaataacagtacacttatacaattagtttctgaaactgttgcattgctttggggtttttttttttagcttagaaaagacatttatctttttatttccctttaaagttggctttcaaataaattcaatttcctctttctgtaacttctgaaacagattaaaccagagcatcagtttgcactttgctattgtcgtcactagttttcaccaagagcttcagagaaaagacattactaagtgctgggctgggtattattttctacttatatgtgaccaaataggatgtaacagccaggttctgagagtcgttgtgatactgaccccttcaaacaacagcccagctgctctccttccttttaccaccaaacaatagatgctgcctccctttttccatgggtctcttcggtcaatcttcttaccccatcatcgggctcccctccttttcttcctcgcttcctcgggccctccttctctcccaaatgttaccaatagcttccaatggcaaccccagtagtttttcaacattctttatcacctttgagtccttggcaggatttcactctcatatgtgtgcccattttttggaaactcctttgcctattttctctcttcctatgccttaacttgcctttatcctttttccatcaaatcttccaacaggtgggcaccatgcagttgactgtcctcagctccctcctcttttctccacactctctcccagtggaacgaacattgatttatctgtggccaccaacacttgttcccctcctcaccttttgatagtggaaacacctcttctattttatgcagcattttgttgggaaggaaatcaaggtatccttactttcactagccaagggatgggcatatgaccaagctcactggattccctcccagttctttgaatcttgaaaagaatgaaaaagtaattgcagctgacttatctcagcttgatgaatgatgaatttgtgagttcttcctacccggacctcagagctgccatagaccctgtcccgtctgagcagaggtccacagtgaactctgtttctgtgagacttttctacttgttagccagattcagtttctgttgccagcaacctaggatgcctaactgacataccttaaatgtctgtaactttgcttagttctggatgaattctaagcccatatctacagatggccttggccaccatcccaaggtaccactcatctatctccaagtgcctggcagacacctccacttaatatcccaccatcacctcccacctaacaagtcaaacccacttattatcttcatcccccaaccagttcttcctcctgtgttccatgtgttttacagacatgacttccatctcagtcaccaaagcacaaagatgggaatgaattctttctttctttcttctttccttccttccttccttccttccttcctttttctttctttccctctttcttttctttctttctttctttctttctttctttctttctttctttctttctttctttctttctttctctttctttctttttccctccttccttccttcctttctttttgagacagagtgtcactcttgtcacccaggctggagtgcagtggcatgatctcagctcactgcaacctctgcctcccggattcaagtgattctccttcctcagcctcccaagtagctgggattacaggcgtgcaccaccatgcctggctacttttttgtatttttagtagagagggggtttcaccatgttggccagactggtctcgaactcctgacctcaggcaatccacctgcctcagcctcccaaagtgctgggattacaggtgtgagccaccgcacccagccccttttcttttttttattcatcccatttccagcaattccttaggtgctgttagtagtttttaaattttttcccccaagtccctctgagtcacccctcttccattttttcaagtcagttcaaactcttaccactccaatagcaccctaactattctctcagcttccagattctatctgtaactgccagcttagtctttctaaagtgctttttcggtcatgccactccccagcttaaaataattccactgttcatcacgaaggttccgattccttggtttagtcagtcttctgtagaggttatgaacacaggctctgaagttagattgcctgtgttcaaatcccagtctcatcactacgcaatttttttcaagtaatttaacctgtgagcctcagtgtccattttgtaaaatgggggataataatagaataacccactcatagggctatgtgaggattgtgtagttaattcatgaaaagaactgagtatttgacacataaatgcttaataaaaatttactacaatgaaagctctctacaatttaaccccaacccacctttcttgcattatcttttcattttctctatgttcttaaaggctttcccaatcagaattactcacctatatcaaaattgtattttttatgtcatcatgccattgtttaaaccattctctctgacctgaatacccttttcttactccacctgtatcagttatctagtgttgcattacaaactatcttttttttttttttttttgagacagagtttctctcttgttacccaggctggagtgcaatggtgtgatctcagctcactgcaacctccacatcccaggttcaagcgattctcctgcctcagcctcctgcttagctgggattacaggcgcctaacaccaccccagctaattttcatatttttagtagagacatggttttgccatgttggccaggctggtctcaaactcctgacctcaggtgatctgcctgcctcagcctcccaaagtgctgggattataggcatgagccaccacgcccggccctactatcccaaattttaatggcttaaaataacaaccattttatttgtttgtgatggtatgggttggatgggcatggtttggctgggatggttcactctgctccacctcctgttgtctgacctcactcttgcagccgtaggactccaggtggcctcactcatgcatgtggactctcagagagaagggctggaaccctcagtcttctctctctagtttttcatcttcacgggcctttttcaccttgttatatttcaagctctaaggctttcctacatggtttttccagcagtagtcaggctttataggatggctgaggacttcaaggtggggaaaacagaagcctcaagttctatgaaggattagccttggatctggcacaataccacttctgcggtcacaattcagagcaggtcacagggctatctcagattcaagaagtggactctacctcttgatgagaggtgtattagacagcataggctgtcataactagatactacagactgggtaacttaaacaatagatgtttattttctcacagttttgtaggctggagatcaaggtgccagcagagttggtacccggtgaggcctctcttcctggcttgcagatggctaccttctcactgtggcctcacttttttattttttttaatatatgtatatatatatagagagagatctgctactgtcttttcttttcttttctttctttctttctttttttttttttttttgagatggagtctcactctgtcacccaggctggagtgcagcggtgcaatctcagctcactgcaacttccacctcccaggatcaagcaattctcctgtctcagcctcctgagtagctgggactacaggcttgtgccactaggcctggctaacttttgtatttttagtagagatgggatttcaccatgttggccaggctggtctcaaactccggacctcaggtgatccactcacctcggtctcccaaagtgctgggattacaggtgtgaaccatggagctcagcctctgctgtctctttcccttcttacaagaacaccagtcatattggattagggccccgcccttatgttctcatttaaccttaattacttccttaaagaccctatcttcaaatacagtcacattagggtgttggggtgtcaacatatgaatttggtggggacacaatttagtccataataagaggagcagtgaaatccatttcaaaaaggcatgcgggaggagagggattactttggccatttttggacataatctgccaccactctttgccactgaaatcattttcatccttcacagttttcccttctcagcctagccagtgtcgatttccccttactccctgctcttgtggctctgagtatgggctgcatattccacacaaccacatccggccttggatgtaagcatttggtttaggttccaacctcagggcaatgggccatgtcttgtatatttttatgttttcacacagtgccttgcacagagaagtccataataaatatttgtggaatgaacaaaaaatgcaattaattttactattctaattgttgcctgggcagtttgcaagcttctgttcctccttatatgtcccacgttccctacctcttccaactcttagagcattgcatgatgggaacatctcagaaaacggaacactgggagccagaaaacccgggtttttgtccagtttctaccacctcttaattgtgatcttgggcaagtcatttgaattctctggggctcagtttcctcatgtctaaaaaaaaataataaaggaagagtaattgaatatctactatagggctattgagagaatataagataggtgaagtactttgtaaagtctaaaaaccttcacagattattactattattaattctgaagcacacatttgatctcagttccttgctggctctgccttatgcaaactgctgtcgtctaaatgtttgtgtaccctcaacattcctgtgttgaaacttagtcaccaatgggtggcactgggggtgattaagtcatgaggacagggtcttcatgattgggattagggcccttataaaagagacccaagagagatccttactcctcctgccatgtgaggacacagcaagaagactgttctcttggaagcaggaaacaggccctcaccaggcactggatctgctggtgcctggatcttgaacttcccagcttccagaactgtgagaaataaattcgtgttatttataagccactcagtctaaggtattttgttatagcagcccaagcaaactgagacacttcctatagtgtctggctcattgtatgttgcccaggttggtctcgaactcctgggatcaagcgatcttcctgcctcagcctctcaaagtattgggattacaggtgtgagccaccatgcccagcctgacatattttaataagatccccagtgaagtcatatgaacgtgaaagtttaaaaaactgatttaacttgcttatctaatgtctaaggcagctggggtccaagaacccgaatgacttgcccaaggttgcgtaggtaaatgagcagcccgtgaaacactgggtaagagcctgtgcttagaattatatataggccactgcaggaatccaggctctcctcttcgccagcctaaaatcttggtaattccctgaatacctctaaagctcaaattactttctgttaaaggagtagcaatgctacttcagaggctcattgagaagttaaaatgaaaagtaggtagaaagcacctagaaagctctcaataatcagtcgttagaatcattattctaacttagatgtccacattctgtgctgcctcataagcatcccatgttgcatagaagaaatgggaatagtgcgtttagatacatttggtctttctgagactaatgttatatctaatttagattttatggtttgtaagaatgaggaaaaggaagagggcttccagaggaaagtgaacagaaagctgtacagctgtgagattgcagatatttgcttgcctgactctttctggcttggcttgtccatgatgacctgcagaaccaaccaaccactggaggaatgtccaggtgggtgaggcttttgcccacacttcgccccacagctttctggggcttctccccaccttctttcctctcacctctgagtgcttcccttcctttaccccctgcagtgttctcatgcaggcttctcacagcctcccaaagtggggctctacctcttcctgtctcctgggaaaccccgcaaattctggacctttcttccacatataagagtcacctgtgccaggcatggtgcctcacactcgtaatctcagcactttgggaggccaagacaggaggatagtttgagcccaggagtttgagaccagccttggcaatatagtgagactcctatcttttcaaaaaatcaaaaaaattagtcggttgtgctggcacgagcctgtggtcccagcaacacaggtggaggctgaagcaggaggatcacttgcaccgaagaggtgaaggctacagtgagctgtgtttgtgccatggagcccatgcaacagagtgagaccctgtctcaaaaaaaaaaaaaaaaaaagtcacctgccccttgcctcattttacaggactggccagctaatcaattttaacactggctttacttccttttgaataatatttgcatttttctgtgatggagtatttttttcctttta
